United States Patent 9,303,079 (MODIFIED POLYNUCLEOTIDES FOR THE PRODUCTION OF CYTOPLASMIC AND CYTOSKELETAL PROTEINS) - sequence listing, part 7

SEQ ID NO: 10471 - DNA, 681 bp, Artificial Sequence
  Description of Artificial Sequence: Synthetic coding sequence
atgggccccctgcccagaaccgtggagctgttctacgacgtgctgagcccctacagctggctgggcttcgagatcctgtgcagataccagaacatctggaacatcaacctgcagctgagacccagcctgatcaccggcatcatgaaggacagcggcaacaagccccccggcctgctgcccagaaagggcctgtacatggccaacgacctgaagctgctgagacaccacctgcagatccccatccacttccccaaggacttcctgagcgtgatgctggagaagggcagcctgagcgccatgagattcctgaccgccgtgaacctggagcaccccgagatgctggagaaggccagcagagagctgtggatgagagtgtggagcagaaacgaggacatcaccgagccccagagcatcctggccgccgccgagaaggccggcatgagcgccgagcaggcccagggcctgctggagaagatcgccacccccaaggtgaagaaccagctgaaggagaccaccgaggccgcctgcagatacggcgccttcggcctgcccatcaccgtggcccacgtggacggccagacccacatgctgttcggcagcgacagaatggagctgctggcccacctgctgggcgagaagtggatgggccccatcccccccgccgtgaacgccagactgtag

SEQ ID NO: 10472 - DNA, 2055 bp, Artificial Sequence
  Description of Artificial Sequence: Synthetic coding sequence
atggaggccaaccacagcgagcagctgagcgccgagagacagagcaccccccccggcgacagcagcagcctgcccagccacaacggcctggagaaggaggacggccaggacagccccacccccgtgcagccccccgagaaggaggccagcgtgcaccccgacatcagcgaggagctgaacagacagctggaggacatcatcaacacctacggcagcgccgccagcaccgccggcaaggagggcagcgccagagccagcgagcagcccgagaacgccgagagccccgacaacgaggacggcgactgcgaggagaccaccgaggaggccggcagagagcccgtggccagcggcgagccccccaccgtgaaggagcccgtgagcaacaaggagcagaagctggagaagaagatcctgaagggcctgggcaaggaggccaacctgctgatgcagaacctgaacaagctgcagacccccgaggagaagttcgacttcctgttcaagaagtacgccgagctgctggacgagcacagaaccgagcagaagaagctgaagctgctgcagaagaagcaggtgcagatccagaaggagaaggaccagctgcagggcgagcacagcagagccatcctggccagaagcaagctggagagcctgtgcagagagctgcagagacacaacaagaccctgaaggaggaggccctgcagagagccagagaggaggaggagaagagaaaggagatcaccagccacttccagagcaccctgaccgacatccagggccagatcgagcagcagagcgagagaaacatgaagctgtgccaggagaacaccgagctggccgagaagctgaagagcatcatcgaccagtacgagctgagagaggagcacctggacaagatcttcaagcacagagagctgcagcagaagctggtggacgccaagctggagcaggcccaggagatgatgaaggaggccgaggagagacacaagagagagaaggagtacctgctgaaccaggccgccgagtggaagctgcaggccaaggtgctgaaggagcaggagaccgtgctgcaggcccagctgaccctgtacagcggcagattcgaggagttccagagcaccctgaccaagagcaacgaggtgttcgccaccttcaagcaggagatggacaagaccaccaagaagatgaagaagctggagaaggacaccgccacctggaaggccagattcgagaactgcaacaaggccctgctggacatgatcgaggagaaggccctgagagccaaggagtacgagtgcttcgtgatgaagatcggcagactggagaacctgtgcagagccctgcaggaggagagaaacgagctgcacaagaagatcagagacgccgagatcagcgagaaggacgaccagagccagcacaacagcgacgaggagcccgagagcaacgtgagcgtggaccaggagatcgacgccgaggaggtgaacagcgtgcagaccgccgtgaagaacctggccaccgccttcatgatcatccaccaccccgagagcaccccccaccagagcaaggagacccagcccgagatcggcagcagccaggagagcgccgacgccgccctgaaggagcccgagcagccccccctgatccccagcagagacagcgagagccccctgccccccctgaccccccaggccgaggccgagggcggcagcgacgccgagccccccagcaaggccagcaacagccccgccggcctgggcgccgagacccagtgcgagggcctgcccgtgggcgcccaggccgaccaggccagctggaagcccgaggccgaggccagcggccaggccccccaggcccccaccgaggccagcctgcagaagatggaggccgacgtgcccgcccccgcctgcgccgccgaggagcacgtggccgccatggtgcccgcctgcgagcccagcagacagccccccagagccgccgccgaggagctgcccgtgggcgccagcgccggcccccagcccagaaacgtggccgacaccaacctggagggcgtggactag

SEQ ID NO: 10473 - DNA, 1461 bp, Artificial Sequence
  Description of Artificial Sequence: Synthetic coding sequence
atgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgcacaacatgaaggtgctgcccggcatgcaccaccccatccagatgaagcccgccgacagcgagaagaacaacgccgtggaggacagaaagctgttcatcggcatgatcagcaagaagtgcaccgagaacgacatcagagtgatgttcagcagcttcggccagatcgaggagtgcagaatcctgagaggccccgacggcctgagcagaggctgcgccttcgtgaccttcaccaccagagccatggcccagaccgccatcaaggccatgcaccaggcccagaccatggagggctgcagcagccccatggtggtgaagttcgccgacacccagaaggacaaggagcagaagagaatggcccagcagctgcagcagcagatgcagcagatcagcgccgccagcgtgtggggcaacctggccggcctgaacaccctgggcccccagtacctggccctgtacctgcagctgctgcagcagaccgccagcagcggcaacctgaacaccctgagcagcctgcaccccatgggcggcctgaacgccatgcagctgcagaacctggccgccctggccgccgccgccagcgccgcccagaacacccccagcggcaccaacgccctgaccaccagcagcagccccctgagcgtgctgaccagcagcggcagcagccccagcagcagcagcagcaacagcgtgaaccccatcgccagcctgggcgccctgcagaccctggccggcgccaccgccggcctgaacgtgggcagcctggccggcatggccgccctgaacggcggcctgggcagcagcggcctgagcaacggcaccggcagcaccatggaggccctgacccaggcctacagcggcatccagcagtacgccgccgccgccctgcccaccctgtacaaccagaacctgctgacccagcagagcatcggcgccgccggcagccagaaggagggccccgagggcgccaacctgttcatctaccacctgccccaggagttcggcgaccaggacctgctgcagatgttcatgcccttcggcaacgtggtgagcgccaaggtgttcatcgacaagcagaccaacctgagcaagtgcttcggcttcgtgagctacgacaaccccgtgagcgcccaggccgccatccagagcatgaacggcttccagatcggcatgaagagactgaaggtgcagctgaagagaagcaagaacgacagcaagccctactag

SEQ ID NO: 10474 - DNA, 7812 bp, Artificial Sequence
  Description of Artificial Sequence: Synthetic coding sequence
atggagaaggccaccgtgcccgtggccgccgccaccgccgccgagggcgagggcagcccccccgccgtggccgccgtggccggcccccccgccgccgccgaggtgggcggcggcgtgggcggcagcagcagagccagaagcgccagcagccccagaggcatggtgagagtgtgcgacctgctgctgaagaagaagcccccccagcagcagcaccacaaggccaagagaaacagaacctgcagaccccccagcagcagcgagagcagcagcgacagcgacaacagcggcggcggcggcggcggcggcggcggcggcggcggcggcggcggcaccagcagcaacaacagcgaggaggaggaggacgacgacgacgaggaggaggaggtgagcgaggtggagagcttcatcctggaccaggacgacctggagaaccccatgctggagaccgccagcaagctgctgctgagcggcaccgccgacggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgagagccgagagcaccgccaacgccggccagagcgacaacagaagcctggccgaggcctgcagcgagggcgacgtgaacgccgtgagaaagctgctgatcgagggcagaagcgtgaacgagcacaccgaggagggcgagagcctgctgtgcctggcctgcagcgccggctactacgagctggcccaggtgctgctggccatgcacgccaacgtggaggacagaggcatcaagggcgacatcacccccctgatggccgccgccaacggcggccacgtgaagatcgtgaagctgctgctggcccacaaggccgacgtgaacgcccagagcagcaccggcaacaccgccctgacctacgcctgcgccggcggctacgtggacgtggtgaaggtgctgctggagagcggcgccagcatcgaggaccacaacgagaacggccacacccccctgatggaggccggcagcgccggccacgtggaggtggccagactgctgctggagaacggcgccggcatcaacacccacagcaacgagttcaaggagagcgccctgaccctggcctgctacaagggccacctggagatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccagcctggaggaggtgaacgacgagggctacacccccctgatggaggccgccagagagggccacgaggagatggtggccctgctgctgggccagggcgccaacatcaacgcccagaccgaggagacccaggagaccgccctgaccctggcctgctgcggcggcttcctggaggtggccgacttcctgatcaaggccggcgccgacatcgagctgggctgcagcacccccctgatggaggccgcccaggagggccacctggagctggtgaagtacctgctggccgccggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacgtgtgcaccgtgcagttcctgatcagcaagggcgccaacgtgaacagaaccaccgccaacaacgaccacaccgtgctgagcctggcctgcgccggcggccacctggccgtggtggagctgctgctggcccacggcgccgaccccacccacagactgaaggacggcagcaccatgctgatcgaggccgccaagggcggccacaccagcgtggtgtgctacctgctggactaccccaacaacctgctgagcgcccccccccccgacgtgacccagctgaccccccccagccacgacctgaacagagcccccagagtgcccgtgcaggccctgcccatggtggtgcccccccaggagcccgacaagccccccgccaacgtggccaccaccctgcccatcagaaacaaggccgccagcaagcagaagagcagcagccacctgcccgccaacagccaggacgtgcagggctacatcaccaaccagagccccgagagcatcgtggaggaggcccagggcaagctgaccgagctggagcagagaatcaaggaggccatcgagaagaacgcccagctgcagagcctggagctggcccacgccgaccagctgaccaaggagaagatcgaggagctgaacaagaccagagaggagcagatccagaagaagcagaagatcctggaggagctgcagaaggtggagagagagctgcagctgaagacccagcagcagctgaagaagcagtacctggaggtgaaggcccagagaatccagctgcagcagcagcagcagcagagctgccagcacctgggcctgctgacccccgtgggcgtgggcgagcagctgagcgagggcgactacgccagactgcagcaggtggaccccgtgctgctgaaggacgagccccagcagaccgccgcccagatgggcttcgcccccatccagcccctggccatgccccaggccctgcccctggccgccggccccctgccccccggcagcatcgccaacctgaccgagctgcagggcgtgatcgtgggccagcccgtgctgggccaggcccagctggccggcctgggccagggcatcctgaccgagacccagcagggcctgatggtggccagccccgcccagaccctgaacgacaccctggacgacatcatggccgccgtgagcggcagagccagcgccatgagcaacacccccacccacagcatcgccgccagcatcagccagccccagacccccacccccagccccatcatcagccccagcgccatgctgcccatctaccccgccatcgacatcgacgcccagaccgagagcaaccacgacaccgccctgaccctggcctgcgccggcggccacgaggagctggtgcagaccctgctggagagaggcgccagcatcgagcacagagacaagaagggcttcacccccctgatcctggccgccaccgccggccacgtgggcgtggtggagatcctgctggacaacggcgccgacatcgaggcccagagcgagagaaccaaggacacccccctgagcctggcctgcagcggcggcagacaggaggtggtggagctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacaccgccgccgtgaagctgctgctggacatgggcagcgacatcaacgcccagatcgagaccaacagaaacaccgccctgaccctggcctgcttccagggcagaaccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatcggcagaggcgcccacatcgacgtgagaaacaagaagggcaacacccccctgtggctggccgccaacggcggccacctggacgtggtgcagctgctggtgcaggccggcgccgacgtggacgccgccgacaacagaaagatcacccccctgatggccgccttcagaaagggccacgtgaaggtggtgagatacctggtgaaggaggtgaaccagttccccagcgacagcgagtgcatgagatacatcgccaccatcaccgacaaggagatgctgaagaagtgccacctgtgcatggagagcatcgtgcaggccaaggacagacaggccgccgaggccaacaagaacgccagcatcctgctggaggagctggacctggagaagctgagagaggagagcagaagactggccctggccgccaagagagagaagagaaaggagaagagaagaaagaagaaggaggagcagagaagaaagctggaggagatcgaggccaagaacaaggagaacttcgagctgcaggccgcccaggagaaggagaagctgaaggtggaggacgagcccgaggtgctgaccgagccccccagcgccaccaccaccaccaccatcggcatcagcgccacctggaccaccctggccggcagccacggcaagagaaacaacaccatcaccaccaccagcagcaagagaaagaacagaaagaacaagatcacccccgagaacgtgcagatcatcttcgacgaccccctgcccatcagctacagccagcccgagaaggtgaacggcgagagcaagagcagcagcaccagcgagagcggcgacagcgacaacatgagaatcagcagctgcagcgacgagagcagcaacagcaacagcagcagaaagagcgacaaccacagccccgccgtggtgaccaccaccgtgagcagcaagaagcagcccagcgtgctggtgaccttccccaaggaggagagaaagagcgtgagcggcaaggccagcatcaagctgagcgagaccatcagcgagggcaccagcaacagcctgagcacctgcaccaagagcggccccagccccctgagcagccccaacggcaagctgaccgtggccagccccaagagaggccagaagagagaggagggctggaaggaggtggtgagaagaagcaagaaggtgagcgtgcccagcaccgtgatcagcagagtgatcggcagaggcggctgcaacatcaacgccatcagagagttcaccggcgcccacatcgacatcgacaagcagaaggacaagaccggcgacagaatcatcaccatcagaggcggcaccgagagcaccagacaggccacccagctgatcaacgccctgatcaaggaccccgacaaggagatcgacgagctgatccccaagaacagactgaagagcagcagcgccaacagcaagatcggcagcagcgcccccaccaccaccgccgccaacaccagcctgatgggcatcaagatgaccaccgtggccctgagcagcaccagccagaccgccaccgccctgaccgtgcccgccatcagcagcgccagcacccacaagaccatcaagaaccccgtgaacaacgtgagacccggcttccccgtgagcctgcccctggcctacccccccccccagttcgcccacgccctgctggccgcccagaccttccagcagatcagaccccccagactgcccatgacccacttcggcggcaccttcccccccgcccagagcacctggggccccttccccgtgagacccctgagccccgccagagccaccaacagccccaagccccacatggtgcccagacacagcaaccagaacagcagcggcagccaggtgaacagcgccggcagcctgaccagcagccccaccaccaccaccagcagcagcgccagcaccgtgcccggcaccagcaccaacggcagccccagcagccccagcgtgagaagacagctgttcgtgaccgtggtgaagaccagcaacgccaccaccaccaccgtgaccaccaccgccagcaacaacaacaccgcccccaccaacgccacctaccccatgcccaccgccaaggagcactaccccgtgagcagccccagcagccccagcccccccgcccagcccggcggcgtgagcagaaacagccccctggactgcggcagcgccagccccaacaaggtggccagcagcagcgagcaggaggccggcagcccccccgtggtggagaccaccaacaccagaccccccaacagcagcagcagcagcggcagcagcagcgcccacagcaaccagcagcagccccccggcagcgtgagccaggagcccagaccccccctgcagcagagccaggtgcccccccccgaggtgagaatgaccgtgccccccctggccaccagcagcgcccccgtggccgtgcccagcaccgcccccgtgacctaccccatgccccagacccccatgggctgcccccagcccacccccaagatggagacccccgccatcagaccccccccccacggcaccaccgccccccacaagaacagcgccagcgtgcagaacagcagcgtggccgtgctgagcgtgaaccacatcaagagaccccacagcgtgcccagcagcgtgcagctgcccagcaccctgagcacccagagcgcctgccagaacagcgtgcaccccgccaacaagcccatcgcccccaacttcagcgcccccctgcccttcggccccttcagcaccctgttcgagaacagccccaccagcgcccacgccttctggggcggcagcgtggtgagcagccagagcacccccgagagcatgctgagcggcaagagcagctacctgcccaacagcgaccccctgcaccagagcgacaccagcaaggcccccggcttcagaccccccctgcagagacccgcccccagccccagcggcatcgtgaacatggacagcccctacggcagcgtgacccccagcagcacccacctgggcaacttcgccagcaacatcagcggcggccagatgtacggccccggcgcccccctgggcggcgcccccgccgccgccaacttcaacagacagcacttcagccccctgagcctgctgaccccctgcagcagcgccagcaacgacagcagcgcccagagcgtgagcagcggcgtgagagcccccagccccgcccccagcagcgtgcccctgggcagcgagaagcccagcaacgtgagccaggacagaaaggtgcccgtgcccatcggcaccgagagaagcgccagaatcagacagaccggcaccagcgcccccagcgtgatcggcagcaacctgagcaccagcgtgggccacagcggcatctggagcttcgagggcatcggcggcaaccaggacaaggtggactggtgcaaccccggcatgggcaaccccatgatccacagacccatgagcgaccccggcgtgttcagccagcaccaggccatggagagagacagcaccggcatcgtgacccccagcggcaccttccaccagcacgtgcccgccggctacatggacttccccaaggtgggcggcatgcccttcagcgtgtacggcaacgccatgatcccccccgtggcccccatccccgacggcgccggcggccccatcttcaacggcccccacgccgccgaccccagctggaacagcctgatcaagatggtgagcagcagcaccgagaacaacggcccccagaccgtgtggaccggcccctgggccccccacatgaacagcgtgcacatgaaccagctgggctag

SEQ ID NO: 10475 - DNA, 3075 bp, Artificial Sequence
  Description of Artificial Sequence: Synthetic coding sequence
atgaccgagggcagaagatgccaggtgcacctgctggacgacagaaagctggagctgctggtgcagcccaagctgctggccaaggagctgctggacctggtggccagccacttcaacctgaaggagaaggagtacttcggcatcgccttcaccgacgagaccggccacctgaactggctgcagctggacagaagagtgctggagcacgacttccccaagaagagcggccccgtggtgctgtacttctgcgtgagattctacatcgagagcatcagctacctgaaggacaacgccaccatcgagctgttcttcctgaacgccaagagctgcatctacaaggagctgatcgacgtggacagcgaggtggtgttcgagctggccagctacatcctgcaggaggccaagggcgacttcagcagcaacgaggtggtgagaagcgacctgaagaagctgcccgccctgcccacccaggccctgaaggagcaccccagcctggcctactgcgaggacagagtgatcgagcactacaagaagctgaacggccagaccagaggccaggccatcgtgaactacatgagcatcgtggagagcctgcccacctacggcgtgcactactacgccgtgaaggacaagcagggcatcccctggtggctgggcctgagctacaagggcatcttccagtacgactaccacgacaaggtgaagcccagaaagatcttccagtggagacagctggagaacctgtacttcagagagaagaagttcagcgtggaggtgcacgaccccagaagagccagcgtgaccagaagaaccttcggccacagcggcatcgccgtgcacacctggtacgcctgccccgccctgatcaagagcatctgggccatggccatcagccagcaccagttctacctggacagaaagcagagcaagagcaagatccacgccgccagaagcctgagcgagatcgccatcgacctgaccgagaccggcaccctgaagaccagcaagctggccaacatgggcagcaagggcaagatcatcagcggcagcagcggcagcctgctgagcagcggcagccaggagagcgacagcagccagagcgccaagaaggacatgctggccgccctgaagagcagacaggaggccctggaggagaccctgagacagagactggaggagctgaagaagctgtgcctgagagaggccgagctgaccggcaagctgcccgtggagtaccccctggaccccggcgaggagccccccatcgtgagaagaagaatcggcaccgccttcaagctggacgagcagaagatcctgcccaagggcgaggaggccgagctggagagactggagagagagttcgccatccagagccagatcaccgaggccgccagaagactggccagcgaccccaacgtgagcaagaagctgaagaagcagagaaagaccagctacctgaacgccctgaagaagctgcaggagatcgagaacgccatcaacgagaacagaatcaagagcggcaagaagcccacccagagagccagcctgatcatcgacgacggcaacatcgccagcgaggacagcagcctgagcgacgccctggtgctggaggacgaggacagccaggtgaccagcaccatcagccccctgcacagcccccacaagggcctgccccccagaccccccagccacaacagacccccccccccccagagcctggagggcctgagacagatgcactaccacagaaacgactacgacaagagccccatcaagcccaagatgtggagcgagagcagcctggacgagccctacgagaaggtgaagaagagaagcagccacagccacagcagcagccacaagagattccccagcaccggcagctgcgccgaggccggcggcggcagcaacagcctgcagaacagccccatcagaggcctgccccactggaacagccagagcagcatgcccagcacccccgacctgagagtgagaagcccccactacgtgcacagcaccagaagcgtggacatcagccccaccagactgcacagcctggccctgcacttcagacacagaagcagcagcctggagagccagggcaagctgctgggcagcgagaacgacaccggcagccccgacttctacacccccagaaccagaagcagcaacggcagcgaccccatggacgactgcagcagctgcaccagccacagcagcagcgagcactactaccccgcccagatgaacgccaactacagcaccctggccgaggacagccccagcaaggccagacagagacagagacagagacagagagccgccggcgccctgggcagcgccagcagcggcagcatgcccaacctggccgccagaggcggcgccggcggcgccggcggcgccggcggcggcgtgtacctgcacagccagagccagcccagcagccagtacagaatcaaggagtaccccctgtacatcgagggcggcgccacccccgtggtggtgagaagcctggagagcgaccaggagggccactacagcgtgaaggcccagttcaagaccagcaacagctacaccgccggcggcctgttcaaggagagctggagaggcggcggcggcgacgagggcgacaccggcagactgacccccagcagaagccagatcctgagaacccccagcctgggcagagagggcgcccacgacaagggcgccggcagagccgccgtgagcgacgagctgagacagtggtaccagagaagcaccgccagccacaaggagcacagcagactgagccacaccagcagcaccagcagcgacagcggcagccagtacagcaccagcagccagagcaccttcgtggcccacagcagagtgaccagaatgccccagatgtgcaaggccaccagcgccgccctgccccagagccagagaagcagcacccccagcagcgagatcggcgccaccccccccagcagcccccaccacatcctgacctggcagaccggcgaggccaccgagaacagccccatcctggacggcagcgagagccccccccaccagagcaccgacgagtag

SEQ ID NO: 10476 - DNA, 864 bp, Artificial Sequence
  Description of Artificial Sequence: Synthetic coding sequence
atgagccaggcctggtggcacaccagcgtgagccccgccacccaggaggccaaggccggcggcctgctgcagcccagaagacagagactgtggctgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgaagatctgcagactgaccgccgccgcctgcgacgagctggccagcaccctgagcgtgaaccagagcctgagagagctggacctgagcctgaacgagctgggcgacctgggcgtgctgctgctgtgcgagggcctgagacaccccacctgcaagctgcagaccctgagactggacagctgcggcctgaccgccaaggcctgcgagaacctgtacttcaccctgggcatcaaccagaccctgaccgacctgtacctgaccaacaacgccctgggcgacaccggcgtgagactgctgtgcaagagactgagccaccccggctgcaagctgagagtgctgtggctgttcggcatggacctgaacaagatgacccacagcagactggccgccctgagagtgaccaagccctacctggacatcggctgctag

SEQ ID NO: 10477 - DNA, 615 bp, Artificial Sequence
  Description of Artificial Sequence: Synthetic coding sequence
atggccggctacctgagcgagagcgacttcgtgatggtggaggagggcttcagcaccagagacctgctgaaggagctgaccctgggcgccagccaggccaccaccgacgaggtggccgccttcttcgtggccgacctgggcgccatcgtgagaaagcacttctgcttcctgaagtgcctgcccagagtgagacccttctacgccgtgaagtgcaacagcagccccggcgtgctgaaggtgctggcccagctgggcctgggcttcagctgcgccaacaagatcgccagcgtgatcaacagcgccctggacctgtacttccccgagggctgcggcgtggacatcttcgccgagctgggcagatactacgtgaccagcgccttcaccgtggccgtgagcatcatcgccaagaaggaggtgctgctggaccagcccggcagagaggaggagaacggcagcaccagcaagaccatcgtgtaccacctggacgagggcgtgtacggcatcttcaacagcgtgctgttcgacaacatctgccccacccccatcctgcagaagagcaagaaccacagcccctgctacatgagcctggagagcatccacttcatcgccgtgtag

SEQ ID NO: 10478 - DNA, 519 bp, Artificial Sequence
  Description of Artificial Sequence: Synthetic coding sequence
atgatgaagctgaagagcaaccagaccagaacctacgacggcgacggctacaagaagagagccgcctgcctgtgcttcagaagcgagagcgaggaggaggtgctgctggtgagcagcagcagacaccccgacagatggatcgtgcccggcggcggcatggagcccgaggaggagcccagcgtggccgccgtgagagaggtgtgcgaggaggccggcgtgaagggcaccctgggcagactggtgggcatcttcgagaaccaggagagaaagcacagaacctacgtgtacgtgctgatcgtgaccgaggtgctggaggactgggaggacagcgtgaacatcggcagaaagagagagtggttcaagatcgaggacgccatcaaggtgctgcagtaccacaagcccgtgcaggccagctacttcgagaccctgagacagggctacagcgccaacaacggcacccccgtggtggccaccacctacagcgtgagcgcccagagcagcatgagcggcatcagatag

SEQ ID NO: 10479 - DNA, 4284 bp, Artificial Sequence; identical to SEQ ID NO: 9740
  Description of Artificial Sequence: Synthetic coding sequence

SEQ ID NO: 10480 - DNA, 1179 bp, Artificial Sequence
  Description of Artificial Sequence: Synthetic coding sequence
atgggcgacagctgccccgccgtgaccttcagaagccagaaggagaacagagccggcctgcaggagaagctgagatacctgcagcagcagctgcaggacgagacccccagaagacaggaggccgagctgcaggagcccgaggagaagcaggagcccgaggagaagcaggagcccgaggagaagcagaagcccgaggccggcctgagctggaacagcctgggccccgccgccaccagccagggctgccccggcccccccggcagccccgacaagcccagcagaccccacggcctggtgcccgccggctggggcatgggccccagagccggcgagggcccctacgtgagcgagcaggagctgcagaagctgttcaccggcatcgaggagctgagaagagaggtgagcagcctgaccgccagatggcaccaggaggagggcgccgtgcaggaggccctgagactgctgggcggcctgggcggcagagtggacggcttcctgggccagtgggagagagcccagagagagcaggcccagaccgccagagacctgcaggagctgagaggcagagccgacgagctgtgcaccatggtggagagaagcgccgtgagcgtggccagcctgagaagcgagctggagggcctgggccccctgaagcccatcctggaggagttcggcagacagttccagaacagcagaagaggccccgacctgagcatgaacctggacagaagccaccagggcaactgcgccagatgcgccagccagggcagccagctgagcaccgagagcctgcagcagctgctggacagagccctgaccagcctggtggacgaggtgaagcagagaggcctgacccccgcctgccccagctgccagagactgcacaagaagatcctggagctggagagacaggccctggccaagcacgtgagagccgaggccctgagcagcaccctgagactggcccaggacgaggccctgagagccaagaacctgctgctgaccgacaagatgaagcccgaggagaagatggccaccctggaccacctgcacctgaagatgtgcagcctgcacgaccacctgagcaacctgcccctggagggcagcaccggcaccatgggcggcggcagcagcgccggcaccccccccaagcagggcggcagcgcccccgagcagtag

SEQ ID NO: 10481 - DNA, 1692 bp, Artificial Sequence
  Description of Artificial Sequence: Synthetic coding sequence
atgagcgacgacgccggcgacaccctggccaccggcgacaaggccgaggtgaccgagatgcccaacagcgacagcctgcccgaggacgccgaggtgcactgcgacagcgccgccgtgagccacgagcccacccccgccgaccccagaggcgagggccacgagaacgccgccgtgcagggcgccggcgccgccgccatcggcccccccgtgcagccccaggacgccaacgccctggagccccccctgaacggcgacgtgaccgaggacaccctggccgagtgcatcgacagcgtgagcctggaggccgagcccagaagcgagatccccctgcaggagcagaactacctggccgtggacagcccccccagcggcggcggctgggccggctggggcagctggggcaagagcctgctgagcagcgccagcgccaccgtgggccacggcctgaccgccgtgaaggagaaggccggcgccaccctgagaatccacggcgtgaacagcggcagcagcgagggcgcccagcccaacaccgagaacggcgtgcccgagatcaccgacgccgccaccgaccagggccccgccgagagcccccccaccagccccagcagcgccagcagaggcatgctgagcgccatcaccaacgtggtgcagaacaccggcaagagcgtgctgaccggcggcctggacgccctggagttcatcggcaagaagaccatgaacgtgctggccgagagcgaccccggcttcaagagaaccaagaccctgatggagagaaccgtgagcctgagccagatgctgagagaggccaaggagaaggagaagcagagactggcccagcagctgaccatggagagaaccgcccactacggcatgctgttcgacgagtaccagggcctgagccacctggaggccctggagatcctgagcaacgagagcgagagcaaggtgcagagcttcctggccagcctggacggcgagaagctggagctgctgaagaacgacctgatcagcatcaaggacatcttcgccgccaaggagctggagaacgaggagaaccaggaggagcagggcctggaggagaagggcgaggagttcgccagaatgctgaccgagctgctgttcgagctgcacgtggccgccacccccgacaagctgaacaaggccatgaagagagcccacgactgggtggaggaggaccagaccgtggtgagcgtggacgtggccaaggtgagcgaggaggagaccaagaaggaggagaaggaggagaagagccaggacccccaggaggacaagaaggaggagaagaagaccaagaccatcgaggaggtgtacatgagcagcatcgagagcctggccgaggtgaccgccagatgcatcgagcagctgcacaaggtggccgagctgatcctgcacggccaggaggaggagaagcccgcccaggaccaggccaaggtgctgatcaagctgaccaccgccatgtgcaacgaggtggccagcctgagcaagaagttcaccaacagcctgaccaccgtgggcagcaacaagaaggccgaggtgctgaaccccatgatcagcagcgtgctgctggagggctgcaacagcaccacctacatccaggacgccttccagctgctgctgcccgtgctgcaggtgagccacatccagaccagctgcctgaaggcccagccctag

SEQ ID NO: 10482 - DNA, 1257 bp, Artificial Sequence
  Description of Artificial Sequence: Synthetic coding sequence
atgttcagccccgaccaggagaaccaccccagcaaggcccccgtgaagtacggcgagctgatcgtgctgggctacaacggcagcctgcccaacggcgacagaggcagaagaaagagcagattcgccctgttcaagagacccaaggccaacggcgtgaagcccagcaccgtgcacatcgcctgcaccccccaggccgccaaggccatcagcaacaaggaccagcacagcatcagctacaccctgagcagagcccagaccgtggtggtggagtacacccacgacagcaacaccgacatgttccagatcggcagaagcaccgagagccccatcgacttcgtggtgaccgacaccgtgcccggcagccagagcaacagcgacacccagagcgtgcagagcaccatcagcagattcgcctgcagaatcatctgcgagagaaacccccccttcaccgccagaatctacgccgccggcttcgacagcagcaagaacatcttcctgggcgagaaggccgccaagtggaagaccagcgacggccagatggacggcctgaccaccaacggcgtgctggtgatgcaccccagaaacggcttcaccgaggacagcaagcccggcatctggagagagatcagcgtgtgcggcaacgtgttcagcctgagagagaccagaagcgcccagcagagaggcaagatggtggagatcgagaccaaccagctgcaggacggcagcctgatcgacctgtgcggcgccaccctgctgtggagaaccgccgagggcctgagccacacccccaccgtgaagcacctggaggccctgagacaggagatcaacgccgccagaccccagtgccccgtgggcttcaacaccctggccttccccagcatgaagagaaaggacgtggtggacgagaagcagccctgggtgtacctgaactgcggccacgtgcacggctaccacaactggggcaacaaggaggagagagacggcaaggacagagagtgccccatgtgcagaagcgtgggcccctacgtgcccctgtggctgggctgcgaggccggcttctacgtggacgccggcccccccacccacgccttcagcccctgcggccacgtgtgcagcgagaagaccaccgcctactggagccagatccccctgccccacggcacccacaccttccacgccgcctgccccttctgcgcccaccagctggccggcgagcagggctacatcagactgatcttccagggccccctggactag

SEQ ID NO: 10483 - DNA, 3963 bp, Artificial Sequence
  Description of Artificial Sequence: Synthetic coding sequence
atgcaggacgacagcatcgaggccagcaccagcatcagccagctgctgagagagagctacctggccgagaccagacacagaggcaacaacgagagaagcagagccgagcccagcagcaacccctgccacttcggcagccccagcggcgccgccgagggcggcggcggccaggacgacctgcccgacctgagcgccttcctgagccaggaggagctggacgagagcgtgaacctggccagactggccatcaactacgaccccctggagaaggccgacgagacccaggccagaaagagactgagccccgaccagatgaagcacagccccaacctgagcttcgagcccaacttctgccaggacaaccccagaagccccaccagcagcaaggagagcccccaggaggccaagagaccccagtactgcagcgagacccagagcaagaaggtgttcctgaacaaggccgccgacttcatcgaggagctgagcagcctgttcaagagccacagcagcaagagaatcagacccagagcctgcaagaaccacaagagcaagctggagagccagaacaaggtgatgcaggagaacagcagcagcttcagcgacctgagcgagagaagagagagaagcagcgtgcccatccccatccccgccgacaccagagacaacgaggtgaaccacgccctggagcagcaggaggccaagagaagagaggccgagcaggccgccagcgaggccgccggcggcgacaccacccccggcagcagccccagcagcctgtactacgaggagcccctgggccagccccccagattcacccagaagctgagaagcagagaggtgcccgagggcaccagagtgcagctggactgcatcgtggtgggcatcccccccccccaggtgagatggtactgcgagggcaaggagctggagaacagccccgacatccacatcgtgcaggccggcaacctgcacagcctgaccatcgccgaggccttcgaggaggacaccggcagatacagctgcttcgccagcaacatctacggcaccgacagcaccagcgccgagatctacatcgagggcgtgagcagcagcgacagcgagggcgaccccaacaaggaggagatgaacagaatccagaagcccaacgaggtgagcagcccccccaccaccagcgccgtgatcccccccgccgtgccccaggcccagcacctggtggcccagcccagagtggccaccatccagcagtgccagagccccaccaactacctgcagggcctggacggcaagcccatcatcgccgcccccgtgttcaccaagatgctgcagaacctgagcgccagcgagggccagctggtggtgttcgagtgcagagtgaagggcgcccccagccccaaggtggagtggtacagagagggcaccctgatcgaggacagccccgacttcagaatcctgcagaagaagcccagaagcatggccgagcccgaggagatctgcaccctggtgatcgccgaggtgttcgccgaggacagcggctgcttcacctgcaccgccagcaacaagtacggcaccgtgagcagcatcgcccagctgcacgtgagaggcaacgaggacctgagcaacaacggcagcctgcacagcgccaacagcaccaccaacctggccgccatcgagccccagcccagccccccccacagcgagccccccagcgtggagcagccccccaagcccaagctggagggcgtgctggtgaaccacaacgagcccagaagcagcagcagaatcggcctgagagtgcacttcaacctgcccgaggacgacaagggcagcgaggccagcagcgaggccggcgtggtgaccaccagacagaccagacccgacagcttccaggagagattcaacggccaggccaccaagacccccgagcccagcagccccgtgaaggagcccccccccgtgctggccaagcccaagctggacagcacccagctgcagcagctgcacaaccaggtgctgctggagcagcaccagctgcagaaccccccccccagcagccccaaggagttccccttcagcatgaccgtgctgaacagcaacgccccccccgccgtgaccaccagcagcaagcaggtgaaggcccccagcagccagaccttcagcctggccagacccaagtacttcttccccagcaccaacaccaccgccgccaccgtggcccccagcagcagccccgtgttcaccctgagcagcaccccccagaccatccagagaaccgtgagcaaggagagcctgctggtgagccaccccagcgtgcagaccaagagccccggcggcctgagcatccagaacgagcccctgccccccggccccaccgagcccacccccccccccttcaccttcagcatccccagcggcaaccagttccagcccagatgcgtgagccccatccccgtgagccccaccagcagaatccagaaccccgtggccttcctgagcagcgtgctgcccagcctgcccgccatcccccccaccaacgccatgggcctgcccagaagcgcccccagcatgcccagccagggcctggccaagaagaacaccaagagcccccagcccgtgaacgacgacaacatcagagagaccaagaacgccgtgatcagagacctgggcaagaagatcaccttcagcgacgtgagacccaaccagcaggagtacaagatcagcagcttcgagcagagactgatgaacgagatcgagttcagactggagagaacccccgtggacgagagcgacgacgagatccagcacgacgagatccccaccggcaagtgcatcgcccccatcttcgacaagagactgaagcacttcagagtgaccgagggcagccccgtgaccttcacctgcaagatcgtgggcatccccgtgcccaaggtgtactggttcaaggacggcaagcagatcagcaagagaaacgagcactgcaagatgagaagagagggcgacggcacctgcagcctgcacatcgagagcaccaccagcgacgacgacggcaactacaccatcatggccgccaacccccagggcagaatcagctgcagcggccacctgatggtgcagagcctgcccatcagaagcagactgaccagcgccggccagagccacagaggcagaagcagagtgcaggagagagacaaggagcccctgcaggagagattcttcagaccccacttcctgcaggcccccggcgacatggtggcccacgagggcagactgtgcagactggactgcaaggtgagcggcctgcccccccccgagctgacctggctgctgaacggccagcccgtgctgcccgacgccagccacaagatgctggtgagagagaccggcgtgcacagcctgctgatcgaccccctgacccagagagacgccggcacctacaagtgcatcgccaccaacaagaccggccagaacagcttcagcctggagctgagcgtggtggccaaggaggtgaagaaggcccccgtgatcctggagaagctgcagaactgcggcgtgcccgagggccaccccgtgagactggagtgcagagtgatcggcatgcccccccccgtgttctactggaagaaggacaacgagaccatcccctgcaccagagagagaatcagcatgcaccaggacaccaccggctacgcctgcctgctgatccagcccgccaagaagagcgacgccggctggtacaccctgagcgccaagaacgaggccggcatcgtgagctgcaccgccagactggacatctacgcccagtggcaccaccagatccccccccccatgagcgtgagacccagcggcagcagatacggcagcctgaccagcaagggcctggacatcttcagcgccttcagcagcatggagagcaccatggtgtacagctgcagcagcagaagcgtggtggagagcgacgagctgtag

SEQ ID NO: 10484 - DNA, 4206 bp, Artificial Sequence
  Description of Artificial Sequence: Synthetic coding sequence
atggccagctgcgccagcatcgacatcgaggacgccacccagcacctgagagacatcctgaagctggacagacccgccggcggccccagcgccgagagccccagacccagcagcgcctacaacggcgacctgaacggcctgctggtgcccgaccccctgtgcagcggcgacagcaccagcgccaacaagaccggcctgagaaccatgccccccatcaacctgcaggagaagcaggtgatctgcctgagcggcgacgacagcagcacctgcatcggcatcctggccaaggaggtggagatcgtggccagcagcgacagcagcatcagcagcaaggccagaggcagcaacaaggtgaagatccagcccgtggccaagtacgactgggagcagaagtactactacggcaacctgatcgccgtgagcaacagcttcctggcctacgccatcagagccgccaacaacggcagcgccatggtgagagtgatcagcgtgagcaccagcgagagaaccctgctgaagggcttcaccggcagcgtggccgacctggccttcgcccacctgaacagcccccagctggcctgcctggacgaggccggcaacctgttcgtgtggagactggccctggtgaacggcaagatccaggaggagatcctggtgcacatcagacagcccgagggcacccccctgaaccacttcagaagaatcatctggtgccccttcatccccgaggagagcgaggactgctgcgaggagagcagccccaccgtggccctgctgcacgaggacagagccgaggtgtgggacctggacatgctgagaagcagccacagcacctggcccgtggacgtgagccagatcaagcagggcttcatcgtggtgaagggccacagcacctgcctgagcgagggcgccctgagccccgacggcaccgtgctggccaccgccagccacgacggctacgtgaagttctggcagatctacatcgagggccaggacgagcccagatgcctgcacgagtggaagccccacgacggcagacccctgagctgcctgctgttctgcgacaaccacaagaagcaggaccccgacgtgcccttctggagattcctgatcaccggcgccgaccagaacagagagctgaagatgtggtgcaccgtgagctggacctgcctgcagaccatcagattcagccccgacatcttcagcagcgtgagcgtgccccccagcctgaaggtgtgcctggacctgagcgccgagtacctgatcctgagcgacgtgcagagaaaggtgctgtacgtgatggagctgctgcagaaccaggaggagggccacgcctgcttcagcagcatcagcgagttcctgctgacccaccccgtgctgagcttcggcatccaggtggtgagcagatgcagactgagacacaccgaggtgctgcccgccgaggaggagaacgacagcctgggcgccgacggcacccacggcgccggcgccatggagagcgccgccggcgtgctgatcaagctgttctgcgtgcacaccaaggccctgcaggacgtgcagatcagattccagccccagctgaaccccgacgtggtggcccccctgcccacccacaccgcccacgaggacttcaccttcggcgagagcagacccgagctgggcagcgagggcctgggcagcgccgcccacggcagccagcccgacctgagaagaatcgtggagctgcccgcccccgccgacttcctgagcctgagcagcgagaccaagcccaagctgatgacccccgacgccttcatgacccccagcgccagcctgcagcagatcaccgccagccccagcagcagcagcagcggcagcagcagcagcagcagcagcagcagcagcagcctgaccgccgtgagcgccatgagcagcaccagcgccgtggaccccagcctgaccagaccccccgaggagctgaccctgagccccaagctgcagctggacggcagcctgaccatgagcagcagcggcagcctgcaggccagccccagaggcctgctgcccggcctgctgcccgcccccgccgacaagctgacccccaagggccccggccaggtgcccaccgccaccagcgccctgagcctggagctgcaggaggtggagcccctgggcctgccccaggccagccccagcagaaccagaagccccgacgtgatcagcagcgccagcaccgccctgagccaggacatccccgagatcgccagcgaggccctgagcagaggcttcggcagcagcgcccccgagggcctggagcccgacagcatggccagcgccgccagcgccctgcacctgctgagccccagacccagacccggccccgagctgggcccccagctgggcctggacggcggccccggcgacggcgacagacacaacacccccagcctgctggaggccgccctgacccaggaggccagcacccccgacagccaggtgtggcccaccgcccccgacatcaccagagagacctgcagcaccctggccgagagccccagaaacggcctgcaggagaagcacaagagcctggccttccacagacccccctaccacctgctgcagcagagagacagccaggacgccagcgccgagcagagcgaccacgacgacgaggtggccagcctggccagcgccagcggcggcttcggcaccaaggtgcccgcccccagactgcccgccaaggactggaagaccaagggcagccccagaaccagccccaagctgaagagaaagagcaagaaggacgacggcgacgccgccatgggcagcagactgaccgagcaccaggtggccgagccccccgaggactggcccgccctgatctggcagcagcagagagagctggccgagctgagacacagccaggaggagctgctgcagagactgtgcacccagctggagggcctgcagagcaccgtgaccggccacgtggagagagccctggagaccagacacgagcaggagcagagaagactggagagagccctggccgagggccagcagagaggcggccagctgcaggagcagctgacccagcagctgagccaggccctgagcagcgccgtggccggcagactggagagaagcatcagagacgagatcaagaagaccgtgcccccctgcgtgagcagaagcctggagcccatggccggccagctgagcaacagcgtggccaccaagctgaccgccgtggagggcagcatgaaggagaacatcagcaagctgctgaagagcaagaacctgaccgacgccatcgccagagccgccgccgacaccctgcagggccccatgcaggccgcctacagagaggccttccagagcgtggtgctgcccgccttcgagaagagctgccaggccatgttccagcagatcaacgacagcttcagactgggcacccaggagtacctgcagcagctggagagccacatgaagagcagaaaggccagagagcaggaggccagagagcccgtgctggcccagctgagaggcctggtgagcaccctgcagagcgccaccgagcagatggccgccaccgtggccggcagcgtgagagccgaggtgcagcaccagctgcacgtggccgtgggcagcctgcaggagagcatcctggcccaggtgcagagaatcgtgaagggcgaggtgagcgtggccctgaaggagcagcaggccgccgtgaccagcagcatcatgcaggccatgagaagcgccgccggcacccccgtgcccagcgcccacctggactgccaggcccagcaggcccacatcctgcagctgctgcagcagggccacctgaaccaggccttccagcaggccctgaccgccgccgacctgaacctggtgctgtacgtgtgcgagaccgtggaccccgcccaggtgttcggccagcccccctgccccctgagccagcccgtgctgctgagcctgatccagcagctggccagcgacctgggcaccagaaccgacctgaagctgagctacctggaggaggccgtgatgcacctggaccacagcgaccccatcaccagagaccacatgggcagcgtgatggcccaggtgagacagaagctgttccagttcctgcaggccgagccccacaacagcctgggcaaggccgccagaagactgagcctgatgctgcacggcctggtgacccccagcctgccctag

SEQ ID NO: 10485 - DNA, 576 bp, Artificial Sequence
  Description of Artificial Sequence: Synthetic coding sequence
atgagcagcggcgccgacggcggcggcggcgccgccgtggccgccagaagcgacaagggcagccccggcgaggacggcttcgtgcccagcgccctgggcaccagagagcactgggacgccgtgtacgagagagagctgcagaccttcagagagtacggcgacaccggcgagatctggttcggcgaggagagcatgaacagactgatcagatggatgcagaagcacaagatccccctggacgccagcgtgctggacatcggcaccggcaacggcgtgttcctggtggagctggccaagttcggcttcagcaacatcaccggcatcgactacagccccagcgccatccagctgagcggcagcatcatcgagaaggagggcctgagcaacatcaagctgaaggtggaggacttcctgaacctgagcacccagctgagcggcttccacatctgcatcgacaagggcaccttcgacgccatcagcctgaaccccgacaacgccatcgagaagagaaagcagtacgtgaagagcctgagcagagtgctgaaggtgaagggcttcttcaacaacgtgatgtag

SEQ ID NO: 10486 - DNA, 2622 bp, Artificial Sequence
  Description of Artificial Sequence: Synthetic coding sequence
atgggcaacagagagatggaggagctgatccccctggtgaacagactgcaggacgccttcagcgccctgggccagagctgcctgctggagctgccccagatcgccgtggtgggcggccagagcgccggcaagagcagcgtgctggagaacttcgtgggcagagacttcctgcccagaggcagcggcatcgtgaccagaagacccctggtgctgcagctggtgaccagcaaggccgagtacgccgagttcctgcactgcaagggcaagaagttcaccgacttcgacgaggtgagactggagatcgaggccgagaccgacagagtgaccggcatgaacaagggcatcagcagcatccccatcaacctgagagtgtacagcccccacgtgctgaacctgaccctgatcgacctgcccggcatcaccaaggtgcccgtgggcgaccagccccccgacatcgagtaccagatcagagagatgatcatgcagttcatcaccagagagaactgcctgatcctggccgtgacccccgccaacaccgacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacgtgggcgtggtgaacagaagccagaaggacatcgacggcaagaaggacatcaaggccgccatgctggccgagagaaagttcttcctgagccaccccgcctacagacacatcgccgacagaatgggcaccccccacctgcagaaggtgctgaaccagcagctgaccaaccacatcagagacaccctgcccaacttcagaaacaagctgcagggccagctgctgagcatcgagcacgaggtggaggcctacaagaacttcaagcccgaggaccccaccagaaagaccaaggccctgctgcagatggtgcagcagttcgccgtggacttcgagaagagaatcgagggcagcggcgaccaggtggacaccctggagctgagcggcggcgccaagatcaacagaatcttccacgagagattccccttcgagatcgtgaagatggagttcaacgagaaggagctgagaagagagatcagctacgccatcaagaacatccacggcatcagaaccggcctgttcacccccgacatggccttcgaggccatcgtgaagaagcagatcgtgaagctgaagggccccagcctgaagagcgtggacctggtgatccaggagctgatcaacaccgtgaagaagtgcaccaagaagctggccaacttccccagactgtgcgaggagaccgagagaatcgtggccaaccacatcagagagagagagggcaagaccaaggaccaggtgctgctgctgatcgacatccaggtgagctacatcaacaccaaccacgaggacttcatcggcttcgccaacgcccagcagagaagcagccaggtgcacaagaagaccaccgtgggcaaccagggcaccaacctgccccccagcagacagatcgtgatcagaaagggctggctgaccatcagcaacatcggcatcatgaagggcggcagcaagggctactggttcgtgctgaccgccgagagcctgagctggtacaaggacgacgaggagaaggagaagaagtacatgctgcccctggacaacctgaaggtgagagacgtggagaagagcttcatgagcagcaagcacatcttcgccctgttcaacaccgagcagagaaacgtgtacaaggactacagattcctggagctggcctgcgacagccaggaggacgtggacagctggaaggccagcctgctgagagccggcgtgtaccccgacaagagcgtgatgaacaagaaggccgagaacgacgagaacggccaggccgagaacttcagcatggacccccagctggagagacaggtggagaccatcagaaacctggtggacagctacatgagcatcatcaacaagtgcatcagagacctgatccccaagaccatcatgcacctgatgatcaacaacgtgaaggacttcatcaacagcgagctgctggcccagctgtacagcagcgaggaccagaacaccctgatggaggagagcgccgagcaggcccagagaagagacgagatgctgagaatgtaccaggccctgaaggaggccctgggcatcatcggcgacatcagcaccgccaccgtgagcacccccgcccccccccccgtggacgacagctggatccagcacagcagaagaagccccccccccagccccaccacccagagaagacccaccctgagcgcccccctggccagacccaccagcggcagaggccccgcccccgccatccccagccccggcccccacagcggcgccccccccgtgcccttcagacccggccccctgccccccttccccagcagcagcgacagcttcggcgcccccccccaggtgcccagcagacccaccagagccccccccagcgtgcccagcagaagacccccccccagccccaccagacccaccatcatcagacccctggagagcagcctgctggactag

SEQ ID NO: 10487 - DNA, 3111 bp, Artificial Sequence
  Description of Artificial Sequence: Synthetic coding sequence
atgagaaagcaggaggtgagaaccggcagagaggccggccagggccacggcaccggcagccccgccgagcaggtgaaggccctgatggacctgctggccggcaagggcagccagggcagccaggccccccaggccctggacagaacccccgacgcccccctgggcccctgcagcaacgacagcagaatccagagacacagaaaggccctgctgagcaaggtgggcggcggccccgagctgggcggcccctggcacagactggccagcctgctgctggtggagggcctgaccgacctgcagctgagagagcacgacttcacccaggtggaggccaccagaggcggcggccaccccgccagaaccgtggccctggacagactgttcctgcccctgagcagagtgagcgtgccccccagagtgagcatcaccatcggcgtggccggcatgggcaagaccaccctggtgagacacttcgtgagactgtgggcccacggccaggtgggcaaggacttcagcctggtgctgcccctgaccttcagagacctgaacacccacgagaagctgtgcgccgacagactgatctgcagcgtgttcccccacgtgggcgagcccagcctggccgtggccgtgcccgccagagccctgctgatcctggacggcctggacgagtgcagaacccccctggacttcagcaacaccgtggcctgcaccgaccccaagaaggagatccccgtggaccacctgatcaccaacatcatcagaggcaacctgttccccgaggtgagcatctggatcaccagcagacccagcgccagcggccagatccccggcggcctggtggacagaatgaccgagatcagaggcttcaacgaggaggagatcaaggtgtgcctggagcagatgttccccgaggaccaggccctgctgggctggatgctgagccaggtgcaggccgacagagccctgtacctgatgtgcaccgtgcccgccttctgcagactgaccggcatggccctgggccacctgtggagaagcagaaccggcccccaggacgccgagctgtggccccccagaaccctgtgcgagctgtacagctggtacttcagaatggccctgagcggcgagggccaggagaagggcaaggccagccccagaatcgagcaggtggcccacggcggcagaaagatggtgggcaccctgggcagactggccttccacggcctgctgaagaagaagtacgtgttctacgagcaggacatgaaggccttcggcgtggacctggccctgctgcagggcgccccctgcagctgcttcctgcagagagaggagaccctggccagcagcgtggcctactgcttcacccacctgagcctgcaggagttcgtggccgccgcctactactacggcgccagcagaagagccatcttcgacctgttcaccgagagcggcgtgagctggcccagactgggcttcctgacccacttcagaagcgccgcccagagagccatgcaggccgaggacggcagactggacgtgttcctgagattcctgagcggcctgctgagccccagagtgaacgccctgctggccggcagcctgctggcccagggcgagcaccaggcctacagaacccaggtggccgagctgctgcagggctgcctgagacccgacgccgccgtgtgcgccagagccatcaacgtgctgcactgcctgcacgagctgcagcacaccgagctggccagaagcgtggaggaggccatggagagcggcgccctggccagactgaccggccccgcccacagagccgccctggcctacctgctgcaggtgagcgacgcctgcgcccaggaggccaacctgagcctgagcctgagccagggcgtgctgcagagcctgctgccccagctgctgtactgcagaaagctgagactggacaccaaccagttccaggaccccgtgatggagctgctgggcagcgtgctgagcggcaaggactgcagaatccagaagatcagcctggccgagaaccagatcagcaacaagggcgccaaggccctggccagaagcctgctggtgaacagaagcctgaccagcctggacctgagaggcaacagcatcggcccccagggcgccaaggccctggccgacgccctgaagatcaacagaaccctgaccagcctgagcctgcagggcaacaccgtgagagacgacggcgccagaagcatggccgaggccctggccagcaacagaaccctgagcatgctgcacctgcagaagaacagcatcggccccatgggcgcccagagaatggccgacctgaagcagaacagaagcctgaaggagctgatgttcagcagcaacagcatcggcgacggcggcgccaaggccctggccgaggccctgaaggtgaaccagggcctggagagcctggacctgcagagcaacagcatcagcgacgccggcgtggccgccctgatgggcgccctgtgcaccaaccagaccctgctgagcctgagcctgagagagaacagcatcagccccgagggcgcccaggccatcgcccacgccctgtgcgccaacagcaccctgaagaacctggacctgcagtggaacttcatccaggccggcgccgcccaggccctgggccaggccctgcagctgaacagaagcctgaccagcctggacctgcaggagaacgccatcggcgacgacggcgcctgcgccgtggccagagccctgaaggtgaacaccgccctgaccgccctgtacctgcaggtggccagcatcggcgccagcggcgcccaggtgctgggcgaggccctggccgtgaacagaaccctggagatcctggacctgagaggcaacgccatcggcgtggccggcgccaaggccctggccaacgccctgaaggtgaacagcagcctgagaagactgaacctgcaggagaacagcctgggcatggacggcgccatctgcatcgccaccgccctgagcggcaaccacagactgcagcacatcaacctgcagggcaaccacatcggcgacagcggcgccagaatgatcagcgaggccatcaagaccaacgcccccacctgcaccgtggagatgtag

SEQ ID NO: 10488 - DNA, 2784 bp, Artificial Sequence
  Description of Artificial Sequence: Synthetic coding sequence
atgttctggaagttcgacctgaacaccaccagccacgtggacaagctgctggacaaggagcacgtgaccctgcaggagctgatggacgaggacgacatcctgcaggagtgcaaggcccagaaccagaagctgctggacttcctgtgcagacagcagtgcatggaggagctggtgagcctgatcacccaggacccccccctggacatggaggagaaggtgagattcaagtaccccaacaccgcctgcgagctgctgacctgcgacgtgccccagatcagcgacagactgggcggcgacgagagcctgctgagcctgctgtacgacttcctggaccacgagccccccctgaaccccctgctggccagcttcttcagcaagaccatcggcaacctgatcgccagaaagaccgagcaggtgatcaccttcctgaagaagaaggacaagttcatcagcctggtgctgaagcacatcggcaccagcgccctgatggacctgctgctgagactggtgagctgcgtggagcccgccggcctgagacaggacgtgctgcactggctgaacgaggagaaggtgatccagagactggtggagctgatccaccccagccaggacgaggacagacagagcaacgccagccagaccctgtgcgacatcgtgagactgggcagagaccagggcagccagctgcaggaggccctggagcccgaccccctgctgaccgccctggagagccaggactgcgtggagcagctgctgaagaacatgttcgacggcgacagaaccgagagctgcctggtgagcggcacccaggtgctgctgaccctgctggagaccagaagagtgggcaccgagggcctggtggacagcttcagccagggcctggagagaagctacgccgtgagcagcagcgtgctgcacggcatcgagcccagactgaaggacttccaccagctgctgctgaacccccccaagaagaaggccatcctgaccaccatcggcgtgctggaggagcccctgggcaacgccagactgcacggcgccagactgatggccgccctgctgcacaccaacacccccagcatcaaccaggagctgtgcagactgaacaccatggacctgctgctggacctgttcttcaagtacacctggaacaacttcctgcacttccaggtggagctgtgcatcgccgccatcctgagccacgccgccagagaggagagaaccgaggccagcggcagcgagagcagagtggagcccccccacgagaacggcaacagaagcctggagaccccccagcccgccgccagcctgcccgacaacaccatggtgacccacctgttccagaagtgctgcctggtgcagagaatcctggaggcctgggaggccaacgaccacacccaggccgccggcggcatgagaagaggcaacatgggccacctgaccagaatcgccaacgccgtggtgcagaacctggagagaggccccgtgcagacccacatcagcgaggtgatcagaggcctgcccgccgactgcagaggcagatgggagagcttcgtggaggagaccctgaccgagaccaacagaagaaacaccgtggacctggccttcagcgactaccagatccagcagatgaccgccaacttcgtggaccagttcggcttcaacgacgaggagttcgccgaccaggacgacaacatcaacgcccccttcgacagaatcgccgagatcaacttcaacatcgacgccgacgaggacagccccagcgccgccctgttcgaggcctgctgcagcgacagaatccagcccttcgacgacgacgaggacgaggacatctgggaggacagcgacaccagatgcgccgccagagtgatggccagacccagattcggcgccccccacgccagcgagagctgcagcaagaacggccccgagagaggcggccaggacggcaaggccagcctggaggcccacagagacgcccccggcgccggcgccccccccgcccccggcaagaaggaggccccccccgtggagggcgacagcgaggccggcgccatgtggaccgccgtgttcgacgagcccgccaacagcacccccaccgcccccggcgtggtgagagacgtgggcagcagcgtgtgggccgccggcaccagcgcccccgaggagaagggctgggccaagttcaccgacttccagcccttctgctgcagcgagagcggccccagatgcagcagccccgtggacaccgagtgcagccacgccgagggcagcagaagccagggccccgagaaggccttcagccccgccagcccctgcgcctggaacgtgtgcgtgaccagaaaggcccccctgctggccagcgacagcagcagcagcggcggcagccacagcgaggacggcgaccagaaggccgccagcgccatggacgccgtgagcagaggccccggcagagaggccccccccctgcccaccgtggccagaaccgaggaggccgtgggcagagtgggctgcgccgacagcagactgctgagccccgcctgccccgcccccaaggaggtgaccgccgcccccgccgtggccgtgccccccgaggccaccgtggccatcaccaccgccctgagcaaggccggccccgccatccccacccccgccgtgagcagcgccctggccgtggccgtgcccctgggccccatcatggccgtgaccgccgcccccgccatggtggccaccctgggcaccgtgaccaaggacggccagatgcccagacagaaggagctgccctag

SEQ ID NO: 10489 - DNA, 2220 bp, Artificial Sequence
  Description of Artificial Sequence: Synthetic coding sequence
atgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacctgctggccctgggcctgaagcacttcgagggcaccgagttcctgaaccccctgatcagcaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 10490 - DNA, 1911 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagctgagattcccctgcagaatcaccgagagcaagaacatgaacatcctgatcgtgctggacatgctgtgctacatcagcagcgagaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaagatgagaggccagatggagagccacctgaaggagctggagagagtgtgcgacagcctgaccgccgccgagagaagactgcacgagtgccaggagagcctgcagtgctgcaagggcaagtgcgccgaccaggagcacaccatcagagagctgcagggccaggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcgaccccgagaccccctag

SEQ ID NO: 10491 - DNA, 873 bp, Artificial Sequence
  Description of Artificial Sequence: Synthetic coding sequence
atggccgccgtggagaagagaagacaggccgtgcccccccccgccggcttcaccgacagcggcagacagagcgtgagcagagccgccggcgccgccgagagcgaggaggacttcctgagacaggtgggcgtgaccgagatgctgagagccgccctgctgaaggtgctggaggccagacccgaggagcccatcgccttcctggcccactacttcgagaacatgggcctgagaagccccgtgaacggcggcgccggcgagccccccggccagctgctgctgcagcagcagagactgggcagagccctgtggcacctgagactggcccaccacagccagagagccgccttcaacaacaacgtgagcgtggcctacgagtgcctgagcgccggcggcagaagaaagagacccggcctggacggcagaacctacagcgagctgctgagaagaatctgcagagacggccaggcccccgaggaggtggtggcccccctgctgagaaaggtgcagtgcagagaccacgaggccgtgcccctgagcgtgttcagagccggcaccctgacctgcttcgtgctgctggagttcgtggccagagccggcgccctgttccagctgctggaggacagcgccgccgccgtggccgacagaagagtgggccaggccgtgctggacaccctggagggcgccctgcaggccagcgacgccgccgcccccgccagattcctggaggccggcagcagactgggccccgacagcctggccctggccctggacagagccgtgggcggcagaagacccagcgcccccatgaccagagaggagttcctggagagagccgccgccctgttcatcgccaaggtgaagcccgtgggctag

SEQ ID NO: 10492 - DNA, 1221 bp, Artificial Sequence
  Description of Artificial Sequence: Synthetic coding sequence
atggccgacagccagctgttctgcgtggccgaggagagaagcggccactgcgccgtggtggacggcaacttcctgtacgtgtggggcggctacgtgagcatcgaggacaacgaggtgtacctgcccaacgacgagatctggacctacgacatcgacagcggcctgtggagaatgcacctgatggagggcgagctgcccgccagcatgagcggcagctgcggcgcctgcatcaacggcaagctgtacatcttcggcggctacgacgacaagggctacagcaacagactgtacttcgtgaacctgagaaccagagacgagacctacatctgggagaagatcaccgacttcgagggccagccccccacccccagagacaagctgagctgctgggtgtacaaggacagactgatctacttcggcggctacggctgcagaagacacagcgagctgcaggactgcttcgacgtgcacgacgccagctgggaggagcagatcttctggggctggcacaacgacgtgcacatcttcgacaccaagacccagacctggttccagcccgagatcaagggcggcgtgcccccccagcccagagccgcccacacctgcgccgtgctgggcaacaagggctacatcttcggcggcagagtgctgcagaccagaatgaacgacctgcactacctgaacctggacacctggacctggagcggcagaatcaccatcaacggcgagagccccaagcacagaagctggcacaccctgacccccatcgccgacgacaagctgttcctgtgcggcggcctgagcgccgacaacatccccctgagcgacggctggatccacaacgtgaccaccaactgctggaagcagctgacccacctgcccaagaccagacccagactgtggcacaccgcctgcctgggcaaggagaacgagatcatggtgttcggcggcagcaaggacgacctgctggccctggacaccggccactgcaacgacctgctgatcttccagacccagccctacagcctgctgagaagctgcctggactgcatcggcaagaacagcatcatgctggagagccagatcagcctgctgccccccaagctgctgcagcaggtgctgaagaagatcaccttctgggccgccgccaaccacagagaggagcagagagtgcagaaggaggagaccgagaacaagtaccagtggatcagcagcaactag

SEQ ID NO: 10493 - DNA, 1113 bp, Artificial Sequence
  Description of Artificial Sequence: Synthetic coding sequence
atggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcatccccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacatcgagagcgccaactgcttcagaagcaacagagtggacatgcagcccaccgacatgcacagcctgctgctgcagccccagccccccctgctgcagcccctgcagcccctgaccgtgaccgtgatggccggctgcacccagcccacccccaccatgcccctgcccctgcccctggccatggagctggccctgtggagagtgtacaccgaggtggccaccgccgacctgccccccaccgaggtgacctag

SEQ ID NO: 10494 - DNA, 534 bp, Artificial Sequence
  Description of Artificial Sequence: Synthetic coding sequence
atgagcgaggacagcgagaaggaggactacagcgacagaaccatcagcgacgaggacgagagcgacgaggacatgttcatgaagttcgtgagcgaggacctgcacagatgcgccctgctgaccgccgacagcttcggcgaccccttcttccccagaaccacccagatcctgctggagtaccagctgggcagatgggtgcccagactgagagagcccagagacctgtacggcgtgagcagcagcggccccctgagccccaccagatggccctaccactgcgaggtgatcgacgagaaggtgcagcacatcgacggcgtgagctgctggagcgagagccaccaggccggcgcccagtggtgcgacctgggcagcctgcagccccccccccccagattcaagagattcgcctgcttcagcctgctgagcagcagagactacagaagagtgccccccagaagcgccaacttcgtgttcctggtggagaccggcttccaccacgtgggccaggacggcctgagactgctgaccagctag

SEQ ID NO: 10495 - DNA, 1827 bp, Artificial Sequence
  Description of Artificial Sequence: Synthetic coding sequence
atgagcgacaagagcgacctgaaggccgagctggagagaaagaagcagagactggcccagatcagagaggagaagaagagaaaggaggaggagagaaagaagaaggaggccgacatgcagcagaagaaggagcccgtgcaggacgacagcgacctggacagaaagagaagagagaccgaggccctgctgcagagcatcggcatcagccccgagccccccctggtgcccacccccatgagccccagcagcaagagcgtgagcacccccagcgaggccggcagccaggacagcggcgacctgggccccctgaccagaagaagactgcacaagctgggcgtgagcaaggtgacccaggtggacttcctgcccagagaggtggtgagctacagcaaggagacccagacccccctggccacccaccagagcgaggaggacgaggaggacgaggagatggtggagagcaaggtgggccaggacagcgagctggagaaccaggacaagaagcaggaggtgaaggaggccccccccagagagctgaccgaggaggagaagcagcagatcctgcacagcgaggagttcctgatcttcttcgacagaaccatcagagtgatcgagagagccctggccgaggacagcgacatcttcttcgactacagcggcagagagctggaggagaaggacggcgacgtgcaggccggcgccaacctgagcttcaacagacagttctacgacgagcactggagcaagcacagagtggtgacctgcatggactggagcctgcagtaccccgagctgatggtggccagctacaacaacaacgaggacgccccccacgagcccgacggcgtggccctggtgtggaacatgaagttcaagaagaccacccccgagtacgtgttccactgccagagcagcgtgatgagcgtgtgcttcgccagattccaccccaacctggtggtgggcggcacctacagcggccagatcgtgctgtgggacaacagaagccacagaagaacccccgtgcagagaacccccctgagcgccgccgcccacacccaccccgtgtactgcgtgaacgtggtgggcacccagaacgcccacaacctgatcaccgtgagcaccgacggcaagatgtgcagctggagcctggacatgctgagcaccccccaggagagcatggagctggtgtacaacaagagcaagcccgtggccgtgaccggcatggccttccccaccggcgacgtgaacaacttcgtggtgggcagcgaggagggcaccgtgtacaccgcctgcagacacggcagcaaggccggcatcggcgaggtgttcgagggccaccagggccccgtgaccggcatcaactgccacatggccgtgggccccatcgacttcagccacctgttcgtgaccagcagcttcgactggaccgtgaagctgtggaccaccaagcacaacaagcccctgtacagcttcgaggacaacgccgactacgtgtacgacgtgatgtggagccccgtgcaccccgccctgttcgcctgcgtggacggcatgggcagactggacctgtggaacctgaacaacgacaccgaggtgcccaccgccagcgtggccatcgagggcgccagcgccctgaacagagtgagatgggcccaggccggcaaggaggtggccgtgggcgacagcgagggcagaatctgggtgtacgacgtgggcgagctggccgtgccccacaacgacgagtggaccagattcgccagaaccctggtggagatcagagccaacagagccgacagcgaggaggagggcaccgtggagctgagcgcctag

SEQ ID NO: 10496 - DNA, 627 bp, Artificial Sequence
  Description of Artificial Sequence: Synthetic coding sequence
atggagggcgccgccgcccccgtggccggcgacagacccgacctgggcctgggcgcccccggcagccccagagaggccgtggccggcgccaccgccgccctggagcccagaaagccccacggcgtgaagagacaccaccacaagcacaacctgaagcacagatacgagctgcaggagaccctgggcaagggcacctacggcaaggtgaagagagccaccgagagattcagcggcagagtggtggccatcaagagcatcagaaaggacaagatcaaggacgagcaggacatggtgcacatcagaagagagatcgagatcatgagcagcctgaaccacccccacatcatcagcatctacgaggtgttcgagaacaaggacaagatcgtgatcatcatggagtacgccagcaagggcgagctgtacgactacatcagcgagagaagaagactgagcgagagagagaccagacacttcttcagacagatcgtgagcgccgtgcactactgccacaagaacggcgtggtgcacagagacctgaagctgaagagacccagcagagagaaccaggtgaccaccctgccccagagcgccgtgagcctgagaagctgctggaccgtgatgatgtag

SEQ ID NO: 10497 - DNA, 990 bp, Artificial Sequence
  Description of Artificial Sequence: Synthetic coding sequence
atggaggtggccgagcccagcagccccaccgaggaggaggaggaggaggaggagcacagcgccgagcccagacccagaaccagaagcaaccccgagggcgccgaggacagagccgtgggcgcccaggccagcgtgggcagcagaagcgagggcgagggcgaggccgccagcgccgacgacggcagcctgaacaccagcggcgccggccccaagagctggcaggtgcccccccccgcccccgaggtgcagatcagaacccccagagtgaactgccccgagaaggtgatcatctgcctggacctgagcgaggagatgagcctgcccaagctggagagcttcaacggcagcaagaccaacgccctgaacgtgagccagaagatgatcgagatgttcgtgagaaccaagcacaagatcgacaagagccacgagttcgccctggtggtggtgaacgacgacaccgcctggctgagcggcctgaccagcgaccccagagagctgtgcagctgcctgtacgacctggagaccgccagctgcagcaccttcaacctggagggcctgttcagcctgatccagcagaagaccgagctgcccgtgaccgagaacgtgcagaccatcccccccccctacgtggtgagaaccatcctggtgtacagcagacccccctgccagccccagttcagcctgaccgagcccatgaagaagatgttccagtgcccctacttcttcttcgacgtggtgtacatccacaacggcaccgaggagaaggaggaggagatgagctggaaggacatgttcgccttcatgggcagcctggacaccaagggcaccagctacaagtacgaggtggccctggccggccccgccctggagctgcacaactgcatggccaagctgctggcccaccccctgcagagaccctgccagagccacgccagctacagcctgctggaggaggaggacgaggccatcgaggtggaggccaccgtgtag

SEQ ID NO: 10498 - DNA, 885 bp, Artificial Sequence
  Description of Artificial Sequence: Synthetic coding sequence
atgagccagcccgccggcggcagaagaaagcccagaaccctgggcccccccgtgtgcagcatcagacccttcaagagcagcgagcagtacctggaggccatgaaggaggacctggccgagtggctgagagacctgtacggcctggacatcgacgccgccaacttcctgcaggtgctggagaccggcctggtgctgtgccagcacgccaacgtggtgaccgacgccgccctggccttcctggccgaggcccccgcccaggcccagaagatccccatgcccagagtgggcgtgagctgcaacggcgccgcccagcccggcaccttccaggccagagacaacgtgagcaacttcatccagtggtgcagaaaggagatgggcatccaggaggtgctgatgttcgagaccgaggacctggtgctgagaaagaacgtgaagaacgtggtgctgtgcctgctggagctgggcagaagagcctggagattcggcgtggccgcccccaccctggtgcagctggaggaggagatcgaggaggaggtgagaagagagctggccctgccccccctgccccagcccggccccgacggcgccgagccctgcgagcccctgcacgtgcccagcgccgtgctgcacggccagagcgtgtacgtgttcctgggccccgccagacagccccccaaggacagactgctgagagccgtgctgggcagcaagggcggcgaggccagcagagtggacggcgccagcgtgggcgaggaggaggaggagggcaaggaggagaaggagcccgccgcccccctggagagcagcccccagccccccgagggcctgcagccccactggctgaaccaggcccccctgccccccgaggaggagagctgggtgtag

SEQ ID NO: 10499 - DNA, 1554 bp, Artificial Sequence; identical to SEQ ID NO: 9849
  Description of Artificial Sequence: Synthetic coding sequence

SEQ ID NO: 10500 - DNA, 951 bp, Artificial Sequence
  Description of Artificial Sequence: Synthetic coding sequence
atggccaccttcgtggagctgagcaccaaggccaagatgcccatcgtgggcctgggcacctggaagagccccctgggcaaggtgaaggaggccgtgaaggtggccatcgacgccggctacagacacatcgactgcgcctacgtgtaccagaacgagcacgaggtgggcgaggccatccaggagaagatccaggagaaggccgtgaagagagaggacctgttcatcgtgagcaagctgtggcccaccttcttcgagagacccctggtgagaaaggccttcgagaagaccctgaaggacctgaagctgagctacctggacgtgtacctgatccactggccccagggcttcaagagcggcgacgacctgttccccaaggacgacaagggcaacgccatcggcggcaaggccaccttcctggacgcctgggaggccatggaggagctggtggacgagggcctggtgaaggccctgggcgtgagcaacttcagccacttccagatcgagaagctgctgaacaagcccggcctgaagtacaagcccgtgaccaaccaggtggagtgccacccctacctgacccaggagaagctgatccagtactgccacagcaagggcatcaccgtgaccgcctacagccccctgggcagccccgacagaccctgggccaagcccgaggaccccagcctgctggaggaccccaagatcaaggagatcgccgccaagcacaagaagaccgccgcccaggtgctgatcagattccacatccagagaaacgtgatcgtgatccccaagagcgtgacccccgccagaatcgtggagaacatccaggtgttcgacttcaagctgagcgacgaggagatggccaccatcctgagcttcaacagaaactggagagcctgcaacgtgctgcagagcagccacctggaggactaccccttcaacgccgagtactag

SEQ ID NO: 10501 - DNA, 8274 bp, Artificial Sequence
  Description of Artificial Sequence: Synthetic coding sequence
gagcccaaggtggtgttcgccaaggagcagcccgtgcacagagaggtgcaggcccaggccggcgccagcaccaccctgagctgcgaggtggcccaggcccagaccgaggtgatgtggtacaaggacggcaagaagctgagcttcagcagcaaggtgagaatggaggccgtgggctgcaccagaagactggtggtgcagcaggccggccaggccgtggccggcgagtacagctgcgaggccggcagccagagactgagcttccacctgcacgtggccgagcccaaggccgtgttcgccaaggagcagcccgcccacagagaggtgcaggccgaggccggcgccagcgccaccctgagctgcgaggtggcccaggcccagaccgaggtgacctggtacaaggacggcaagaagctgagcagcagcctgaaggtgcacgtggaggccgccggctgcaccagaagactggtggtgcagcaggccggccaggccgacaccggcgagtacagctgcgaggccggcggccagcagctgagcttcagactgcaggtggccgagcccaaggccgtgttcgccaaggagcagcccgccagcagagaggtgcaggccgaggccggcaccagcgccaccctgagctgcgaggtggcccaggcccagaccgaggtgacctggtacaaggacggcaagaagctgagcagcagcagcaaggtgagaatggaggccgtgggctgcaccagaagactggtggtgcaggaggccggccaggccgacgccggcgagtacagctgcaaggccggcgaccagagactgagcttccacctgcacgtggccgagcccaaggtggtgttcgccaaggagcagcccgcccacagagaggtgcaggccgaggccggcgccagcgccaccctgagctgcgaggtggcccaggcccagaccgaggtgacctggtacaaggacggcaagaagctgagcagcagcagcaaggtgagagtggaggccgtgggctgcaccagaagactggtggtgcagcaggccggccaggccgaggccggcgagtacagctgcgaggccggcggccagcagctgagcttcagactgcaggtggccgagcccaaggccgtgttcgccaaggagcaggtggtgttcgccaaggaccagcccgtgcacagagaggtgcaggccgaggccggcaccagcaccatgctgagctgcgaggtggcccaggcccagaccgaggtgatgtggtacaaggacggcaagaagctgagcagcagcagcaagatgagagtggaggccgtgggctgcaccagaagactggtggtgcaggaggccggccaggccgacgccggcgagtacagctgcgaggccggcggccagagactgagcttccacctgcacgtggccgagcccaaggtggtgttcgccaaggagcagcccgcctgcagagaggtgcaggccgaggccggcgccagcgccaccctgagctgcgaggtggcccagggccagatggaggtgacctggtacaaggacggcaagaagctgagcagcagcagcaaggtgcacatggaggccagcggctacaccagaagactggtggtgcagcaggccggccaggccgacgccggcgagtacagctgcgaggccggcggccagagactgagcttcagactgcacgtggccgagctggagccccagatcagcgagagaccctgcagaagagagcccctggtggtgaaggagcacgaggacatcatcctgaccgccaccctggccacccccagcgccgccaccgtgacctggctgaaggacggcgtggagatcagaagaagcaagagacacgagaccgccagccagggcgacacccacaccctgaccgtgcacggcgcccaggtgctggacagcgccatctacagctgcagagtgggcgccgagggccaggacttccccgtgcaggtggaggaggtggccgccaagttctgcagactgctggagcccgtgtgcggcgagctgggcggcaccgtgaccctggcctgcgagctgagccccgcctgcgccgaggtggtgtggagatgcggcaacacccagctgagagtgggcaagagattccagatggtggccgagggccccgtgagaagcctgaccgtgctgggcctgagagccgaggacgccggcgagtacgtgtgcgagagcagagacgaccacaccagcgcccagctgaccgtgagcgtgcccagagtggtgaagttcatgagcggcctgagcaccgtggtggccgaggagggcggcgaggccaccttccagtgcgtggtgagccccagcgacgtggccgtggtgtggttcagagacggcgccctgctgcagcccagcgagaagttcgccatcagccagagcggcgccagccacagcctgaccatcagcgacctggtgctggaggacgccggccagatcaccgtggaggccgagggcgccagcagcagcgccgccctgagagtgagagaggcccccgtgctgttcaagaagaagctggagccccagaccgtggaggagagaagcagcgtgaccctggaggtggagctgaccagaccctggcccgagctgagatggaccagaaacgccaccgccctggcccccggcaagaacgtggagatccacgccgagggcgccagacacagactggtgctgcacaacgtgggcttcgccgacagaggcttcttcggctgcgagacccccgacgacaagacccaggccaagctgaccgtggagatgagacaggtgagactggtgagaggcctgcaggccgtggaggccagagagcagggcaccgccaccatggaggtgcagctgagccacgccgacgtggacggcagctggaccagagacggcctgagattccagcagggccccacctgccacctggccgtgagaggccccatgcacaccctgaccctgagcggcctgagacccgaggacagcggcctgatggtgttcaaggccgagggcgtgcacaccagcgccagactggtggtgaccgagctgcccgtgagcttcagcagacccctgcaggacgtggtgaccaccgagaaggagaaggtgaccctggagtgcgagctgagcagacccaacgtggacgtgagatggctgaaggacggcgtggagctgagagccggcaagaccatggccatcgccgcccagggcgcctgcagaagcctgaccatctacagatgcgagttcgccgaccagggcgtgtacgtgtgcgacgcccacgacgcccagagcagcgccagcgtgaaggtgcagggcagaacctacaccctgatctacagaagagtgctggccgaggacgccggcgagatccagttcgtggccgagaacgccgagagcagagcccagctgagagtgaaggagctgcccgtgaccctggtgagacccctgagagacaagatcgccatggagaagcacagaggcgtgctggagtgccaggtgagcagagccagcgcccaggtgagatggttcaagggcagccaggagctgcagcccggccccaagtacgagctggtgagcgacggcctgtacagaaagctgatcatcagcgacgtgcacgccgaggacgaggacacctacacctgcgacgccggcgacgtgaagaccagcgcccagttcttcgtggaggagcagagcatcaccatcgtgagaggcctgcaggacgtgaccgtgatggagcccgcccccgcctggttcgagtgcgagaccagcatccccagcgtgagaccccccaagtggctgctgggcaagaccgtgctgcaggccggcggcaacgtgggcctggagcaggagggcaccgtgcacagactgatgctgagaagaacctgcagcaccatgaccggccccgtgcacttcaccgtgggcaagagcagaagcagcgccagactggtggtgagcgacatccccgtggtgctgaccagacccctggagcccaagaccggcagagagctgcagagcgtggtgctgagctgcgacttcagacccgcccccaaggccgtgcagtggtacaaggacgacacccccctgagccccagcgagaagttcaagatgagcctggagggccagatggccgagctgagaatcctgagactgatgcccgccgacgccggcgtgtacagatgccaggccggcagcgcccacagcagcaccgaggtgaccgtggaggccagagaggtgaccgtgaccggccccctgcaggacgccgaggccaccgaggagggctgggccagcttcagctgcgagctgagccacgaggacgaggaggtggagtggagcctgaacggcatgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccctgcccgccagacacagcagaagcgaggaccagggcggcctgagaagaggccacagctacaccgccgtgtag

SEQ ID NO: 10502 - DNA, 1449 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagaccttcgtgctggcccccgagggcagcgtgcccaacaagttctacgtgcacaacgacatgttcagatacgaggacgaggtgttcggcgacagcgagcccgagctggacgaggagagcgaggacgaggtggaggaggagcaggaggagagacagcccagccccgagcccgtgcaggagaacgccaacagcggctactacgaggcccaccccgtgaccaacggcatcgaggagcccctggaggagagcagccacgagcccgagcccgagcccgagagcgagaccaagaccgaggagctgaagccccaggtggaggagaagaacctggaggagctggaggagaagagcaccacccccccccccgccgagcccgtgagcctgccccaggagccccccaaggccttcagctgggccagcgtgaccagcaagaacctgccccccagcggcaccgtgagcagcagcggcatccccccccacgtgaaggcccccgtgagccagcccagagtggaggccaagcccgaggtgcagagccagccccccagagtgagagagcagagacccagagagagacccggcttcccccccagaggccccagacccggcagaggcgacatggagcagaacgacagcgacaacagaagaatcatcagataccccgacagccaccagctgttcgtgggcaacctgccccacgacatcgacgagaacgagctgaaggagttcttcatgagcttcggcaacgtggtggagctgagaatcaacaccaagggcgtgggcggcaagctgcccaacttcggcttcgtggtgttcgacgacagcgagcccgtgcagagaatcctgatcgccaagcccatcatgttcagaggcgaggtgagactgaacgtggaggagaagaagaccagagccgccagagagagagagaccagaggcggcggcgacgacagaagagacatcagaagaaacgacagaggccccggcggccccagaggcatcgtgggcggcggcatgatgagagacagagacggcagaggccccccccccagaggcggcatggcccagaagctgggcagcggcagaggcaccggccagatggagggcagattcaccggccagagaagatag

SEQ ID NO: 10503 - DNA, 807 bp, Artificial Sequence
  Description of Artificial Sequence: Synthetic coding sequence
atgagcggcagaaagagaagcttcaccttcggcgcctacggcggcgtggacaagagcttcaccagcagaagaagcgtgtggagaagcgacggccagaaccagcacttcccccaggccctggacctgagcagagtgaacctggtgcccagctacacccccagcctgtaccccaagaacaccgacctgttcgagatgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagtag

SEQ ID NO: 10504 - DNA, 606 bp, Artificial Sequence; identical to SEQ ID NO: 9982
  Description of Artificial Sequence: Synthetic coding sequence

SEQ ID NO: 10505 - DNA, 1707 bp, Artificial Sequence
  Description of Artificial Sequence: Synthetic coding sequence
atgggcctgctgaccttcagagacgtggccatcgagttcagcctggaggagtggcagtgcctggacaccgcccagagaaacctgtacaagaacgtgatcctggagaactacagaaacctggtgttcctgggcatcgccgtgagcaagcaggacctgatcacctgcctggagcaggagaaggagcccctgaccgtgaagagacacgagatggtgaacgagccccccgtgatgtgcagccacttcgcccaggagttctggcccgagcagaacatcaaggacagcttcgagaaggtgaccctgagaagatacgagaagtgcggcaacgacaacttccagctgaagggctgcaagagcgtggacgagtgcaagctgcacaagggcggctacaacggcctgaaccagtgcctgcccaccatgcagagcaagatgttccagtgcgacaagtacgtgaaggtgttcaacaagttcagccacagcgacagacacaagatcaagcacatggagaacaagcccttcaagtgcaaggagtgcggcagaagcttctgcatgctgagccacctgaccagacacgagagaaactacaccaaggtgaacttctgcaagtgcgaggagtgcgagaaggccgtgaaccagagcagcaagctgaccaagcacaagagaatctacacctgcgagaagctgtacaagtgccaggagtgcgacagaaccttcaaccagttcagcaacctgaccgagtacaagaaggactacgccagagagaagccctacaagtgcgaggagtgcggcaaggccttcaaccagagcagccacctgaccacccacaagatcatccacaccggcgagaagccctacaagtgcgaggagtgcggcaaggccttcaaccagttcagcaacctgaccacccacaagaagatccacaccggcgagcagccctacatctgcgaggagtgcggcaaggccttcacccagagcagcaccctgaccacccacaagagaatccacaccggcgagaagccctacaagtgcgaggagtgcggcaaggccttcaacagaagcagcaagctgaccgagcacaagaacatccacaccggcgagcagccctacaagtgcgaggagtgcggcaaggccttcaacagaagcagcaacctgaccgagcacagaaagatccacaccgaggagaagccctacaagtgcaaggagtgcggcaaggccttcaagcacagcagcgccctgaccacccacaagagaatccacaccggcgagaagccctacaagtgcgaggagtgcggcaaggccttcaacagaagcagcaagctgaccgagcacaagaagctgcacaccggcaagaagccctacaagtgcgaggagtgcggcaaggccttcatccagagcagcaagctgaccgagcacaagaagatccacagcggcgagatcccctacaagtgcgaggagtgcggcaaggccttcaagcacagcagcagcctgaccacccacaagagaatccacaccggcgagaagccctacaagtgcgaggagtgcggcaaggccttcagcagaagcagcaagctgaccgagcacaagatcatccacaccggcgagaagccctacaagtgcgagagatgcgacaaggccttcaaccagagcgccaacctgaccaagcacaagaagatccacaccggcgagaagctgcagaactggaacgtgtag

SEQ ID NO: 10506 - DNA, 1383 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaaggacatcagcatccagctgagcagcgcccagagcagatgcaccctgctggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagatcaagcacctggaggagaagctgaaggaggaggagcaccagagaaagctgttccaggacaaggccagcgagctgcagaccggcctggagatcagcaagatcatcatgagcagcgtgagcaacctgaagcacagcaaggagaagaagaagagcagcaagaagaccaagtgcatcaagagaagacccccctggcagatctgcagcaagttcggcgccctgcccttcgtggccgagaagatgagacagcacagagacccccacatcctgcagaagcccttcaacgtgaccgagaccagatgcctgcccaagcccagcagaaccaccagctggtgcaaggccatcccccccgacagcgagaagagcatcagcatctgcgacaacctgagcgagctgctgatggccatgcaggacgagctggaccagatgagcatggagcaccaggagctgctgaagcagatgaaggagaccgagagccacagcgtgtgcgacgacatcgagtgcgagctggagtgcctgctgaagaagatggagatcaagggcgagcagatcagcaagctgaagaagcaccaggacagcgtgtgcaagctgcagcagaaggtgcagaacagcaagatgagcgaggccagcggcatccagcaggaggacagctaccccaagggcagcaagaacatcaagaacagccccagaaagtgcctgaccgacaccaacctgttccagaagaacagcagcttccaccccatcagagtgcacaacctgcagatgaagctgagaagagacgacatcatgtgggagcagtag

SEQ ID NO: 10507 - DNA, 1833 bp, Artificial Sequence
  Description of Artificial Sequence: Synthetic coding sequence
atgagccagaccagcctgaagcagaagaagaacgagcccggcatgagaagcagcaaggagagcctggaggccgagaagagaaaggagagcgacaagaccggcgtgagactgagcaaccagatgagaagagccgtgaaccccaaccacagcctgagatgctgccccttccagggccacagcagctgcagaagatgcctgtgcgccgccgagggcaccgccctgggcccctgccacaccatcagaatctacatccacatgtgcctgctgtgggagcagggccagcagatcaccatgatgagaggcagccaggagagcagcctgagaaagaccgacagcagaggctacctggtgagaagccagtggagcagaatcagcagaagccccagcaccaaggcccccagcatcgacgagcccagaagcagaaacaccagcgccaagctgcccagcagcagcaccagcagcagaacccccagcaccagccccagcctgcacgacagcagccccccccccctgagcggccagcccagcctgcagccccccgccagcccccagctgcccagaagcctggacagcagaccccccaccccccccgagcccgaccccggcagcagaagaagcaccaagatgcaggagaaccccgaggcctgggcccagggcatcgtgagagagatcagacagaccagagacagccagcccctggagtacagcagaaccagccccaccgagtggaagagcagcagccagagaagaggcatctaccccgccagcacccagctggacagaaacagcctgagcgagcagcagcagcagcagagagaggacgaggacgactacgaggccgcctactgggccagcatgagaagcttctacgagaagaaccccagctgcagcagaccctggccccccaagcccaagaacgccatcaccatcgccctgagcagctgcgccctgttcaacatggtggacggcagaaagatctacgagcaggagggcctggagaagtacatggagtaccagctgaccaacgagaacgtgatcctgacccccggccccgccttcagattcgtgaaggccctgcagtacgtgaacgccagactgagagacctgtaccccgacgagcaggacctgttcgacatcgtgctgatgaccaacaaccacgcccaggtgggcgtgagactgatcaacagcgtgaaccactacggcctgctgatcgacagattctgcctgaccggcggcaaggaccccatcggctacctgaaggcctacctgaccaacctgtacatcgccgccgacagcgagaaggtgcaggaggccatccaggagggcatcgccagcgccaccatgttcgacggcgccaaggacatggcctactgcgacacccagctgagagtggccttcgacggcgacgccgtgctgttcagcgacgagagcgagcacttcaccaaggagcacggcctggacaagttcttccagtacgacaccctgtgcgagagcaagcccctggcccagggccccctgaagggcttcctggaggacctgggcagactgcagaagaagttctacgccaagaacgagagactgctgtgccccatcagaacctacctggtgaccgccagaagcgccgccagcagcggcgccagagtgctgaagaccctgagaagatggggcctggagatcgacgaggccctgttcctggccggcgcccccaagagccccatcctggtgaagatcagaccccacatcttcttcgacgaccacatgttccacatcgagggcgcccagagactgggcagcatcgccgcctacggcttcaacaagaagttcagcagctag

SEQ ID NO: 10508 - DNA, 456 bp, Artificial Sequence
  Description of Artificial Sequence: Synthetic coding sequence
atgagcaagaacaccgtgagcagcgccagattcagaaaggtggacgtggacgagtacgacgagaacaagttcgtggacgaggaggacggcggcgacggccaggccggccccgacgagggcgaggtggacagctgcctgagacagggcaacatgaccgccgccctgcaggccgccctgaagaacccccccatcaacaccaagagccaggccgtgaaggacagagccggcagcatcgtgctgaaggtgctgatcagcttcaaggccaacgacatcgagaaggccgtgcagagcctggacaagaacggcgtggacctgctgatgaagtacatctacaagggcttcgagagccccagcgacaacagcagcgccatgctgctgcagtggcacgagaaggccctggccgccggcggcgtgggcagcatcgtgagagtgctgaccgccagaaagaccgtgtag

SEQ ID NO: 10509 - DNA, 3522 bp, Artificial Sequence
  Description of Artificial Sequence: Synthetic coding sequence
atggtgaccgtgggcaccaacatcctgcccagcagacccgccgccagcgccaacaccgccagagaggacgccgccctgttcagcagaagaatcccccccagacacaagaacggcgccgcccagcccggcgccgcccccggccccggcgcccccggcgccaacatgggcaacgcccacagcaagagcggcgacagacacagcgccctgcccggcagacccgagctgagcttctacggcagcttccccagaaagtggagcgagaacgtgttcctggacaacgagctgctgaccagcaagatcctgagcgtgctgagaccccagagcgagagaggcttcagagccggcgacctgagataccccacccacttcctgagcaccaacagcgtgctggccagcgtgaccgccagcctgaaggagcaccccagaggcaccctgctgagcgacggcagccccgccctgagcagaaacgtgggcatgaccgtgagccagaagggcggcccccagcccacccccagccccgccggccccggcacccagctgggccccatcaccggcgagatggacgaggccgacagcgccttcctgaagttcaagcagaccgccgacgacagcctgagcctgaccagccccaacaccgagagcatcttcgtggaggacccctacaccgccagcctgagaagcgagatcgagagcgacggccacgagttcgaggccgagagctggagcctggccgtggacgccgcctacgccaagaagcagaagagagaggtggtgaagagacaggacgtgctgtacgagctgatgcagaccgaggtgcaccacgtgagaaccctgaagatcatgctgaaggtgtacagcagagccctgcaggaggagctgcagttcagcagcaaggccatcggcagactgttcccctgcgccgacgacctgctggagacccacagccacttcctggccagactgaaggagagaagacaggagagcctggaggagggcagcgacagaaactacgtgatccagaagatcggcgacctgctggtgcagcagttcagcggcgagaacggcgagagaatgaaggagaagtacggcgtgttctgcagcggccacaacgaggccgtgagccactacaagctgctgctgcagcagaacaagaagttccagaacctgatcaagaagatcggcaacttcagcatcgtgagaagactgggcgtgcaggagtgcatcctgctggtgacccagagaatcaccaagtaccccgtgctggtggagagaatcatccagaacaccgaggccggcaccgaggactacgaggacctgacccaggccctgaacctgatcaaggacatcatcagccaggtggacgccaaggtgagcgagtgcgagaagggccagagactgagagagatcgccggcaagatggacctgaagagcagcagcaagctgaagaacggcctgaccttcagaaaggaggacatgctgcagagacagctgcacctggagggcatgctgtgctggaagaccaccagcggcagactgaaggacatcctggccatcctgctgaccgacgtgctgctgctgctgcaggagaaggaccagaagtacgtgttcgccagcgtggacagcaagccccccgtgatcagcctgcagaagctgatcgtgagagaggtggccaacgaggagaaggccatgttcctgatcagcgccagcctgcagggccccgagatgtacgagatctacaccagcagcaaggaggacagaaacgcctggatggcccacatccagagagccgtggagagctgccccgacgaggaggagggccccttcagcctgcccgaggaggagagaaaggtggtggaggccagagccaccagactgagagacttccaggagagactgagcatgaaggaccagctgatcgcccagagcctgctggagaagcagcagatctacctggagatggccgagatgggcggcctggaggacctgccccagcccagaggcctgttcagaggcggcgaccccagcgagaccctgcagggcgagctgatcctgaagagcgccatgagcgagatcgagggcatccagagcctgatctgcagacagctgggcagcgccaacggccaggccgaggacggcggcagcagcaccggcccccccagaagagccgagaccttcgccggctacgactgcaccaacagccccaccaagaacggcagcttcaagaagaaggtgagcagcaccgaccccagacccagagactggagaggcccccccaacagccccgacctgaagctgagcgacagcgacatccccggcagcagcgaggagagcccccaggtggtggaggcccccggcaccgagagcgaccccagactgcccaccgtgctggagagcgagctggtgcagagaatccagaccctgagccagctgctgctgaacctgcaggccgtgatcgcccaccaggacagctacgtggagacccagagagccgccatccaggagagagagaagcagttcagactgcagagcaccagaggcaacctgctgctggagcaggagagacagagaaacttcgagaagcagagagaggagagagccgccctggagaagctgcagagccagctgagacacgagcagcagagatgggagagagagagacagtggcagcaccaggagctggagagagccggcgccagactgcaggagagagagggcgaggccagacagctgagagagagactggagcaggagagagccgagctggagagacagagacaggcctaccagcacgacctggagagactgagagaggcccagagagccgtggagagagagagagagagactggagctgctgagaagactgaagaagcagaacaccgcccccggcgccctgccccccgacaccctggccgaggcccagccccccagccacccccccagcttcaacggcgagggcctggagggccccagagtgagcatgctgcccagcggcgtgggccccgagtacgccgagagacccgaggtggccagaagagacagcgcccccaccgagaacagactggccaagagcgacgtgcccatccagctgctgagcgccaccaaccagttccagagacaggccgccgtgcagcagcagatccccaccaagctggccgccagcaccaagggcggcaaggacaagggcggcaagagcagaggcagccagagatgggagagcagcgccagcttcgacctgaagcagcagctgctgctgaacaagctgatgggcaaggacgagagcaccagcagaaacagaagaagcctgagccccatcctgcccggcagacacagccccgcccccccccccgaccccggcttccccgcccccagccccccccccgccgacagccccagcgagggcttcagcctgaaggccggcggcaccgccctgctgcccggcccccccgcccccagccccctgcccgccacccccctgagcgccaaggaggacgccagcaaggaggacgtgatcttcttctag

SEQ ID NO: 10510 - DNA, 1674 bp, Artificial Sequence
  Description of Artificial Sequence: Synthetic coding sequence
atggacagcaccgtgcccagcgccctggagctgccccagagactggccctgaaccccagagagagccccagaagccccgaggaggaggagccccacctgctgagcagcctggccgccgtgcagaccctggccagcgtgatcagaccctgctacggcccccacggcagacagaagttcctggtgaccatgaagggcgagaccgtgtgcaccggctgcgccaccgccatcctgagagccctggagctggagcaccccgccgcctggctgctgagagaggccggccagacccaggccgagaacagcggcgacggcaccgccttcgtggtgctgctgaccgaggccctgctggagcaggccgagcagctgctgaaggccggcctgcccagaccccagctgagagaggcctacgccaccgccaccgccgaggtgctggccaccctgcccagcctggccatccagagcctgggccccctggaggaccccagctgggccctgcacagcgtgatgaacacccacaccctgagccccatggaccacctgaccaagctggtggcccacgcctgctgggccatcaaggagctggacggcagcttcaagcccgagagagtgggcgtgtgcgccctgcccggcggcaccctggaggacagctgcctgctgcccggcctggccatcagcggcaagctgtgcggccagatggccaccgtgctgagcggcgccagagtggccctgttcgcctgccccttcggccccgcccaccccaacgcccccgccaccgccagactgagcagccccgccgacctggcccagttcagcaagggcagcgaccagctgctggagaagcaggtgggccagctggccgccgccggcatcaacgtggccgtggtgctgggcgaggtggacgaggagaccctgaccctggccgacaagtacggcatcgtggtgatccaggccagaagctggatggagatcatctacctgagcgaggtgctggacacccccctgctgcccagactgctgcccccccagagacccggcaagtgccagagagtgtacagacaggagctgggcgacggcctggccgtggtgttcgagtgggagtgcaccggcacccccgccctgaccgtggtgctgagaggcgccaccacccagggcctgagaagcgccgagcaggccgtgtaccacggcatcgacgcctacttccagctgtgccaggaccccagactgatccccggcgccggcgccaccgagatggccctggccaagatgctgagcgacaagggcagcagactggagggccccagcggccccgccttcctggccttcgcctgggccctgaagtacctgcccaagaccctggccgagaacgccggcctggccgtgagcgacgtgatggccgagatgagcggcgtgcaccagggcggcaacctgctgatgggcgtgggcaccgagggcatcatcaacgtggcccaggagggcgtgtgggacaccctgatcgtgaaggcccagggcttcagagccgtggccgaggtggtgctgcagctggtgaccgtggacgagatcgtggtggccaagaagagccccacccaccaggagatctggaaccccgacagcaagaagaccaagaagcaccccccccccgtggagaccaagaagatcctgggcctgaacaactag

SEQ ID NO: 10511 - DNA, 939 bp, Artificial Sequence
  Description of Artificial Sequence: Synthetic coding sequence
atgaccagaagcctgttcaagggcaacttctggagcgccgacatcctgagcaccatcggctacgacaacatcatccagcacctgaacaacggcagaaagaactgcaaggagttcgaggacttcctgaaggagagagccgccatcgaggagagatacggcaaggacctgctgaacctgagcagaaagaagccctgcggccagagcgagatcaacaccctgaagagagccctggaggtgttcaagcagcaggtggacaacgtggcccagtgccacatccagctggcccagagcctgagagaggaggccagaaagatggaggagttcagagagaagcagaagctgcagagaaagaagaccgagctgatcatggacgccatccacaagcagaagagcctgcagttcaagaagaccatggacgccaagaagaactacgagcagaagtgcagagacaaggacgaggccgagcaggccgtgagcagaagcgccaacctggtgaaccccaagcagcaggagaagctgttcgtgaagctggccaccagcaagaccgccgtggaggacagcgacaaggcctacatgctgcacatcggcaccctggacaaggtgagagaggagtggcagagcgagcacatcaaggcctgcgaggccttcgaggcccaggagtgcgagagaatcaacttcttcagaaacgccctgtggctgcacgtgaaccagctgagccagcagtgcgtgaccagcgacgagcaccccagctgcatgagaatcagcaccccccccagaagaatgcagagccagcaggagagactgcagggcctgacctggcagggcgaggaccccagccagttcctgaaggcccaccagatgatccccatcaccctgtggctgatgaccaccgtgtgcagcatcagcaagatcaacgagaccagagccttcagcggctag

SEQ ID NO: 10512 - DNA, 3693 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaaggagggcgacgactacgaggtgatccccaacagcaacttctacgtgagcagaaccgcctgcagagacaacaccagcgtgtaccacatcagcggcaagaagaagaccttcaaggacgtgggcaacctgctgagaagccacggcatcgacctggaccacaacagattcctgatcctgcagggcgaggtggagcagatcgccatgatgaagcccaagggccagaccgagcacgacgagggcatgctggagtacctggaggacatcatcggctgcggcagactgaacgagcccatcaaggtgctgtgcagaagagtggagatcctgaacgagcacagaggcgagaagctgaacagagtgaagatggtggagaaggagaaggacgccctggagggcgagaagaacatcgccatcgagttcctgaccctggagaacgagatcttcagaaagaagaaccacgtgtgccagtactacatctacgagctgcagaagagaatcgccgagatggagacccagaaggagaagatccacgaggacaccaaggagatcaacgagaagagcaacatcctgagcaacgagatgaaggccaagaacaaggacgtgaaggacaccgagaagaagctgaacaagatcaccaagttcatcgaggagaacaaggagaagttcacccagctggacctggaggacgtgcaggtgagagagaagctgaagcacgccaccagcaaggccaagaagctggagaagcagctgcagaaggacaaggagaaggtggaggagttcaagagcatccccgccaagagcaacaacatcatcaacgagaccaccaccagaaacaacgccctggagaaggagaaggagaaggaggagaagaagctgaaggaggtgatggacagcctgaagcaggagacccagggcctgcagaaggagaaggagagcagagagaaggagctgatgggcttcagcaagagcgtgaacgaggccagaagcaagatggacgtggcccagagcgagctggacatctacctgagcagacacaacaccgccgtgagccagctgaccaaggccaaggaggccctgatcgccgccagcgagaccctgaaggagagaaaggccgccatcagagacatcgagggcaagctgccccagaccgagcaggagctgaaggagaaggagaaggagctgcagaagctgacccaggaggagaccaacttcaagagcctggtgcacgacctgttccagaaggtggaggaggccaagagcagcctggccatgaacagaagcagaggcaaggtgctggacgccatcatccaggagaagaagagcggcagaatccccggcatctacggcagactgggcgacctgggcgccatcgacgagaagtacgacgtggccatcagcagctgctgccacgccctggactacatcgtggtggacagcatcgacatcgcccaggagtgcgtgaacttcctgaagagacagaacatcggcgtggccaccttcatcggcctggacaagatggccgtgtgggccaagaagatgaccgagatccagacccccgagaacacccccagactgttcgacctggtgaaggtgaaggacgagaagatcagacaggccttctacttcgccctgagagacaccctggtggccgacaacctggaccaggccaccagagtggcctaccagaaggacagaagatggagagtggtgaccctgcagggccagatcatcgagcagagcggcaccatgaccggcggcggcagcaaggtgatgaagggcagaatgggcagcagcctggtgatcgagatcagcgaggaggaggtgaacaagatggagagccagctgcagaacgacagcaagaaggccatgcagatccaggagcagaaggtgcagctggaggagagagtggtgaagctgagacacagcgagagagagatgagaaacaccctggagaagttcaccgccagcatccagagactgatcgagcaggaggagtacctgaacgtgcaggtgaaggagctggaggccaacgtgctggccaccgcccccgacaagaagaagcagaagctgctggaggagaacgtgagcgccttcaagaccgagtacgacgccgtggccgagaaggccggcaaggtggaggccgaggtgaagagactgcacaacaccatcgtggagatcaacaaccacaagctgaaggcccagcaggacaagctggacaagatcaacaagcagctggacgagtgcgccagcgccatcaccaaggcccaggtggccatcaagaccgccgacagaaacctgcagaaggcccaggacagcgtgctgagaaccgagaaggagatcaaggacaccgagaaggaggtggacgacctgaccgccgagctgaagagcctggaggacaaggccgccgaggtggtgaagaacaccaacgccgccgagatcagcaagatcagcctgcaccccatcgaggacaaccccatcgaggagatcagcgtgctgagccccgaggacctggaggccatcaagaaccccgacagcatcaccaaccagatcgccctgctggaggccagatgccacgagatgaagcccaacctgggcgccatcgccgagtacaagaagaaggaggagctgtacctgcagagagtggccgagctggacaagatcacctacgagagagacagcttcagacaggcctacgaggacctgagaaagcagagactgaacgagttcatggccggcttctacatcatcaccaacaagctgaaggagaactaccagatgctgaccctgggcggcgacgccgagctggagctggtggacagcctggaccccttcagcgagggcatcatgttcagcgtgagaccccccaagaagagctggaagaagatcttcaacctgagcggcggcgagaagaccctgagcagcctggccctggtgttcgccctgcaccactacaagcccacccccctgtacttcatggacgagatcgacgccgccctggacttcaagaacgtgagcatcgtggccttctacatctacgagcagaccaagaacgcccagttcatcatcatcagcctgagaaacaacatgttcgagatcagcgacagactgatcggcatctacaagacctacaacatcaccaagagcgtggccgtgaaccccaaggagatcgccagcaagggcctgtgctag

SEQ ID NO: 10513 - DNA, 2661 bp, Artificial Sequence
  Description of Artificial Sequence: Synthetic coding sequence
atggagctgagatgcggcggcctgctgttcagcagcagattcgacagcggcaacctggcccacgtggagaaggtggagagcctgagcagcgacggcgagggcgtgggcggcggcgccagcgccctgaccagcggcatcgccagcagccccgactacgagttcaacgtgtggaccagacccgactgcgccgagaccgagttcgagaacggcaacagaagctggttctacttcagcgtgagaggcggcatgcccggcaagctgatcaagatcaacatcatgaacatgaacaagcagagcaagctgtacagccagggcatggcccccttcgtgagaaccctgcccaccagacccagatgggagagaatcagagacagacccaccttcgagatgaccgagacccagttcgtgctgagcttcgtgcacagattcgtggagggcagaggcgccaccaccttcttcgccttctgctaccccttcagctacagcgactgccaggagctgctgaaccagctggaccagagattccccgagaaccaccccacccacagcagccccctggacaccatctactaccacagagagctgctgtgctacagcctggacggcctgagagtggacctgctgaccatcaccagctgccacggcctgagagaggacagagagcccagactggagcagctgttccccgacaccagcacccccagacccttcagattcgccggcaagagaatcttcttcctgagcagcagagtgcaccccggcgagacccccagcagcttcgtgttcaacggcttcctggacttcatcctgagacccgacgaccccagagcccagaccctgagaagactgttcgtgttcaagctgatccccatgctgaaccccgacggcgtggtgagaggccactacagaaccgacagcagaggcgtgaacctgaacagacagtacctgaagcccgacgccgtgctgcaccccgccatctacggcgccaaggccgtgctgctgtaccaccacgtgcacagcagactgaacagccagagcagcagcgagcaccagcccagcagctgcctgccccccgacgcccccgtgagcgacctggagaaggccaacaacctgcagaacgaggcccagtgcggccacagcgccgacagacacaacgccgaggcctggaagcagaccgagcccgccgagcagaagctgaacagcgtgtggatcatgccccagcagagcgccggcctggaggagagcgcccccgacaccatcccccccaaggagagcggcgtggcctactacgtggacctgcacggccacgccagcaagagaggctgcttcatgtacggcaacagcttcagcgacgagagcacccaggtggagaacatgctgtaccccaagctgatcagcctgaacagcgcccacttcgacttccagggctgcaacttcagcgagaagaacatgtacgccagagacagaagagacggccagagcaaggagggcagcggcagagtggccatctacaaggccagcggcatcatccacagctacaccctggagtgcaactacaacaccggcagaagcgtgaacagcatccccgccgcctgccacgacaacggcagagccagccccccccccccccccgccttccccagcagatacaccgtggagctgttcgagcaggtgggcagagccatggccatcgccgccctggacatggccgagtgcaacccctggcccagaatcgtgctgagcgagcacagcagcctgaccaacctgagagcctggatgctgaagcacgtgagaaacagcagaggcctgagcagcaccctgaacgtgggcgtgaacaagaagagaggcctgagaaccccccccaagagccacaacggcctgcccgtgagctgcagcgagaacaccctgagcagagccagaagcttcagcaccggcaccagcgccggcggcagcagcagcagccagcagaacagcccccagatgaagaacagccccagcttccccttccacggcagcagacccgccggcctgcccggcctgggcagcagcacccagaaggtgacccacagagtgctgggccccgtgagagagcccagaagccaggacagaagaagacagcagcagcccctgaaccacagacccgccggcagcctggcccccagccccgcccccaccagcagcggccccgccagcagccacaagctgggcagctgcctgctgcccgacagcttcaacatccccggcagcagctgcagcctgctgagcagcggcgacaagcccgaggccgtgatggtgatcggcaagggcctgctgggcaccggcgccagaatgccctgcatcaagaccagactgcaggccagacccagactgggcagaggcagcccccccaccagaagaggcatgaagggcagcagcggccccaccagccccacccccagaaccagagagagcagcgagctggagctgggcagctgcagcgccacccccggcctgccccaggccagaccccccagacccagaagcgcccccgccttcagccccatcagctgcagcctgagcgacagccccagctggaactgctacagcagaggccccctgggccagcccgaggtgtgcttcgtgcccaagagcccccccctgaccgtgagccccagagtgtag

SEQ ID NO: 10514 - DNA, 4221 bp, Artificial Sequence; identical to SEQ ID NO: 10332
  Description of Artificial Sequence: Synthetic coding sequence

SEQ ID NO: 10515 - DNA, 1308 bp, Artificial Sequence
  Description of Artificial Sequence: Synthetic coding sequence
atgggcgacctggagctgctgctgcccggcgaggccgaggtgctggtgagaggcctgagaagcttccccctgagagagatgggcagcgagggctggaaccagcagcacgagaacctggagaagctgaacatgcaggccatcctggacgccaccgtgagccagggcgagcccatccaggagctgctggtgacccacggcaaggtgcccaccctggtggaggagctgatcgccgtggagatgtggaagcagaaggtgttccccgtgttctgcagagtggaggacttcaagccccagaacaccttccccatctacatggtggtgcaccacgaggccagcatcatcaacctgctggagaccgtgttcttccacaaggaggtgtgcgagagcgccgaggacaccgtgctggacctggtggactactgccacagaaagctgaccctgctggtggcccagagcggctgcggcggcccccccgagggcgagggcagccaggacagcaaccccatgcaggagctgcagaagcaggccgagctgatggagttcgagatcgccctgaaggccctgagcgtgctgagatacatcaccgactgcgtggacagacagtggagcgtgagccagcccccccagctggcccacctgaagagaatccagagactgcaccccgtgtgctggttcctgagccccggcaagctgcagcagttcgagggcagcagatggcacaccgtggcccccagcgagcagcagaagctgagcaagctggacggccaggtgtggatcgccctgtacaacctgctgctgagccccgaggcccaggccagatactgcctgaccagcttcgccaagggcagactgctgaagctgagagccttcctgaccgacaccctgctggaccagctgcccaacctggcccacctgcagagcttcctggcccacctgaccctgaccgagacccagccccccaagaaggacctggtgctggagcagatccccgagatctgggagagactggagagagagaacagaggcaagtggcaggccatcgccaagcaccagctgcagcacgtgttcagccccagcgagcaggacctgagactgcaggccagaagatgggccgagacctacagactggacgtgctggaggccgtggcccccgagagacccagatgcgcctactgcagcgccgaggccagcaagagatgcagcagatgccagaacgagtggtactgctgcagagagtgccaggtgaagcactgggagaagcacggcaagacctgcgtgctggccgcccagggcgacagagccaagtag

SEQ ID NO: 10516 - DNA, 1377 bp, Artificial Sequence
  Description of Artificial Sequence: Synthetic coding sequence
atgaacgaggccatggccaccgacagccccagaagacccagcagatgcaccggcggcgtggtggtgagaccccaggccgtgaccgagcagagctacatggagagcgtggtgaccttcctgcaggacgtggtgccccaggtgtactgctgcggcgacaacatccagagctacaccgccaccgtgatcagcgccgccaagaccctgaagagcggcctgaccatggtgggcaaggtggtgacccagctgaccggcaccctgcccagcggcgtgaccgaggacgacgtggccatccacagcaacagcagaagaagccccctggtgcccggcatcatcaccgtgatcgacaccgagaccgtgggcgagggccaggtgctggtgagcgaggacagcgacagcgacggcatcgtggcccacttccccgcccacgagaagcccgtgtgctgcatggccttcaacaccagcggcatgctgctggtgaccaccgacaccctgggccacgacttccacgtgttccagatcctgacccacccctggagcagcagccagtgcgccgtgcaccacctgtacaccctgcacagaggcgagaccgaggccaaggtgcaggacatctgcttcagccacgactgcagatgggtggtggtgagcaccctgagaggcaccagccacgtgttccccatcaacccctacggcggccagccctgcgtgagaacccacatgagccccagagtggtgaacagaatgagcagattccagaagagcgccggcctggaggagatcgagcaggagctgaccagcaagcagggcggcagatgcagccccgtgcccggcctgagcagcagccccagcggcagccccctgcacggcaagctgaacagccaggacagctacaacaacttcaccaacaacaaccccggcaaccccagactgagccccctgcccagcctgatggtggtgatgcccctggcccagatcaagcagcccatgaccctgggcaccatcaccaagagaaccggcaaggtgaagccccccccccagatcagccccagcaagagcatgggcggcgagttctgcgtggccgccatcttcggcaccagcagaagctggttcgccaacaacgccggcctgaagagagagaaggaccagagcaagcaggtggtggtggagagcctgtacatcatcagctgctacggcaccctggtggagcacatgatggagccccagcccctgaacggcatgaactgcagccacagactgatgcagaccaccctgtgcagcagcctgcagatgcagtacagcatcatcagcagctgcctgctggcctggttccccctggaggtgctgggccccctgctggacatgggcctgaccaccgtgtag

SEQ ID NO: 10517 - DNA, 309 bp, Artificial Sequence
  Description of Artificial Sequence: Synthetic coding sequence
atgagagccagcccctgcatcagccagcccgccgccagctggcaccccagacccagcgccctgagacccaccgccggcagcggccccgacaccagaacccccggcaccgtggaggacggcagcgccccctgccccgccttcagaagccccgccgtgagcccctgcggcgaggagccctgctgcttccagatcagccccgccgaggagaccctggagctgggcagactggtgagccccggctgccacaagagcagcgccccccaggagagaagactggaccccagagccagatgcgtggtgcacatctag

SEQ ID NO: 10518 - DNA, 4227 bp, Artificial Sequence; identical to SEQ ID NO: 10132
  Description of Artificial Sequence: Synthetic coding sequence

SEQ ID NO: 10519 - DNA, 2994 bp, Artificial Sequence
  Description of Artificial Sequence: Synthetic coding sequence
agacccccccccgccggcccccaggcccccgagggcgccagagccggcagcagacccgtgcagctgctggccctgctgagcagctggtgcgaggagctgggcagactgctgctgctgagacaccagaagagcagacagagcgacccccccggcaagctgcccatgcagccccccctgagcagcatgagcagcatgaagcccaccctgagccacagcgacggcagcttcccctacgacagcgtgccctggcagcagaacaccaaccagccccccggcagcctgagcgtggtgaccaccgtgtggggcgtgaccaacaccagccagagccaggtgctgggcaaccccatggccaacgccaacaaccccatgaaccccggcggcaaccccatggccagcggcatgaccaccagcaaccccggcctgaacagcccccagttcgccggccagcagcagcagttcagcgccaaggccggccccgcccagccctacatccagcagagcatgtacggcagacccaactaccccggcagcggcggcttcggcgccagctaccccggcggccccaacgcccccgccggcatgggcatccccccccacaccagaccccccgccgacttcacccagcccgccgccgccgccgccgccgccgccgtggccgccgccgccgccaccgccaccgccaccgccaccgccaccgtggccgccctgcaggagacccagaacaaggacatcaaccagtacggccccatgggccccacccaggcctacaacagccagttcatgaaccagcccggccccagaggccccgccagcatgggcggcagcatgaaccccgccagcatggccgccggcatgacccccagcggcatgagcggcccccccatgggcatgaaccagcccagaccccccggcatcagccccttcggcacccacggccagagaatgccccagcagacctaccccggccccagaccccagagcctgcccatccagaacatcaagagaccctaccccggcgagcccaactacggcaaccagcagtacggccccaacagccagttccccacccagcccggccagtaccccgcccccaacccccccagacccctgaccagccccaactaccccggccagagaatgcccagccagcccagcagcggccagtaccccccccccaccgtgaacatgggccagtactacaagcccgagcagttcaacggccagaacaacaccttcagcggcagcagctacagcaactacagccagggcaacgtgaacagaccccccagacccgtgcccgtggccaactacccccacagccccgtgcccggcaaccccaccccccccatgacccccggcagcagcatccccccctacctgagccccagccaggacgtgaagccccccttcccccccgacatcaagcccaacatgagcgccctgccccccccccccgccaaccacaacgacgagctgagactgaccttccccgtgagagacggcgtggtgctggagcccttcagactggagcacaacctggccgtgagcaaccacgtgttccacctgagacccaccgtgcaccagaccctgatgtggagaagcgacctggagctgcagttcaagtgctaccaccacgaggacagacagatgaacaccaactggcccgccagcgtgcaggtgagcgtgaacgccacccccctgaccatcgagagaggcgacaacaagaccagccacaagcccctgcacctgaagcacgtgtgccagcccggcagaaacaccatccagatcaccgtgaccgcctgctgctgcagccacctgttcgtgctgcagctggtgcacagacccagcgtgagaagcgtgctgcagggcctgctgaagaagagactgctgcccgccgagcactgcatcaccaagatcaagagaaacttcagcagcgtggccgccagcagcggcaacaccaccctgaacggcgaggacggcgtggagcagaccgccatcaaggtgagcctgaagtgccccatcaccttcagaagaatccagctgcccgccagaggccacgactgcaagcacgtgcagtgcttcgacctggagagctacctgcagctgaactgcgagagaggcacctggagatgccccgtgtgcaacaagaccgccctgctggagggcctggaggtggaccagtacatgtggggcatcctgaacgccatccagcacagcgagttcgaggaggtgaccatcgaccccacctgcagctggagacccgtgcccatcaagagcgacctgcacatcaaggacgaccccgacggcatccccagcaagagattcaagaccatgagccccagccagatgatcatgcccaacgtgatggagatgatcgccgccctgggccccggccccagcccctaccccctgccccccccccccggcggcaccaacagcaacgactacagcagccagggcaacaactaccagggccacggcaacttcgacttcccccacggcaaccccggcggcaccagcatgaacgacttcatgcacggccccccccagctgagccacccccccgacatgcccaacaacatggccgccctggagaagcccctgagccaccccatgcaggagaccatgccccacgccggcagcagcgaccagccccaccccagcatccagcagggcctgcacgtgccccaccccagcagccagagcggcccccccctgcaccacagcggcgcccccccccccccccccagccagccccccagacagcccccccaggccgcccccagcagccacccccacagcgacctgaccttcaaccccagcagcgccctggagggccaggccggcgcccagggcgccagcgacatgcccgagcccagcctggacctgctgcccgagctgaccaaccccgacgagctgctgagctacctggacccccccgacctgcccagcaacagcaacgacgacctgctgagcctgttcgagaacaactag

SEQ ID NO: 10520 - DNA, 3405 bp, Artificial Sequence
  Description of Artificial Sequence: Synthetic coding sequence
atgggcaaggagcaggagctgctggaggccgccagaaccggccacctgcccgccgtggagaagctgctgagcggcaagagactgagcagcggcttcggcggcggcggcggcggcggcagcggcggcggcggcggcggcagcggcggcggcggcggcggcctgggcagcagcagccaccccctgagcagcctgctgagcatgtggagaggccccaacgtgaactgcgtggacagcaccggctacacccccctgcaccacgccgccctgaacggccacaaggacgtggtggaggtgctgctgagaaacgacgccctgaccaacgtggccgacagcaagggctgctaccccctgcacctggccgcctggaagggcgacgcccagatcgtgagactgctgatccaccagggccccagccacaccagagtgaacgagcagaacaacgacaacgagaccgccctgcactgcgccgcccagtacggccacaccgaggtggtgaaggtgctgctggaggagctgaccgaccccaccatgagaaacaacaagttcgagacccccctggacctggccgccctgtacggcagactggaggtggtgaagatgctgctgaacgcccaccccaacctgctgagctgcaacaccaagaagcacacccccctgcacctggccgccagaaacggccacaaggccgtggtgcaggtgctgctggacgccggcatggacagcaactaccagaccgagatgggcagcgccctgcacgaggccgccctgttcggcaagaccgacgtggtgcagatcctgctggccgccggcaccgacgtgaacatcaaggacaaccacggcctgaccgccctggacaccgtgagagagctgcccagccagaagagccagcagatcgccgccctgatcgaggaccacatgaccggcaagagaagcaccaaggaggtggacaagaccccccccccccagccccccctgatcagcagcatggacagcatcagccagaagagccagggcgacgtggagaaggccgtgaccgagctgatcatcgacttcgacgccaacgccgaggaggagggcccctacgaggccctgtacaacgccatcagctgccacagcctggacagcatggccagcggcagaagcagcgaccaggacagcaccaacaaggaggccgaggccgccggcgtgaagcccgccggcgtgagacccagagagagaccccccccccccgccaagcccccccccgacgaggaggaggaggaccacatcgacaagaagtacttccccctgaccgccagcgaggtgctgagcatgagacccagaatccacggcagcgccgccagagaggaggacgagcacccctacgagctgctgctgaccgccgagaccaagaaggtggtgctggtggacggcaagaccaaggaccacagaagaagcagcagcagcagaagccaggacagcgccgagggccaggacggccaggtgcccgagcagttcagcggcctgctgcacggcagcagccccgtgtgcgaggtgggccaggaccccttccagctgctgtgcaccgccggccagagccaccccgacggcagcccccagcagggcgcctgccacaaggccagcatgcagctggaggagaccggcgtgcacgcccccggcgccagccagcccagcgccctggaccagagcaagagagtgggctacctgaccggcctgcccaccaccaacagcagaagccaccccgagaccctgacccacaccgccagcccccaccccggcggcgccgaggagggcgacagaagcggcgccagaagcagagccccccccaccagcaagcccaaggccgagctgaagctgagcagaagcctgagcaagagcgacagcgacctgctgacctgcagccccaccgaggacgccaccatgggcagcagaagcgagagcctgagcaactgcagcatcggcaagaagagactggagaagagccccagcttcgccagcgagtgggacgagatcgagaagatcatgagcagcatcggcgagggcatcgacttcagccaggagagacagaagatcagcggcctgagaaccctggagcagagcgtgggcgagtggctggagagcatcggcctgcagcagtacgagagcaagctgctgctgaacggcttcgacgacgtgcacttcctgggcagcaacgtgatggaggagcaggacctgagagacatcggcatcagcgacccccagcacagaagaaagctgctgcaggccgccagaagcctgcccaaggtgaaggccctgggctacgacggcaacagcccccccagcgtgcccagctggctggacagcctgggcctgcaggactacgtgcacagcttcctgagcagcggctacagcagcatcgacaccgtgaagaacctgtgggagctggagctggtgaacgtgctgaaggtgcagctgctgggccacagaaagagaatcatcgccagcctggccgacagaccctacgaggagcccccccagaagccccccagattcagccagctgagatgccaggacctgctgagccagaccagcagccccctgagccagaacgacagctgcaccggcagaagcgccgacctgctgctgccccccggcgacaccggcagaagaagacacgacagcctgcacgaccccgccgcccccagcagagccgagagattcagaatccaggaggagcacagagaggccaagctgaccctgagaccccccagcctggccgccccctacgcccccgtgcagagctggcagcaccagcccgagaagctgatcttcgagagctgcggctacgaggccaactacctgggcagcatgctgatcaaggacctgagaggcaccgagagcacccaggacgcctgcgccaagatgagaaagagcaccgagcacatgaagaagatccccaccatcatcctgagcatcacctacaagggcgtgaagttcatcgacgccagcaacaagaacgtgatcgccgagcacgagatcagaaacatcagctgcgccgcccaggaccccgaggacctgtgcaccttcgcctacatcaccaaggacctgcagaccagccaccactactgccacgtgttcagcaccgtggacgtgaacctgacctacgagatcatcctgaccctgggccaggccttcgaggtggcctaccagctggccctgcaggcccagaagagcagagccaccggcgccagcgccgccgagatgatcgagaccaagagcagcaagcccgtgcccaagcccagagtgggcgtgagaaagagcgccctggagccccccgacatggaccaggacgcccagagccacgccagcgtgagctgggtggtggaccccaagcccgacagcaagagaagcctgagcaccaactag

SEQ ID NO: 10521 - DNA, 3099 bp, Artificial Sequence
  Description of Artificial Sequence: Synthetic coding sequence
atggaggccgccgccgccgtggtggccgccgaggccgaggtggagaacgaggacggcgacagcagctgcggcgacgtgtgcttcatggacaagggcctgcagagcatcagcgagctgagcctggacagcaccctgcacgccgtgaacctgcactgcaacaacatcagcaagatcgaggccatcgaccacatctggaacctgcagcacctggacctgagcagcaaccagatcagcagaatcgagggcctgaacaccctgaccaagctgtgcaccctgaacctgagctgcaacctgatcaccaaggtggagggcctggaggagctgatcaacctgaccagactgaacgtgagctacaaccacatcgacgacctgagcggcctgatccccctgcacggcatcaagcacaagctgagatacatcgacctgcacagcaacagaatcgacagcatccaccacctgctgcagtgcatggtgggcctgcacttcctgaccaacctgatcctggagaaggacggcgacgacaaccccgtgtgcagactgcccggctacagagccgtgatcctgcagaccctgccccagctgagaatcctggactgcaagaacatcttcggcgagcccgtgaacctgaccgagatcaacagcagccagctgcagtgcctggagggcctgctggacaacctggtgagcagcgacagccccctgaacatcagcgaggacgagatcatcgacagaatgcccgtgatcaccgcccccatcgacgagctggtgcccctggagcagttcgccagcacccccagcgacgccgtgctgaccagcttcatgagcgtgtgccagagcagcgagcccgagaagaacaaccacgagaacgacctgcagaacgagatcaagctgcagaagctggacgaccagatcctgcagctgctgaacgagaccagcaacagcatcgacaacgtgctggagaaggaccccagacccaagagagacaccgacatcaccagcgagagcgactacggcaacagaaaggagtgcaacagaaaggtgcccagaagaagcaagatcccctacgacgccaagaccatccagaccatcaagcaccacaacaagaactacaacagcttcgtgagctgcaacagaaagatgaagcccccctacctgaaggagctgtacgtgagcagcagcctggccaactgccccatgctgcaggagagcgagaagcccaagaccgagatcatcaaggtggaccagagccacagcgaggacaacacctaccagagcctggtggagcagctggaccaggagagagagaagagatggagagccgagcaggccgagaacaagctgatggactacatcgacgagctgcacaagcacgccaacgagaaggaggacatccacagcctggccctgctgaccaccgacagactgaaggagatcatcttcagagagagaaacagcaagggccagctggaggtgatggtgcacaagctgcagaacgagatcaagaagctgaccgtggagctgatgaaggccaaggaccagcaggaggaccacctgaagcacctgagaaccctggagaagaccctggagaagatggagagacagaagagacagcagcaggccgcccagatcagactgatccaggaggtggagctgaaggccagcgccgccgacagagagatctacctgctgagaaccagcctgcacagagagagagagcaggcccagcagctgcaccagctgctggccctgaaggagcaggagcacagaaaggagctggagaccagagagttcttcaccgacgccgacttccaggacgccctggccaaggagatcgccaaggaggagaagaagcacgagcagatgatcaaggagtaccaggagaagatcgacgtgctgagccagcagtacatggacctggagaacgagttcagaatcgccctgaccgtggaggccagaagattccaggacgtgaaggacggcttcgagaacgtggccaccgagctggccaagagcaagcacgccctgatctgggcccagagaaaggagaacgagagcagcagcctgatcaaggacctgacctgcatggtgaaggagcagaagaccaagctggccgaggtgagcaagctgaagcaggagaccgccgccaacctgcagaaccagatcaacaccctggagatcctgatcgaggacgacaagcagaagagcatccagatcgagctgctgaagcacgagaaggtgcagctgatcagcgagctggccgccaaggagagcctgatcttcggcctgagaaccgagagaaaggtgtggggccacgagctggcccagcagggcagcagcctggcccagaacagaggcaagctggaggcccagatcgagagcctgagcagagagaacgagtgcctgagaaagaccaacgagagcgacagcgacgccctgagaatcaagtgcaagatcatcgacgaccagaccgagaccatcagaaagctgaaggactgcctgcaggagaaggacgagcacatcaagagactgcaggagaagatcaccgagatcgagaagtgcacccaggagcagctggacgagaagagcagccagctggacgaggtgctggagaagctggagagacacaacgagagaaaggagaagctgaagcagcagctgaagggcaaggaggtggagctggaggagatcagaaaggcctacagcaccctgaacagaaagtggcacgacaagggcgagctgctgtgccacctggagacccaggtgaaggaggtgaaggagaagttcgagaacaaggagaagaagctgaaggccgagagagacaagagcatcgagctgcagaagaacgccatggagaagctgcacagcatggacgacgccttcaagagacaggtggacgccatcgtggaggcccaccaggccgagatcgcccagctggccaacgagaagcagaagtgcatcgacagcgccaacctgaaggtgcaccagatcgagaaggagatgagagagctgctggaggagacctgcaagaacaagaagaccatggaggccaagatcaagcagctggccttcgccctgaacgagatccagcaggacatgtag

SEQ ID NO: 10522 - DNA, 219 bp, Artificial Sequence
  Description of Artificial Sequence: Synthetic coding sequence
atgagctaccagcagcagcagtgcaagcagccctgccagcccccccccgtgtgccccacccccaagtgccccgagccctgccccccccccaagtgccccgagccctgccccagccccaagtgcccccagccctgccccccccagcagtgccagcagaagtacccccccgtgacccccagccccccctgccagcccaagtgcccccccaagagcaagtag

SEQ ID NO: 10523 - DNA, 888 bp, Artificial Sequence; identical to SEQ ID NO: 10194
  Description of Artificial Sequence: Synthetic coding sequence

SEQ ID NO: 10524 - DNA, 1491 bp, Artificial Sequence; identical to SEQ ID NO: 10231
  Description of Artificial Sequence: Synthetic coding sequence

SEQ ID NO: 10525 - DNA, 1575 bp, Artificial Sequence
  Description of Artificial Sequence: Synthetic coding sequence
atgagcagctgcgtgagcagccagcccagcagcaacagagccgccccccaggacgagctgggcggcagaggcagcagcagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagctgcacccctgggtgaccagacacggcgccgagcccctgcccagcgaggacgagaactgcaccctggtggaggtgaccgaggaggaggtggagaacagcgtgaagcacatccccagcctggccaccgtgatcctggtgaagaccatgatcagaaagagaagcttcggcaaccccttcgagggcagcagaagagaggagagaagcctgagcgcccccggcaacctgctgaccaagcagggcagcgaggacaacctgcagggcaccgaccccccccccgtgggcgaggaggaggtgctgctgtag

SEQ ID NO: 10526 - DNA, 1902 bp, Artificial Sequence
  Description of Artificial Sequence: Synthetic coding sequence
atgaaggccatcaagaagagcctgaccgaggaggagtacctgtacctggacttcagccaccagaccgagggctgcatcttccccctgcacaccagcgtgaccctgttcctgctgagctactgcgactgcaagatcttcaagatctgcctggtggtgaccaaggaggtgagcagagacagcagcctgctgagagacgacctgatccaggacgtggagatccagatcatcagcagacaggagctgccccccatcgtgcagaactgctgcctgcccgccgtggtggagagaagcgacaacttctgcagagccggcctggccgtggtgctgagacacatcatccagaagagctacgaggccgaccccctgaagaaggagctgctggagctgctgggcttcaagaagacctgcctgaaggcctgcgccgaggtgagccagtggaccagactgtgcgagctgaccatccccctggccatcgagaacttcctgagagagagcagcgaccagccccccaccatccccgtggagatcctgcagctggagaagaagctgagcgagcccgtgagagtgcacaacgacgacaagctgagaagacagaagctgaagcagcagaaggccgacggcgtgggcccccccctgaccaagggcaaggccaagagcaaggtgcacacccaggagaccagcgagggcctggacagcagcagcaagagcctggagctgaaggtggccttcagcaagctgaccgtgcaggaggagcccgccaccaccaacagagagcccagccacatcagaaaggccaaggccagcgacctgccccccctggagcacgtgttcgccgagggcctgtacttcaccctggccgacatcgtgctgctgccctgcatccaccacttcctggtgatcatcagcagaaagttcagcgagaagctggtggagttccccctgctggccagctggtaccagagaatccaggaggtgcccggcgtgaagaccgccgccagcaagtgcggcatccagttcctgcacctgcccaagctgctgaccaccagcaccgagcagcaccccaacctgtgcgaggtgcccggcgtggaggagcagagcgaccccctgttcatcggcggccccagacccaccatggccaagctgatggagaagggcatcgaggtgatgttcagcccccacccctgccccacctggaccctggactggaacgtgctgcccgccgccgtgagccccaaggagggcaagatgagcagcgacagagccctgagaaagcagcagcagctgaacaacctggtgtacgtggtgaccaaccaggccaagcccggcgacagaatcgtggacttctgcagcggcggcggccacgtgggcatcgtgctggcccacatgctgcccagctgccaggtgaccctgatcgagaacaaggagctgagcctgatcagagccaagaagagaagcgacgagctgggcctgagcaacatctggttcatccaggccaacatggagtacttcaccggcatgttcaacatcggcgtggccctgcacgcctgcggcgtggccaccgacatggtgatcgagcactgcatcaagaccagagccagcttcgtgacctgcccctgctgctacggcttcatccagaacaccagcaagttcaacttccccaagagcgagcagttcaagaagaccctgagctacaaggagcacatgatcctgtgcagattcgccgaccagaccgccgtgcagctgcccccccagagaagactgatcggcaagcagtgcatgtgcctggtggacctggacagagccagagccgccgaggagtgcggctacagcgtgcaggtgatcagcatggagcccgagagctgcagccccaagaacaacatgatcgtgggcgtgcccatctag

SEQ ID NO: 10527 - DNA, 519 bp, Artificial Sequence
  Description of Artificial Sequence: Synthetic coding sequence
atgagcagcggcaactaccagcagagcgaggccctgagcaagcccaccttcagcgaggagcaggccagcgccctggtggagagcgtgttcggcctgaaggtgagcaaggtgagacccctgcccagctacgacgaccagaacttccacgtgtacgtgagcaagaccaaggacggccccaccgagtacgtgctgaagatcagcaacaccaaggccagcaagaaccccgacctgatcgaggtgcagaaccacatcatcatgttcctgaaggccgccggcttccccaccgccagcgtgtgccacaccaagggcgacaacaccgccagcctggtgagcgtggacagcggcagcgagatcaagagctacctggtgagactgctgacctacctgcccggcagacccatcgccgagctgcccgtgagcccccagctgctgtacgagatcggcaagctggccgccaagctggacaagaccctgcaggagggcaagcccagagtgacccccctgctggccaagaactag

SEQ ID NO: 10528 - DNA, 2937 bp, Artificial Sequence
  Description of Artificial Sequence: Synthetic coding sequence
atgggctggaagcccagcgaggccagaggccagagccagagcttccaggccagcggcctgcagcccagaagcctgaaggccgccagaagagccaccggcagacccgacagaagcagagccgccagacccaccatggaccccagcgcccacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcggcgagggcaagcccggcagagtggtggacatcagaggctgggacgtggagaccggcagaagcgtggccagcgtgacctgggccgacggcaccaccaacgtgtacagagtgggccacaagggcaaggtggacctgaagtgcgtgggcgaggccgccggcggcttctactacaaggaccacctgcccagactgggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagttcatcggccagaccggcaccgtgcacagaatcaccgacagaggcgacgtgagagtgcagttcaaccacgagaccagatggaccttccaccccggcgccctgaccaaggccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 10529 - DNA, 1074 bp, Artificial Sequence
  Description of Artificial Sequence: Synthetic coding sequence
atgggcggcgccgtgagcgccggcgaggacaacgacgacctgatcgacaacctgaaggaggcccagtacatcagaaccgagagagtggagcaggccttcagagccatcgacagaggcgactactacctggagggctacagagacaacgcctacaaggacctggcctggaagcacggcaacatccacctgagcgccccctgcatctacagcgaggtgatggaggccctgaagctgcagcccggcctgagcttcctgaacctgggcagcggcaccggctacctgagcaccatggtgggcctgatcctgggccccttcggcatcaaccacggcatcgagctgcacagcgacgtggtggagtacgccaaggagaagctggagagcttcatcaagaacagcgacagcttcgacaagttcgagttctgcgagcccgccttcgtggtgggcaactgcctgcagatcgccagcgacagccaccagtacgacagaatctactgcggcgccggcgtgcagaaggaccacgagaactacatgaagatcctgctgaaggtgggcggcatcctggtgatgcccatcgaggaccagctgacccagatcatgagaaccggccagaacacctgggagagcaagaacatcctggccgtgagcttcgcccccctggtgcagcccagcaagaacgacaacggcaagcccgacagcgtgggcctgcccccctgcgccgtgagaaacctgcaggacctggccagaatctacatcagaagaaccctgagaaacttcatcaacgacgagatgcaggccaagggcatcccccagagagccccccccaagagaaagagaaagagagtgaagcagagaatcaacacctacgtgttcgtgggcaaccagctgatcccccagcccctggacagcgaggaggacgagaagatggaggaggacaacaaggaggaggaggagaaggaccacaacgaggccatgaagcccgaggagcccccccagaacctgctgagagagaagatcatgaagctgcccctgcccgagagcctgaaggcctacctgacctacttcagagacaagtag

SEQ ID NO: 10530 - DNA, 633 bp, Artificial Sequence
  Description of Artificial Sequence: Synthetic coding sequence
atgagctgccccaactactgcagcggcaacagcaacagcggcagcctgagaaccagcagacacatccccctgaccagcatcgacctgtgccccaccagcgtgagctgcggcgacgtgctgtacctgcccaccagcagccaggaccacacctgggtgaccgacaactgccaggagacctgcggcgagcccaccagctgccagcccgtgcactgcgagaccggcaacctggagaccagctgcggcagcagcaccgcctactacgtgcccagaccctgccagggcagcagcttcctgcccgccagcttcttcagcagcagctgcctgcccgtgagctgcagaccccagagatacgtgagcagcggctgcagacccctgagacccctgctgaacagctaccagcccatcggcgactgcgtgcccaacgcctacagaccccagttctgcctgagcaagagctgccagccccagaacctgctgaccagcggctgccagcccagcagctgcctggcctacagaccccagagcctgcacgtggtgagcagcagcctgagacccctgggccccctgttcagcggctgccagcccctgacccacgtgttcagcacctgcagacccagctgcagcggcctgtag

SEQ ID NO: 10531 - DNA, 606 bp, Artificial Sequence
  Description of Artificial Sequence: Synthetic coding sequence
atggccagcggcgacgacagccccatcttcgaggacgacgagagccccccctacagcctggagaagatgaccgacctggtggccgtgtgggacgtggccctgagcgacggcgtgcacaagatcgagttcgagcacggcaccaccagcggcaagagagtggtgtacgtggacggcaaggaggagatcagaaaggagtggatgttcaagctggtgggcaaggagaccttctacgtgggcgccgccaagaccaaggccaccatcaacatcgacgccatcagcggcttcgcctacgagtacaccctggagatcaacggcaagagcctgaagaagtacatggaggacagaagcaagaccaccaacacctgggtgctgcacatggacggcgagaacttcagaatcgtgctggagaaggacgccatggacgtgtggtgcaacggcaagaagctggagaccgccggcgagttcgtggacgacggcaccgagacccacttcagcatcggcaaccacgactgctacatcaaggccgtgagcagcggcaagagaaaggagggcatcatccacaccctgatcgtggacaacagagagatccccgagatcgccagctag

SEQ ID NO: 10532 - DNA, 3390 bp, Artificial Sequence
  Description of Artificial Sequence: Synthetic coding sequence
atgcccgccaccagaaagcccatgagatacggccacaccgagggccacaccgaggtgtgcttcgacgacagcggcagcttcatcgtgacctgcggcagcgacggcgacgtgagaatctgggaggacctggacgacgacgaccccaagttcatcaacgtgggcgagaaggcctacagctgcgccctgaagagcggcaagctggtgaccgccgtgagcaacaacaccatccaggtgcacaccttccccgagggcgtgcccgacggcatcctgaccagattcaccaccaacgccaaccacgtggtgttcaacggcgacggcaccaagatcgccgccggcagcagcgacttcctggtgaagatcgtggacgtgatggacagcagccagcagaagaccttcagaggccacgacgcccccgtgctgagcctgagcttcgaccccaaggacatcttcctggccagcgccagctgcgacggcagcgtgagagtgtggcagatcagcgaccagacctgcgccatcagctggcccctgctgcagaagtgcaacgacgtgatcaacgccaagagcatctgcagactggcctggcagcccaagagcggcaagctgctggccatccccgtggagaagagcgtgaagctgtacagaagagagagctggagccaccagttcgacctgagcgacaacttcatcagccagaccctgaacatcgtgacctggagcccctgcggccagtacctggccgccggcagcatcaacggcctgatcatcgtgtggaacgtggagaccaaggactgcatggagagagtgaagcacgagaagggctacgccatctgcggcctggcctggcaccccacctgcggcagaatcagctacaccgacgccgagggcaacctgggcctgctggagaacgtgtgcgaccccagcggcaagaccagcagcagcaaggtgagcagcagagtggagaaggactacaacgacctgttcgacggcgacgacatgagcaacgccggcgacttcctgaacgacaacgccgtggagatccccagcttcagcaagggcatcatcaacgacgacgaggacgacgaggacctgatgatggccagcggcagacccagacagagaagccacatcctggaggacgacgagaacagcgtggacatcagcatgctgaagaccggcagcagcctgctgaaggaggaggaggaggacggccaggagggcagcatccacaacctgcccctggtgaccagccagagacccttctacgacggccccatgcccacccccagacagaagcccttccagagcggcagcacccccctgcacctgacccacagattcatggtgtggaacagcatcggcatcatcagatgctacaacgacgagcaggacaacgccatcgacgtggagttccacgacaccagcatccaccacgccacccacctgagcaacaccctgaactacaccatcgccgacctgagccacgaggccatcctgctggcctgcgagagcaccgacgagctggccagcaagctgcactgcctgcacttcagcagctgggacagcagcaaggagtggatcatcgacctgccccagaacgaggacatcgaggccatctgcctgggccagggctgggccgccgccgccaccagcgccctgctgctgagactgttcaccatcggcggcgtgcagaaggaggtgttcagcctggccggccccgtggtgagcatggccggccacggcgagcagctgttcatcgtgtaccacagaggcaccggcttcgacggcgaccagtgcctgggcgtgcagctgctggagctgggcaagaagaagaagcagatcctgcacggcgaccccctgcccctgaccagaaagagctacctggcctggatcggcttcagcgccgagggcaccccctgctacgtggacagcgagggcatcgtgagaatgctgaacagaggcctgggcaacacctggacccccatctgcaacaccagagagcactgcaagggcaagagcgaccactactgggtggtgggcatccacgagaacccccagcagctgagatgcatcccctgcaagggcagcagattcccccccaccctgcccagacccgccgtggccatcctgagcttcaagctgccctactgccagatcgccaccgagaagggccagatggaggagcagttctggagaagcgtgatcttccacaaccacctggactacctggccaagaacggctacgagtacgaggagagcaccaagaaccaggccaccaaggagcagcaggagctgctgatgaagatgctggccctgagctgcaagctggagagagagttcagatgcgtggagctggccgacctgatgacccagaacgccgtgaacctggccatcaagtacgccagcagaagcagaaagctgatcctggcccagaagctgagcgagctggccgtggagaaggccgccgagctgaccgccacccaggtggaggaggaggaggaggaggaggacttcagaaagaagctgaacgccggctacagcaacaccgccaccgagtggagccagcccagattcagaaaccaggtggaggaggacgccgaggacagcggcgaggccgacgacgaggagaagcccgagatccacaagcccggccagaacagcttcagcaagagcaccaacagcagcgacgtgagcgccaagagcggcgccgtgaccttcagcagccagggcagagtgaaccccttcaaggtgagcgccagcagcaaggagcccgccatgagcatgaacagcgccagaagcaccaacatcctggacaacatgggcaagagcagcaagaagagcaccgccctgagcagaaccaccaacaacgagaagagccccatcatcaagcccctgatccccaagcccaagcccaagcaggccagcgccgccagctacttccagaagagaaacagccagaccaacaagaccgaggaggtgaaggaggagaacctgaagaacgtgctgagcgagacccccgccatctgccccccccagaacaccgagaaccagagacccaagaccggcttccagatgtggctggaggagaacagaagcaacatcctgagcgacaaccccgacttcagcgacgaggccgacatcatcaaggagggcatgatcagattcagagtgctgagcaccgaggagagaaaggtgtgggccaacaaggccaagggcgagaccgccagcgagggcaccgaggccaagaagagaaagagagtggtggacgagagcgacgagaccgagaaccaggaggagaaggccaaggagaacctgaacctgagcaagaagcagaagcccctggacttcagcaccaaccagaagctgagcgccttcgccttcaagcaggagtag

SEQ ID NO: 10533 - DNA, 1476 bp, Artificial Sequence
  Description of Artificial Sequence: Synthetic coding sequence
agcggcagcagccacagcttccccggcagcctggaggtgaccgccctgatgaccacctggagcagcctgcagggcagccacgtgagcaagagagccctggcctacgccctggtggtgaccaactgccaggagagaatccagcactggaagaaggtggacaacgactacaacgccctgagagagagactgagcaccctgcccgacaagctgagctacaacatcatggtgcccttcggccccttcgccttcatgcccggcaagctggtgcacaccaacgaggtgaccgtgctgctgggcgacaactggttcgccaagtgcagcgccaagcaggccgtgggcctggtggagcacagaaaggagcacgtgagaaagaccatcgacgacctgaagaaggtgatgaagaacttcgagagcagagtggagttcaccgaggacctgcagaagatgagcgacgccgccggcgacatcgtggacatcagagaggagatcaagtgcgacttcgagttcaaggccaagcacagaatcgcccacaagccccacagcaagcccaagaccagcgacatcttcgaggccgacatcgccaacgacgtgaagagcaaggacctgctggccgacaaggagctgtgggccagactggaggagctggagagacaggaggagctgctgggcgagctggacagcaagcccgacaccgtgatcgccaacggcgaggacaccaccagcagcgaggaggagaaggaggacagaaacaccaacgtgaacgccatgcaccaggtgaccgacagccacaccccctgccacaaggacgtggccagcagcgagcccttcagcggccaggtgaacagccagctgaactgcagcgtgaacggcagcagcagctaccacagcgacgacgacgacgacgacgacgacgacgacgacgacgacaacatcgacgacgacgacggcgacaacgaccacgaggccctgggcgtgggcgacaacagcatccccaccatctacttcagccacaccgtggagcccaagagagtgagaatcaacaccggcaagaacaccaccctgaagttcagcgagaagaaggaggaggccaagagaaagagaaagaacagcaccggcagcggccacagcgcccaggagctgcccaccatcagaacccccgccgacatctacagagccttcgtggacgtggtgaacggcgagtacgtgcccagaaagagcatcctgaagagcagaagcagagagaacagcgtgtgcagcgacaccagcgagagcagcgccgccgagttcgacgacagaagaggcgtgctgagaagcatcagctgcgaggaggccacctgcagcgacaccagcgagagcatcctggaggaggagccccaggagaaccagaagaagctgctgcccctgagcgtgacccccgaggtgctgagactggtgggctacagcagaaacctggcccccctgaacgtgatcctgtag

SEQ ID NO: 10534 - DNA, 981 bp, Artificial Sequence
  Description of Artificial Sequence: Synthetic coding sequence
atgctgctgagcaagttcggcagcctggcccacctgtgcggccccggcggcgtggaccacctgcccgtgaagatcctgcagcccgccaaggccgacaaggagagcttcgagaaggcctaccaggtgggcgccgtgctgggcagcggcggcttcggcaccgtgtacgccggcagcagaatcgccgacggcctgcccgtggccgtgaagcacgtggtgaaggagagagtgaccgagtggggcagcctgggcggcgccaccgtgcccctggaggtggtgctgctgagaaaggtgggcgccgccggcggcgccagaggcgtgatcagactgctggactggttcgagagacccgacggcttcctgctggtgctggagagacccgagcccgcccaggacctgttcgacttcatcaccgagagaggcgccctggacgagcccctggccagaagattcttcgcccaggtgctggccgccgtgagacactgccacagctgcggcgtggtgcacagagacatcaaggacgagaacctgctggtggacctgagaagcggcgagctgaagctgatcgacttcggcagcggcgccctgctgaaggacaccgtgtacaccgacttcgacggcaccagagtgtacagcccccccgagtggatcagataccacagataccacggcagaagcgccaccgtgtggagcctgggcgtgctgctgtacgacatggtgtgcggcgacatccccttcgagcaggacgaggagatcctgagaggcagactgctgttcagaagaagagtgagccccgagtgccagcagctgatcagatggtgcctgagcctgagacccagcgagagacccagcctggaccagatcgccgcccacccctggatgctgggcgccgacggcggcgtgcccgagagctgcgacctgagactgtgcaccctggaccccgacgacgtggccagcaccaccagcagcagcgagagcctgtag

SEQ ID NO: 10535 - DNA, 2880 bp, Artificial Sequence
  Description of Artificial Sequence: Synthetic coding sequence
atggccgccagcaccggctacgtgagactgtggggcgccgccagatgctgggtgctgagaagacccatgctggccgccgccggcggcagagtgcccaccgccgccggcgcctggctgctgagaggccagagaacctgcgacgccagccccccctgggccctgtggggcagaggccccgccatcggcggccagtggagaggcttctgggaggccagcagcagaggcggcggcgccttcagcggcggcgaggacgccagcgagggcggcgccgaggagggcgccggcggcgccggcggcagcgccggcgccggcgagggccccgtgatcaccgccctgacccccatgaccatccccgacgtgttcccccacctgcccctgatcgccatcaccagaaaccccgtgttccccagattcatcaagatcatcgaggtgaagaacaagaagctggtggagctgctgagaagaaaggtgagactggcccagccctacgtgggcgtgttcctgaagagagacgacagcaacgagagcgacgtggtggagagcctggacgagatctaccacaccggcaccttcgcccagatccacgagatgcaggacctgggcgacaagctgagaatgatcgtgatgggccacagaagagtgcacatcagcagacagctggaggtggagcccgaggagcccgaggccgagaacaagcacaagcccagaagaaagagcaagagaggcaagaaggaggccgaggacgagctgagcgccagacaccccgccgagctggccatggagcccacccccgagctgcccgccgaggtgctgatggtggaggtggagaacgtggtgcacgaggacttccaggtgaccgaggaggtgaaggccctgaccgccgagatcgtgaagaccatcagagacatcatcgccctgaaccccctgtacagagagagcgtgctgcagatgatgcaggccggccagagagtggtggacaaccccatctacctgagcgacatgggcgccgccctgaccggcgccgagagccacgagctgcaggacgtgctggaggagaccaacatccccaagagactgtacaaggccctgagcctgctgaagaaggagttcgagctgagcaagctgcagcagagactgggcagagaggtggaggagaagatcaagcagacccacagaaagtacctgctgcaggagcagctgaagatcatcaagaaggagctgggcctggagaaggacgacaaggacgccatcgaggagaagttcagagagagactgaaggagctggtggtgcccaagcacgtgatggacgtggtggacgaggagctgagcaagctgggcctgctggacaaccacagcagcgagttcaacgtgaccagaaactacctggactggctgaccagcatcccctggggcaagtacagcaacgagaacctggacctggccagagcccaggccgtgctggaggaggaccactacggcatggaggacgtgaagaagagaatcctggagttcatcgccgtgagccagctgagaggcagcacccagggcaagatcctgtgcttctacggcccccccggcgtgggcaagaccagcatcgccagaagcatcgccagagccctgaacagagagtacttcagattcagcgtgggcggcatgaccgacgtggccgagatcaagggccacagaagaacctacgtgggcgccatgcccggcaagatcatccagtgcctgaagaagaccaagaccgagaaccccctgatcctgatcgacgaggtggacaagatcggcagaggctaccagggcgaccccagcagcgccctgctggagctgctggaccccgagcagaacgccaacttcctggaccactacctggacgtgcccgtggacctgagcaaggtgctgttcatctgcaccgccaacgtgaccgacaccatccccgagcccctgagagacagaatggagatgatcaacgtgagcggctacgtggcccaggagaagctggccatcgccgagagatacctggtgccccaggccagagccctgtgcggcctggacgagagcaaggccaagctgagcagcgacgtgctgaccctgctgatcaagcagtactgcagagagagcggcgtgagaaacctgcagaagcaggtggagaaggtgctgagaaagagcgcctacaagatcgtgagcggcgaggccgagagcgtggaggtgacccccgagaacctgcaggacttcgtgggcaagcccgtgttcaccgtggagagaatgtacgacgtgaccccccccggcgtggtgatgggcctggcctggaccgccatgggcggcagcaccctgttcgtggagaccagcctgagaagaccccaggacaaggacgccaagggcgacaaggacggcagcctggaggtgaccggccagctgggcgaggtgatgaaggagagcgccagaatcgcctacaccttcgccagagccttcctgatgcagcacgcccccgccaacgactacctggtgaccagccacatccacctgcacgtgcccgagggcgccacccccaaggacggccccagcgccggctgcaccatcgtgaccgccctgctgagcctggccatgggcagacccgtgagacagaacctggccatgaccggcgaggtgagcctgaccggcaagatcctgcccgtgggcggcatcaaggagaagaccatcgccgccaagagagccggcgtgacctgcatcgtgctgcccgccgagaacaagaaggacttctacgacctggccgccttcatcaccgagggcctggaggtgcacttcgtggagcactacagagagatcttcgacatcgccttccccgacgagcaggccgaggccctggccgtggagagatag

SEQ ID NO: 10536 - DNA, 1203 bp, Artificial Sequence
  Description of Artificial Sequence: Synthetic coding sequence
atgaaccccgccagcgcccccccccccctgcccccccccggccagcaggtgatccacgtgacccaggacctggacaccgacctggaggccctgttcaacagcgtgatgaaccccaagcccagcagctggagaaagaagatcctgcccgagagcttcttcaaggagcccgacagcggcagccacagcagacagagcagcaccgacagcagcggcggccaccccggccccagactggccggcggcgcccagcacgtgagaagccacagcagccccgccagcctgcagctgggcaccggcgccggcgccgccggcagccccgcccagcagcacgcccacctgagacagcagagctacgacgtgaccgacgagctgcccctgccccccggctgggagatgaccttcaccgccaccggccagagatacttcctgaaccacatcgagaagatcaccacctggcaggaccccagaaaggccatgaaccagcccctgaaccacatgaacctgcaccccgccgtgagcagcacccccgtgccccagagaagcatggccgtgagccagcccaacctggtgatgaaccaccagcaccagcagcagatggcccccagcaccctgagccagcagaaccaccccacccagaacccccccgccggcctgatgagcatgcccaacgccctgaccacccagcagcagcagcagcagaagctgagactgcagagaatccagatggagagagagagaatcagaatgagacaggaggagctgatgagacaggaggccgccctgtgcagacagctgcccatggaggccgagaccctggcccccgtgcaggccgccgtgaacccccccaccatgacccccgacatgagaagcatcaccaacaacagcagcgaccccttcctgaacggcggcccctaccacagcagagagcagagcaccgacagcggcctgggcctgggctgctacagcgtgcccaccacccccgaggacttcctgagcaacgtggacgagatggacaccggcgagaacgccggccagacccccatgaacatcaacccccagcagaccagattccccgacttcctggactgcctgcccggcaccaacgtggacctgggcaccctggagagcgaggacctgatccccctgttcaacgacgtggagagcgccctgaacaagagcgagcccttcctgacctggctgtag

SEQ ID NO: 10537 - DNA, 2625 bp, Artificial Sequence
  Description of Artificial Sequence: Synthetic coding sequence
atggaggtgctgagagagaaggtggaggaggaggaggaggccgagagagaggaggccgccgagtgggccgagtgggccagaatggagaagatgatgagacccgtggaggtgagaaaggaggagatcaccctgaagcaggagaccctgagagacctggagaagaagctgagcgagatccagatcaccgtgagcgccgagctgcccgccttcaccaaggacaccatcgacatcagcaagctgcccatcagctacaagaccaacacccccaaggaggagcacctgctgcaggtggccgacaacttcagcagacagtacagccacctgtgccccgacagagtgcccctgttcctgcaccccctgaacgagtgcgaggtgcccaagttcgtgagcaccaccctgagacccaccctgatgccctaccccgagctgtacaactgggacagctgcgcccagttcgtgagcgacttcctgaccatggtgcccctgcccgaccccctgaagccccccagccacctgtacagcagcaccaccgtgctgaagtaccagaagggcaactgcttcgacttcagcaccctgctgtgcagcatgctgatcggcagcggctacgacgcctactgcgtgaacggctacggcagcctggacctgtgccacatggacctgaccagagaggtgtgccccctgaccgtgaagcccaaggagaccatcaagaaggaggagaaggtgctgcccaagaagtacaccatcaagccccccagagacctgtgcagcagattcgagcaggagcaggaggtgaagaagcagcaggagatcagagcccaggagaagaagagactgagagaggaggaggagagactgatggaggccgagaaggccaagcccgacgccctgcacggcctgagagtgcacagctgggtgctggtgctgagcggcaagagagaggtgcccgagaacttcttcatcgaccccttcaccggccacagctacagcacccaggacgagcacttcctgggcatcgagagcctgtggaaccacaagaactactggatcaacatgcaggactgctggaactgctgcaaggacctgatcttcgacctgggcgaccccgtgagatgggagtacatgctgctgggcaccgacaagagccagctgagcctgaccgaggaggacgacagcggcatcaacgacgaggacgacgtggagaacctgggcaaggaggacgaggacaagagcttcgacatgccccacagctgggtggagcagatcgagatcagccccgaggccttcgagaccagatgccccaacggcaagaaggtgatccagtacaagagagccaagctggagaagtgggccccctacctgaacagcaacggcctggtgagcagactgaccacctacgaggacctgcagtgcaccaacatcctggagatcaaggagtggtaccagaacagagaggacatgctggagctgaagcacatcaacaagaccaccgacctgaagaccgactacttcaagcccggccacccccaggccctgagagtgcacagctacaagagcatgcagcccgagatggacagagtgatcgagttctacgagaccgccagagtggacggcctgatgaagagagaggagacccccagaaccatgaccgagtactaccagggcagacccgacttcctgagctacagacacgccagcttcggccccagagtgaagaagctgaccctgagcagcgccgagagcaaccccagacccatcgtgaagatcaccgagagattcttcagaaaccccgccaagcccgccgaggaggacgtggccgagagagtgttcctggtggccgaggagagaatccagctgagataccactgcagagaggaccacatcaccgccagcaagagagagttcctgagaagaaccgaggtggacagcaagggcaacaagatcatcatgacccccgacatgtgcatcagcttcgaggtggagcccatggagcacaccaagaagctgctgtaccagtacgaggccatgatgcacctgaagagagaggagaagctgagcagacaccaggtgtgggagagcgagctggaggtgctggagatcctgaagctgagagaggaggaggaggccgcccacaccctgaccatcagcatctacgacaccaagagaaacgagaagagcaaggagtacagagaggccatggagagaatgatgcacgaggagcacctgagacaggtggagacccagctggactacctggcccccttcctggcccagctgccccccggcgagaagctgacctgctggcaggccgtgagactgaaggacgagtgcctgagcgacttcaagcagagactgatcaacaaggccaacctgatccaggccagattcgagaaggagacccaggagctgcagaagaagcagcagtggtaccaggagaaccaggtgaccctgacccccgaggacgaggacctgtacctgagctactgcagccaggccatgttcagaatcagaatcctggagcagagactgaacagacacaaggagctggcccccctgaagtacctggccctggaggagaagctgtacaaggaccccagactgggcgagctgcagaagatcttcgcctag

SEQ ID NO: 10538 - DNA, 1851 bp, Artificial Sequence
  Description of Artificial Sequence: Synthetic coding sequence
atggacgtgatgctggagaactactgccacctgatcagcgtgggctgccacatgaccaagcccgacgtgatcctgaagctggagagaggcgaggagccctggaccagcttcgccggccacacctgcctggaggagaactggaaggccgaggacttcctggtgaagttcaaggagcaccaggagaagtacagcagaagcgtggtgagcatcaaccacaagaagctggtgaaggagaagagcaagatctacgagaagaccttcaccctgggcaagaaccccgtgaacagcaagaacctgccccccgagtacgacacccacggcagaatcctgaagaacgtgagcgagctgatcatcagcaacctgaaccccgccagaaagagactgagcgagtacaacggctacggcaagagcctgctgagcaccaagcaggagaccacccaccccgaggtgaagagccacaaccagagcgccagagccttcagccacaacgaggtgctgatgcagtaccagaagaccgagacccccgcccagagcttcggctacaacgactgcgagaagagcttcctgcagagaggcggcctgatcacccacagcagaccctacaagggcgagaaccccagcgtgtacaacaagaagagaagagccaccaacatcgagaagaagcacacctgcaacgagtgcggcaagagcttctgcagaaagagcgtgctgatcctgcaccagggcatccacagcgaggagaagccctaccagtgccaccagtgcggcaacgccttcagaagaaagagctacctgatcgaccaccagagaacccacaccggcgagaagcccttcgtgtgcaacgagtgcggcaagagcttcagactgaagaccgccctgaccgaccaccagagaacccacaccggcgagaagagctacgagtgcctgcagtgcagaaacgccttcagactgaagagccacctgatcagacaccagagaacccacaccggcgagaagccctacgagtgcaacgactgcggcaagagcttcagacagaagaccaccctgagcctgcaccagagaatccacaccggcgagaagccctacatctgcaaggagtgcggcaagagcttccaccagaaggccaacctgaccgtgcaccagagaacccacaccggcgagaagccctacatctgcaacgagtgcggcaagagcttcagccagaagaccaccctggccctgcacgagaagacccacaacgaggagaagccctacatctgcagcgagtgcggcaagagcttcagacagaagaccaccctggtggcccaccagagaacccacaccggcgagaagagctacgagtgcccccactgcggcaaggccttcagaatgaagagctacctgatcgaccaccacagaacccacaccggcgagaagccctacgagtgcaacgagtgcggcaagagcttcagccagaagaccaacctgaacctgcaccagagaatccacaccggcgagaagccctacgtgtgcaacgagtgcggcaagagcttcagacagaaggccaccctgaccgtgcaccagaagatccacaccggccagaagagctacgagtgcccccagtgcggcaaggccttcagcagaaagagctacctgatccaccaccagagaacccacaccggcgagaagccctacaagtgcagcgagtgcggcaagtgcttcagacagaagaccaacctgatcgtgcaccagagaacccacaccggcgagaagccctacgtgtgcaacgagtgcggcaagagcttcagctacaagagaaacctgatcgtgcaccagagaacccacaagggcgagaacatcgagatgcagtag

SEQ ID NO: 10539 - DNA, 441 bp, Artificial Sequence
  Description of Artificial Sequence: Synthetic coding sequence
atgtgccacaccagctgcagcagcggctgccagcccgcctgctgcgcccccagcccctgccagcccgcctgctgcgtgcccagcagctgccaggccagctgctgcgtgcccgtgggctgccagagcagcgtgtgcgtgcccgtgagcttcaagcccgccgtgtgcctgcccgtgagctgccagagcagcgtgtgcgtgcccatgagcttcaagagcgccgtgtgcgtgcccgtgagctgccagagcagcgtgtgcgtgcccgtgagctgcagacccatcgtgtgcgccgcccccagctgccagagcagcctgtgcgtgcccgtgagctgcagacccgtggtgtacgccgcccccagctgccagagcagcggctgctgccagcccagctgcaccagcgtgctgtgcagacccatcagctacagcatcagcagctgctgctag

SEQ ID NO: 10540 - DNA, 1257 bp, Artificial Sequence; identical to SEQ ID NO: 10234
  Description of Artificial Sequence: Synthetic coding sequence

SEQ ID NO: 10541 - DNA, 3351 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccagcacatgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaaggtggagcagctgaaggaggagctgagcagcaaggaggcccagtgggaggagctgaagaagaaggccgccggcctgcaggccgagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggacagcctgagaaagaaggacgacagaatcgaggagctggaggaggccctgagagagagcgtgcagatcaccgccgagagagagatggtgctggcccaggaggagagcgccagaaccaacgccgagaagcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccagatcatccagcccctgctggagctggaccagaacagaagcaagctgaagctgtacatcggccacctgaccaccctgtgccacgacagagaccccctgatcctgagaggcctgaccccccccgccagctacaacctggacgacgaccaggccgcctgggagaacgagctgcagaagatgaccagaggccagctgcaggacgagctggagaagggcgagagagacaacgccgagctgcaggagttcgccaacgccatcctgcagcagatcgccgaccactgccccgacatcctggagcaggtggtgaacgccctggaggagagcagctag

SEQ ID NO: 10542 - DNA, 3075 bp, Artificial Sequence
  Description of Artificial Sequence: Synthetic coding sequence
atgaacttcatcaaggacaacagcagagccctgatccagagaatgggcatgaccgtgatcaagcagatcaccgacgacctgttcgtgtggaacgtgctgaacagagaggaggtgaacatcatctgctgcgagaaggtggagcaggacgccgccagaggcatcatccacatgatcctgaagaagggcagcgagagctgcaacctgttcctgaagagcctgaaggagtggaactaccccctgttccaggacctgaacggccagagcctgttccaccagaccagcgagggcgacctggacgacctggcccaggacctgaaggacctgtaccacacccccagcttcctgaacttctaccccctgggcgaggacatcgacatcatcttcaacctgaagagcaccttcaccgagcccgtgctgtggagaaaggaccagcaccaccacagagtggagcagctgaccctgaacggcctgctgcaggccctgcagagcccctgcatcatcgagggcgagagcggcaagggcaagagcaccctgctgcagagaatcgccatgctgtggggcagcggcaagtgcaaggccctgaccaagttcaagttcgtgttcttcctgagactgagcagagcccagggcggcctgttcgagaccctgtgcgaccagctgctggacatccccggcaccatcagaaagcagaccttcatggccatgctgctgaagctgagacagagagtgctgttcctgctggacggctacaacgagttcaagccccagaactgccccgagatcgaggccctgatcaaggagaaccacagattcaagaacatggtgatcgtgaccaccaccaccgagtgcctgagacacatcagacagttcggcgccctgaccgccgaggtgggcgacatgaccgaggacagcgcccaggccctgatcagagaggtgctgatcaaggagctggccgagggcctgctgctgcagatccagaagagcagatgcctgagaaacctgatgaagacccccctgttcgtggtgatcacctgcgccatccagatgggcgagagcgagttccacagccacacccagaccaccctgttccacaccttctacgacctgctgatccagaagaacaagcacaagcacaagggcgtggccgccagcgacttcatcagaagcctggaccactgcggcgacctggccctggagggcgtgttcagccacaagttcgacttcgagctgcaggacgtgagcagcgtgaacgaggacgtgctgctgaccaccggcctgctgtgcaagtacaccgcccagagattcaagcccaagtacaagttcttccacaagagcttccaggagtacaccgccggcagaagactgagcagcctgctgaccagccacgagcccgaggaggtgaccaagggcaacggctacctgcagaagatggtgagcatcagcgacatcaccagcacctacagcagcctgctgagatacacctgcggcagcagcgtggaggccaccagagccgtgatgaagcacctggccgccgtgtaccagcacggctgcctgctgggcctgagcatcgccaagagacccctgtggagacaggagagcctgcagagcgtgaagaacaccaccgagcaggagatcctgaaggccatcaacatcaacagcttcgtggagtgcggcatccacctgtaccaggagagcaccagcaagagcgccctgagccaggagttcgaggccttcttccagggcaagagcctgtacatcaacagcggcaacatccccgactacctgttcgacttcttcgagcacctgcccaactgcgccagcgccctggacttcatcaagctggacttctacggcggcgccatggccagctgggagaaggccgccgaggacaccggcggcatccacatggaggaggcccccgagacctacatccccagcagagccgtgagcctgttcttcaactggaagcaggagttcagaaccctggaggtgaccctgagagacttcagcaagctgaacaagcaggacatcagatacctgggcaagatcttcagcagcgccaccagcctgagactgcagatcaagagatgcgccggcgtggccggcagcctgagcctggtgctgagcacctgcaagaacatctacagcctgatggtggaggccagccccctgaccatcgaggacgagagacacatcaccagcgtgaccaacctgaagaccctgagcatccacgacctgcagaaccagagactgcccggcggcctgaccgacagcctgggcaacctgaagaacctgaccaagctgatcatggacaacatcaagatgaacgaggaggacgccatcaagctggccgagggcctgaagaacctgaagaagatgtgcctgttccacctgacccacctgagcgacatcggcgagggcatggactacatcgtgaagagcctgagcagcgagccctgcgacctggaggagatccagctggtgagctgctgcctgagcgccaacgccgtgaagatcctggcccagaacctgcacaacctggtgaagctgagcatcctggacctgagcgagaactacctggagaaggacggcaacgaggccctgcacgagctgatcgacagaatgaacgtgctggagcagctgaccgccctgatgctgccctggggctgcgacgtgcagggcagcctgagcagcctgctgaagcacctggaggaggtgccccagctggtgaagctgggcctgaagaactggagactgaccgacaccgagatcagaatcctgggcgccttcttcggcaagaaccccctgaagaacttccagcagctgaacctggccggcaacagagtgagcagcgacggctggctggccttcatgggcgtgttcgagaacctgaagcagctggtgttcttcgacttcagcaccaaggagttcctgcccgaccccgccctggtgagaaagctgagccaggtgctgagcaagctgaccttcctgcaggaggccagactggtgggctggcagttcgacgacgacgacctgagcgtgatcaccggcgccttcaagctggtgaccgcctag

SEQ ID NO: 10543 - DNA, 1065 bp, Artificial Sequence
  Description of Artificial Sequence: Synthetic coding sequence
atggccgagagccccaccgaggaggccgccaccgccggcgccggcgccgccggccccggcgccagcagcgtggccggcgtggtgggcgtgagcggcagcggcggcggcttcggcccccccttcctgcccgacgtgtgggccgccgccgccgccgccggcggcgccggcggccccggcagcggcctggcccccctgcccggcctgccccccagcgccgccgcccacggcgccgccctgctgagccactgggaccccaccctgagcagcgactgggacggcgagagaaccgccccccagtgcctgctgagaatcaagagagacatcatgagcatctacaaggagcccccccccggcatgttcgtggtgcccgacaccgtggacatgaccaagatccacgccctgatcaccggccccttcgacaccccctacgagggcggcttcttcctgttcgtgttcagatgcccccccgactaccccatccacccccccagagtgaagctgatgaccaccggcaacaacaccgtgagattcaaccccaacttctacagaaacggcaaggtgtgcctgagcatcctgggcacctggaccggccccgcctggagccccgcccagagcatcagcagcgtgctgatcagcatccagagcctgatgaccgagaacccctaccacaacgagcccggcttcgagcaggagagacaccccggcgacagcaagaactacaacgagtgcatcagacacgagaccatcagagtggccgtgtgcgacatgatggagggcaagtgcccctgccccgagcccctgagaggcgtgatggagaagagcttcctggagtactacgacttctacgaggtggcctgcaaggacagactgcacctgcagggccagaccatgcaggaccccttcggcgagaagagaggccacttcgactaccagagcctgctgatgagactgggcctgatcagacagaaggtgctggagagactgcacaacgagaacgccgagatggacagcgacagcagcagcagcggcaccgagaccgacctgcacggcagcctgagagtgtag

SEQ ID NO: 10544 - DNA, 2487 bp, Artificial Sequence
  Description of Artificial Sequence: Synthetic coding sequence
atggacagcgaggccttccagagcgccagagacttcctggacatgaacttccagagcctggccatgaagcacatggacctgaagcagatggagctggacaccgccgccgccaaggtggacgagctgaccaagcagctggagagcctgtggagcgacagccccgccccccccggcccccaggccggcccccccagcagaccccccagatacagcagcagcagcatccccgagcccttcggcagcagaggcagccccagaaaggccgccaccgacggcgccgacacccccttcggcagaagcgagagcgcccccaccctgcacccctacagccccctgagccccaagggcagacccagcagccccagaacccccctgtacctgcagcccgacgcctacggcagcctggacagagccaccagccccagacccagagccttcgacggcgccggcagcagcctgggcagagcccccagccccagacccggccccggccccctgagacagcagggcccccccacccccttcgacttcctgggcagagccggcagccccagaggcagccccctggccgagggcccccaggccttcttccccgagagaggccccagccccagaccccccgccaccgcctacgacgcccccgccagcgccttcggcagcagcctgctgggcagcggcggcagcgccttcgccccccccctgagagcccaggacgacctgaccctgagaagaagaccccccaaggcctggaacgagagcgacctggacgtggcctacgagaagaagcccagccagaccgccagctacgagagactggacgtgttcgccagacccgccagccccagcctgcagctgctgccctggagagagagcagcctggacggcctgggcggcaccggcaaggacaacctgaccagcgccaccctgcccagaaactacaaggtgagccccctggccagcgacagaagaagcgacgccggcagctacagaagaagcctgggcagcgccggccccagcggcaccctgcccagaagctggcagcccgtgagcagaatccccatgccccccagcagcccccagcccagaggcgcccccagacagagacccatccccctgagcatgatcttcaagctgcagaacgccttctgggagcacggcgccagcagagccatgctgcccggcagccccctgttcaccagagcccccccccccaagctgcagccccagccccagccccagccccagccccagagccagccccagccccagctgcccccccagccccagacccagccccagacccccacccccgccccccagcacccccagcagacctggccccccgtgaacgagggcccccccaagccccccaccgagctggagcccgagcccgagatcgagggcctgctgacccccgtgctggaggccggcgacgtggacgagggccccgtggccagacccctgagccccaccagactgcagcccgccctgccccccgaggcccagagcgtgcccgagctggaggaggtggccagagtgctggccgagatccccagacccctgaagagaagaggcagcatggagcaggcccccgccgtggccctgccccccacccacaagaagcagtaccagcagatcatcagcagactgttccacagacacggcggccccggccccggcggccccgagcccgagctgagccccatcaccgagggcagcgaggccagagccggcccccccgcccccgccccccccgcccccatccccccccccgcccccagccagagcagcccccccgagcagccccagagcatggagatgagaagcgtgctgagaaaggccggcagccccagaaaggccagaagagccagactgaaccccctggtgctgctgctggacgccgccctgaccggcgagctggaggtggtgcagcaggccgtgaaggagatgaacgaccccagccagcccaacgaggagggcatcaccgccctgcacaacgccatctgcggcgccaactacagcatcgtggacttcctgatcaccgccggcgccaacgtgaacagccccgacagccacggctggacccccctgcactgcgccgccagctgcaacgacaccgtgatctgcatggccctggtgcagcacggcgccgccatcttcgccaccaccctgagcgacggcgccaccgccttcgagaagtgcgacccctacagagagggctacgccgactgcgccacctacctggccgacgtggagcagagcatgggcctgatgaacagcggcgccgtgtacgccctgtgggactacagcgccgagttcggcgacgagctgagcttcagagagggcgagagcgtgaccgtgctgagaagagacggccccgaggagaccgactggtggtgggccgccctgcacggccaggagggctacgtgcccagaaactacttcggcctgttccccagagtgaagccccagagaagcaaggtgtag

SEQ ID NO: 10545 - DNA, 1131 bp, Artificial Sequence
  Description of Artificial Sequence: Synthetic coding sequence
atggtggtggaggtggacagcatgcccgccgccagcagcgtgaagaagcccttcggcctgagaagcaagatgggcaagtggtgctgcagatgcttcccctgctgcagagagagcggcaagagcaacgtgggcaccagcggcgaccacgacgacagcgccatgaagaccctgagaagcaagatgggcaagtggtgcagacactgcttcccctgctgcagaggcagcggcaagagcaacgtgggcgccagcggcgaccacgacgacagcgccatgaagaccctgagaaacaagatgggcaagtggtgctgccactgcttcccctgctgcagaggcagcagcaagagcaaggtgggcgcctggggcgactacgacgacagcgccttcatggagcccagataccacgtgagaggcgaggacctggacaagctgcacagagccgcctggtggggcaaggtgcccagaaaggacctgatcgtgatgctgagagacaccgacgtgaacaagcaggacaagcagaagagaaccgccctgcacctggccagcgccaacggcaacagcgaggtggtgaagctgctgctggacagaagatgccagctgaacgtgctggacaacaagaagagaaccgccctgatcaaggccgtgcagtgccaggaggacgagtgcgccctgatgctgctggagcacggcaccgaccccaacatccccgacgagtacggcaacaccaccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccaccacgtgatctgccagctgctgagcgactacaaggagaagcagatgctgaagatcagcagcgagaacagcaaccccggctag

SEQ ID NO: 10546 - DNA, 765 bp, Artificial Sequence
  Description of Artificial Sequence: Synthetic coding sequence
atgcccgccagcttccccatgctgagatgcgccagaagcccctgctggaccgtgtgctggagcccctggtgcagagccctgcccgacggcagatgcagctgcctgagcagcccccccagccccctgggccccaccagagaccccgtggccaccttcctggagacctgcagagagcccggcagccagcccgccggccccgccagcctgagagccgagtacctgccccccagcgtggccagcatcaaggtgagcgccgagctgctgagagccgccctgaaggacggccacagcggcgtgcccctgtgctgcgccaccctgcagtggctgctggccgagaacgccgccgtggacgtggtgagagccagagccctgagcagcatccagggcgtggcccccgacggcgccaacgtgcacctgatcgtgagagaggtggccatgaccgacctgtgccccgccggccccatccaggccgtggagatccaggtggagagcagcagcctggccgacatctgcagagcccaccacgccgtggtgggcagaatgcagaccatggtgaccgagcaggccacccagggcagcagcgcccccgacctgagagtgcagtacctgagacagatccacgccaaccacgagaccctgctgagagaggtgcagaccctgagagacagactgtgcaccgaggacgaggccagcagctgcgccaccgcccagagactgctgcaggtgtacagacagctgagacaccccagcctgatcctgctgtag

SEQ ID NO: 10547 - DNA, 2046 bp, Artificial Sequence
  Description of Artificial Sequence: Synthetic coding sequence
atgtgcggcatcttcgcctacctgaactaccacgtgcccagaaccagaagagagatcctggagaccctgatcaagggcctgcagagactggagtacagaggctacgacagcgccggcgtgggcttcgacggcggcaacgacaaggactgggaggccaacgcctgcaagatccagctgatcaagaagaagggcaaggtgaaggccctggacgaggaggtgcacaagcagcaggacatggacctggacatcgagttcgacgtgcacctgggcatcgcccacaccagatgggccacccacggcgagcccagccccgtgaacagccacccccagagaagcgacaagaacaacgagttcatcgtgatccacaacggcatcatcaccaactacaaggacctgaagaagttcctggagagcaagggctacgacttcgagagcgagaccgacaccgagaccatcgccaagctggtgaagtacatgtacgacaacagagagagccaggacaccagcttcaccaccctggtggagagagtgatccagcagctggagggcgccttcgccctggtgttcaagagcgtgcacttccccggccaggccgtgggcaccagaagaggcagccccctgctgatcggcgtgagaagcgagcacaagctgagcaccgaccacatccccatcctgtacagaaccggcaaggacaagaagggcagctgcaacctgagcagagtggacagcaccacctgcctgttccccgtggaggagaaggccgtggagtactacttcgccagcgacgccagcgccgtgatcgagcacaccaacagagtgatcttcctggaggacgacgacgtggccgccgtggtggacggcagactgagcatccacagaatcaagagaaccgccggcgaccaccccggcagagccgtgcagaccctgcagatggagctgcagcagatcatgaagggcaacttcagcagcttcatgcagaaggagatcttcgagcagcccgagagcgtggtgaacaccatgagaggcagagtgaacttcgacgactacaccgtgaacctgggcggcctgaaggaccacatcaaggagatccagagatgcagaagactgatcctgatcgcctgcggcaccagctaccacgccggcgtggccaccagacaggtgctggaggagctgaccgagctgcccgtgatggtggagctggccagcgacttcctggacagaaacacccccgtgttcagagacgacgtgtgcttcttcctgagccagagcggcgagaccgccgacaccctgatgggcctgagatactgcaaggagagaggcgccctgaccgtgggcatcaccaacaccgtgggcagcagcatcagcagagagaccgactgcggcgtgcacatcaacgccggccccgagatcggcgtggccagcaccaaggcctacaccagccagttcgtgagcctggtgatgttcgccctgatgatgtgcgacgacagaatcagcatgcaggagagaagaaaggagatcatgctgggcctgaagagactgcccgacctgatcaaggaggtgctgagcatggacgacgagatccagaagctggccaccgagctgtaccaccagaagagcgtgctgatcatgggcagaggctaccactacgccacctgcctggagggcgccctgaagatcaaggagatcacctacatgcacagcgagggcatcctggccggcgagctgaagcacggccccctggccctggtggacaagctgatgcccgtgatcatgatcatcatgagagaccacacctacgccaagtgccagaacgccctgcagcaggtggtggccagacagggcagacccgtggtgatctgcgacaaggaggacaccgagaccatcaagaacaccaagagaaccatcaaggtgccccacagcgtggactgcctgcagggcatcctgagcgtgatccccctgcagctgctggccttccacctggccgtgctgagaggctacgacgtggacttccccagaaacctggccaagagcgtgaccgtggagtag

SEQ ID NO: 10548 - DNA, 498 bp, Artificial Sequence
  Description of Artificial Sequence: Synthetic coding sequence
atggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgagctgggagcccctgctgaaggcccccagccccttcaccatcagcaccacccccagcttcagaccctgcagcaaccccgtgacctag

SEQ ID NO: 10549 - DNA, 633 bp, Artificial Sequence
  Description of Artificial Sequence: Synthetic coding sequence
atggccgccagcgtggagcagagagagggcaccatccaggtgcagggccaggccctgttcttcagagaggccctgcccggcagcggccaggccagattcagcgtgctgctgctgcacggcatcagattcagcagcgagacctggcagaacctgggcaccctgcacagactggcccaggccggctacagagccgtggccatcgacctgcccggcctgggccacagcaaggaggccgccgcccccgcccccatcggcgagctggcccccggcagcttcctggccgccgtggtggacgccctggagctgggcccccccgtggtgatcagccccagcctgagcggcatgtacagcctgcccttcctgaccgcccccggcagccagctgcccggcttcgtgcccgtggcccccatctgcaccgacaagatcaacgccgccaactacgccagcgtgaagacccccgccctgatcgtgtacggcgaccaggaccccatgggccagaccagcttcgagcacctgaagcagctgcccaaccacagagtgctgatcatgaagggcgccggccacccctgctacctggacaagcccgaggagtggcacaccggcctgctggacttcctgcagggcctgcagtag

SEQ ID NO: 10550 - DNA, 1248 bp, Artificial Sequence
  Description of Artificial Sequence: Synthetic coding sequence
atgagagccgccgacagcggcagctgggagagagtgagacagctggccgcccagggcgagcccgcccccagctgcggcgccggcgccggccccgccagaccccccggccccgccgcctgcgagcagtgcgtggacgccgccggccccggcgacagacccagagccggcgtgcccagagtgagagccgacggcgactgcagccagcccgtgctgctgagagaggaggtgagcagactgcaggaggaggtgcacctgctgagacagatgaaggagatgctggccaaggacctggaggagagccagggcggcaagagcagcgaggtgctgagcgccaccgagctgagagtgcagctggcccagaaggagcaggagctggccagagccaaggaggccctgcaggccatgaaggccgacagaaagagactgaagggcgagaagaccgacctggtgagccagatgcagcagctgtacgccaccctggagagcagagaggagcagctgagagacttcatcagaaactacgagcagcacagaaaggagagcgaggacgccgtgaaggccctggccaaggagaaggacctgctggagagagagaagtgggagctgagaagacaggccaaggaggccaccgaccacgccaccgccctgagaagccagctggacctgaaggacaacagaatgaaggagctggaggccgagctggccatggccaagcagagcctggccaccctgaccaaggacgtgcccaagagacacagcctggccatgcccggcgagaccgtgctgaacggcaaccaggagtgggtggtgcaggccgacctgcccctgaccgccgccatcagacagagccagcagaccctgtaccacagccaccccccccaccccgccgacagacaggccgtgagagtgagcccctgccacagcagacagcccagcgtgatcagcgacgccagcgccgccgagggcgacagaagcagcacccccagcgacatcaacagccccagacacagaacccacagcctgtgcaacggcgacagccccggccccgtgcagaagaacctgcacaaccccatcgtgcagagcctggaggacctggaggaccagaagagaaagaagaagaaggagaagatgggcttcggcagcatcagcagagtgttcgccagaggcaagcagagaaagagcctggaccccggcctgttcgacggcaccgcccccgactactacatcgaggaggacgccgactggtag

SEQ ID NO: 10551 - DNA, 693 bp, Artificial Sequence
  Description of Artificial Sequence: Synthetic coding sequence
atggaggccgccgagaccgaggccgaggccgccgccctggaggtgctggccgaggtggccggcatcctggagcccgtgggcctgcaggaggaggccgagctgcccgccaagatcctggtggagttcgtggtggacagccagaagaaggacaagctgctgtgcagccagctgcaggtggccgacttcctgcagaacatcctggcccaggaggacaccgccaagggcctggaccccctggccagcgaggacaccagcagacagaaggccatcgccgccaaggagcagtggaaggagctgaaggccacctacagagagcacgtggaggccatcaagatcggcctgaccaaggccctgacccagatggaggaggcccagagaaagagaacccagctgagagaggccttcgagcagctgcaggccaagaagcagatggccatggagaagagaagagccgtgcagaaccagtggcagctgcagcaggagaagcacctgcagcacctggccgaggtgagcgccgagggcaagctgctgttccccgaggccgaggccgaggccgagaacctgcccgacgacaagccccagcagcccaccagaccccaggagcagagcaccggcgacaccatgggcagagaccccggcgtgagcttcaaggccgtgggcctgcagcccgccggcgacgtgaacctgccctag

SEQ ID NO: 10552 - DNA, 2547 bp, Artificial Sequence
  Description of Artificial Sequence: Synthetic coding sequence
atgcaggccgaggccgccgactggttcagcagcatgcccttccagaagcacgtgtactaccccctggccagcggccccgagggccccgacgtggccgtggccgccgccgccgccggcgccgccagcatggcctgcgccccccccagcgccgccagcggccccctgcccttcttccagttcagacccagactggagagcgtggactggagaagactgagcgccatcgacgtggacaaggtggccggcgccgtggacgtgctgaccctgcaggagaacatcatgaacatcaccttctgcaagctggaggacgagaagtgcccccactgccagagcggcgtggaccccgtgctgctgaagctgatcagactggcccagttcaccatcgagtacctgctgcacagccaggagttcctgaccagccagctgcacaccctggaggagagactgagactgagccactgcgacggcgagcagagcaagaagctgctgaccaagcaggccggcgagatcaagaccctgaaggaggagtgcaagagaagaaagaagatgatcagcacccagcagctgatgatcgaggccaaggccaactactaccagtgccacttctgcgacaaggccttcatgaaccaggccttcctgcagagccacatccagagaagacacaccgaggagaacagccacttcgagtaccagaagaacgcccagatcgagaagctgagaagcgagatcgtggtgctgaaggaggagctgcagctgaccagaagcgagctggaggccgcccaccacgccagcgccgtgagattcagcaaggagtacgagatgcagaagaccaaggaggaggacttcctgaagctgttcgacagatggaaggaggaggagaaggagaagctggtggacgagatggagaaggtgaaggagatgttcatgaaggagttcaaggagctgaccagcaagaacagcgccctggagtaccagctgagcgagatccagaagagcaacatgcagatcaagagcaacatcggcaccctgaaggacgcccacgagttcaaggaggacagaagcccctacccccaggacttccacaacgtgatgcagctgctggacagccaggagagcaagtggaccgccagagtgcaggccatccaccaggagcacaagaaggagaagggcagactgctgagccacatcgagaagctgagaaccagcatgatcgacgacctgaacgccagcaacgtgttctacaagaagagaatcgaggagctgggccagagactgcaggagcagaacgagctgatcatcacccagagacagcagatcaaggacttcacctgcaaccccctgaacagcatcagcgagcccaaggtgaacgcccccgccctgcacaccctggagaccaagagcagcctgcccatggtgcacgagcaggccttcagcagccacatcctggagcccatcgaggagctgagcgaggaggagaagggcagagagaacgagcagaagctgaacaacaacaagatgcacctgagaaaggccctgaagagcaacagcagcctgaccaagggcctgagaaccatggtggagcagaacctgatggagaagctggagaccctgggcatcaacgccgacatcagaggcatcagcagcgaccagctgcacagagtgctgaagagcgtggagagcgagagacacaagcaggagagagagatccccaacttccaccagatcagagagttcctggagcaccaggtgagctgcaagatcgaggagaaggccctgctgagcagcgaccagtgcagcgtgagccagatggacaccctgagcaccggcgaggtgcccaagatgatccagctgcccagcaagaacagacagctgatcagacagaaggccgtgagcaccgacagaaccagcgtgcccaagatcaagaagaacgtgatggaggaccccttccccagaaagagcagcaccatcaccaccccccccttcagcagcgaggaggagcaggaggacgacgacctgatcagagcctacgccagccccggccccctgcccgtgccccccccccagaacaagggcagcttcggcaagaacaccgtgaagagcgacgccgacggcaccgagggcagcgagatcgaggacaccgacgacagccccaagcccgccggcgtggccgtgaagacccccaccgagaaggtggagaagatgttcccccacagaaagaacgtgaacaagcccgtgggcggcaccaacgtgcccgagatgttcatcaagaaggaggagctgcaggagctgaagtgcgccgacgtggaggacgaggactgggacatcagcagcctggaggaggagatcagcctgggcaagaagagcggcaaggagcagaaggagcccccccccgccaagaacgagccccacttcgcccacgtgctgaacgcctggggcgccttcaaccccaagggccccaagggcgagggcctgcaggagaacgagagcagcaccctgaagagcagcctggtgaccgtgaccgactggagcgacaccagcgacgtgtag

SEQ ID NO: 10553 - DNA, 1185 bp, Artificial Sequence
  Description of Artificial Sequence: Synthetic coding sequence
atggtggtggaggtggacagcatgcccgccgccagcagcgtgaagaagcccttcggcctgagaagcaagatgggcaagtggtgctgcagatgcttcccctgctgcagagagagcggcaagagcaacgtgggcaccagcggcgaccacgacgacagcgccatgaagaccctgagaagcaagatgggcaagtggtgcagacactgcttcccctgctgcagaggcagcggcaagagcaacgtgggcgccagcggcgaccacgacgacagcgccatgaagaccctgagaaacaagatgggcaagtggtgctgccactgcttcccctgctgcagaggcagcagcaagagcaaggtgggcgcctggggcgactacgacgacagcgccttcatggagcccagataccacgtgagaggcgaggacctggacaagctgcacagagccgcctggtggggcaaggtgcccagaaaggacctgatcgtgatgctgagagacaccgacgtgaacaagcaggacaagcagaagagaaccgccctgcacctggccagcgccaacggcaacagcgaggtggtgaagctgctgctggacagaagatgccagctgaacgtgctggacaacaagaagagaaccgccctgatcaaggtgtgcagcagccagctgtaccagcacgaggccgtgcagtgccaggaggacgagtgcgccctgatgctgctggagcacggcaccgaccccaacatccccgacgagtacggcaacaccaccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccaccacgtgatctgccagctgctgagcgactacaaggagaagcagatgctgaagatcagcagcgagaacagcaaccccgagaacgtgagcagaaccagaaacaagtag

SEQ ID NO: 10554 - DNA, 1308 bp, Artificial Sequence
  Description of Artificial Sequence: Synthetic coding sequence
atggcccccttcggcagaaacctgctgaagaccagacacaagaacagaagccccaccaaggacatggacagcgaggagaaggagatcgtggtgtgggtgtgccaggaggagaagctggtgtgcggcctgaccaagagaaccaccagcgccgacgtgatccaggccctgctggaggagcacgaggccaccttcggcgagaagagattcctgctgggcaagcccagcgactactgcatcatcgagaagtggagaggcagcgagagagtgctgccccccctgaccagaatcctgaagctgtggaaggcctggggcgacgagcagcccaacatgcagttcgtgctggtgaaggccgacgccttcctgcccgtgcccctgtggagaaccgccgaggccaagctggtgcagaacaccgagaagctgtgggagctgagccccgccaactacatgaagaccctgccccccgacaagcagaagagaatcgtgagaaagaccttcagaaagctggccaagatcaagcaggacaccgtgagccacgacagagacaacatggagaccctggtgcacctgatcatcagccaggaccacaccatccaccagcaggtgaagagaatgaaggagctggacctggagatcgagaagtgcgaggccaagttccacctggacagagtggagaacgacggcgagaactacgtgcaggacgcctacctgatgcccagcttcagcgaggtggagcagaacctggacctgcagtacgaggagaaccagaccctggaggacctgagcgagagcgacggcatcgagcagctggaggagagactgaagtactacagaatcctgatcgacaagctgagcgccgagatcgagaaggaggtgaagagcgtgtgcatcgacatcaacgaggacgccgagggcgaggccgccagcgagctggagagcagcaacctggagagcgtgaagtgcgacctggagaagagcatgaaggccggcctgaagatccacagccacctgagcggcatccagaaggagatcaagtacagcgacagcctgctgcagatgaaggccaaggagtacgagctgctggccaaggagttcaacagcctgcacatcagcaacaaggacggctgccagctgaaggagaacagagccaaggagagcgaggtgcccagcagcaacggcgagatcccccccttcacccagagagtgttcagcaactacaccaacgacaccgacagcgacaccggcatcagcagcaaccacagccaggacagcgagaccaccgtgggcgacgtggtgctgctgagcacctag

SEQ ID NO: 10555 - DNA, 1644 bp, Artificial Sequence
  Description of Artificial Sequence: Synthetic coding sequence
atggccggcaccaagaacaagaccagagcccaggccaagaccgagaagaaggccgccatccaggccaaggccggcgccgagagagaggccaccggcgtggtgagacccgtggccaagaccagagccaaggccaaggccaagaccggcagcaagaccgacgccgtggccgagatgaaggccgtgagcaagaacaaggtggtggccgagaccaaggagggcgccctgagcgagcccaagaccctgggcaaggccatgggcgacttcacccccaaggccggcaacgagagcaccagcagcacctgcaagaacgaggccggcaccgacgcctggttctgggccggcgaggaggccaccatcaacagctggttctggaacggcgaggaggccggcaacagcttcagcaccaagaacgacaagcccgagatcggcgcccaggtgtgcgccgaggagctggagcccgccgccggcgccgactgcaagcccagaagcggcgccgaggaggaggaggaggagaacgtgatcggcaactggttctgggagggcgacgacaccagcttcgaccccaaccccaagcccgtgagcagaatcgtgaagccccagcccgtgtacgagatcaacgagaagaacagacccaaggactggagcgaggtgaccatctggcccaacgcccccgccgtgacccccgccgtgctgggcttcagaagccaggcccccagcgaggccagcccccccagctacatcgtgctggccagcgccgaggagaacgcctgcagcctgcccgtggccaccgcctgcagacccagcagaaacaccagaagctgcagccagcccatccccgagtgcagattcgacagcgacccctgcatccagaccatcgacgagatcagaagacagatcagaatcagagaggtgaacggcatcaagcccttcgcctgcccctgcaagatggagtgctacatggacagcgaggagttcgagaagctggtgagcctgctgaagagcaccaccgaccccctgatccacaagatcgccagaatcgccatgggcgtgcacaacgtgcaccccttcgcccaggagttcatcaacgaggtgggcgtggtgaccctgatcgagagcctgctgagcttccccagccccgagatgagaaagaagaccgtgatcaccctgaacccccccagcggcgacgagagacagagaaagatcgagctgcacgtgaagcacatgtgcaaggagaccatgagcttccccctgaacagccccggccagcagagcggcctgaagatcctgggccagctgaccaccgacttcgtgcaccactacatcgtggccaactacttcagcgagctgttccacctgctgagcagcggcaactgcaagaccagaaacctggtgctgaagctgctgctgaacatgagcgagaaccccaccgccgccagagacatgatcaacatgaaggccctggccgccctgaagctgatcttcaaccagaaggaggccaaggccaacctggtgagcggcgtggccatcttcatcaacatcaaggagcacatcagaaagggcagcatcgtggtggtggaccacctgagctacaacaccctgatggccatcttcagagaggtgaaggagatcatcgagaccatgtag

SEQ ID NO: 10556 - DNA, 1362 bp, Artificial Sequence
  Description of Artificial Sequence: Synthetic coding sequence
atggccagaaaggtggtgagcagaaagagaaaggcccccgccagccccggcgccggcagcgacgcccagggcccccagttcggctgggaccacagcctgcacaagagaaagagactgccccccgtgaagagaagcctggtgtactacctgaagaacagagaggtgagactgcagaacgagaccagctacagcagagtgctgcacggctacgccgcccagcagctgcccagcctgctgaaggagagagagttccacctgggcaccctgaacaaggtgttcgccagccagtggctgaaccacagacaggtggtgtgcggcaccaagtgcaacaccctgttcgtggtggacgtgcagaccagccagatcaccaagatccccatcctgaaggacagagagcccggcggcgtgacccagcagggctgcggcatccacgccatcgagctgaaccccagcagaaccctgctggccaccggcggcgacaaccccaacagcctggccatctacagactgcccaccctggaccccgtgtgcgtgggcgacgacggccacaaggactggatcttcagcatcgcctggatcagcgacaccatggccgtgagcggcagcagagacggcagcatgggcctgtgggaggtgaccgacgacgtgctgaccaagagcgacgccagacacaacgtgagcagagtgcccgtgtacgcccacatcacccacaaggccctgaaggacatccccaaggaggacaccaaccccgacaactgcaaggtgagagccctggccttcaacaacaagaacaaggagctgggcgccgtgagcctggacggctacttccacctgtggaaggccgagaacaccctgagcaagctgctgagcaccaagctgccctactgcagagagaacgtgtgcctggcctacggcagcgagtggagcgtgtacgccgtgggcagccaggcccacgtgagcttcctggaccccagacagcccagctacaacgtgaagagcgtgtgcagcagagagagaggcagcggcatcagaagcgtgagcttctacgagcacatcatcaccgtgggcaccggccagggcagcctgctgttctacgacatcagagcccagagattcctggaggagagactgagcgcctgctacggcagcaagcccagactggccggcgagaacctgaagctgaccaccggcaagggctggctgaaccacgacgagacctggagaaactacttcagcgacatcgacttcttccccaacgccgtgtacacccactgctacgacagcagcggcaccaagctgttcgtggccggcggccccctgcccagcggcctgcacggcaactacgccggcctgtggagctag

SEQ ID NO: 10557 - DNA, 2439 bp, Artificial Sequence
  Description of Artificial Sequence: Synthetic coding sequence
atggaggccttccaggagctgagaaagcccagcgccagactggagtgcgaccactgcagcttcagaggcaccgactacgagaacgtgcagatccacatgggcaccatccaccccgagttctgcgacgagatggacgccggcggcctgggcaagatgatcttctaccagaagagcgccaagctgttccactgccacaagtgcttcttcaccagcaagatgtacagcaacgtgtactaccacatcaccagcaagcacgccagccccgacaagtggaacgacaagcccaagaaccagctgaacaaggagaccgaccccgtgaagagcccccccctgcccgagcaccagaagatcccctgcaacagcgccgagcccaagagcatccccgccctgagcatggagacccagaagctgggcagcgtgctgagccccgagagccccaagcccacccccctgacccccctggagccccagaagcccggcagcgtggtgagccccgagctgcagacccccctgcccagccccgagcccagcaagcccgccagcgtgagcagccccgagccccccaagagcgtgcccgtgtgcgagagccagaagctggcccccgtgcccagccccgagccccagaagcccgcccccgtgagccccgagagcgtgaaggccaccctgagcaaccccaagccccagaagcagagccacttccccgagaccctgggcccccccagcgccagcagccccgagagccccgtgctggccgccagccccgagccctggggccccagccccgccgccagccccgagagcagaaagagcgccagaaccaccagccccgagcccagaaagcccagccccagcgagagccccgagccctggaagcccttccccgccgtgagccccgagcccagaagacccgcccccgccgtgagccccggcagctggaagcccggcccccccggcagccccagaccctggaagagcaaccccagcgccagcagcggcccctggaagcccgccaagcccgcccccagcgtgagccccggcccctggaagcccatccccagcgtgagccccggcccctggaagcccacccccagcgtgagcagcgccagctggaagagcagcagcgtgagccccagcagctggaagagcccccccgccagccccgagagctggaagagcggcccccccgagctgagaaagaccgcccccaccctgagccccgagcactggaaggccgtgccccccgtgagccccgagctgagaaagcccggcccccccctgagccccgagatcagaagccccgccggcagccccgagctgagaaagcccagcggcagccccgacctgtggaagctgagccccgaccagagaaagaccagccccgccagcctggacttccccgagagccagaagagcagcagaggcggcagccccgacctgtggaagagcagcttcttcatcgagccccagaagcccgtgttccccgagaccagaaagcccggccccagcggccccagcgagagccccaaggccgccagcgacatctggaagcccgtgctgagcatcgacaccgagcccagaaagcccgccctgttccccgagcccgccaagaccgccccccccgccagccccgaggccagaaagagagccctgttccccgagcccagaaagcacgccctgttccccgagctgcccaagagcgccctgttcagcgagagccagaaggccgtggagctgggcgacgagctgcagatcgacgccatcgacgaccagaagtgcgacatcctggtgcaggaggagctgctggccagccccaagaagctgctggaggacaccctgttccccagcagcaagaagctgaagaaggacaaccaggagagcagcgacgccgagctgagcagcagcgagtacatcaagaccgacctggacgccatggacatcaagggccaggagagcagcagcgaccaggagcaggtggacgtggagagcatcgacttcagcaaggagaacaagatggacatgaccagccccgagcagagcagaaacgtgctgcagttcaccgaggagaaggaggccttcatcagcgaggaggagatcgccaagtacatgaagagaggcaagggcaagtactactgcaagatctgctgctgcagagccatgaagaagggcgccgtgctgcaccacctggtgaacaagcacaacgtgcacagcccctacaagtgcaccatctgcggcaaggccttcctgctggagagcctgctgaagaaccacgtggccgcccacggccagagcctgctgaagtgccccagatgcaacttcgagagcaacttccccagaggcttcaagaagcacctgacccactgccagagcagacacaacgaggaggccaacaagaagctgatggaggccctggagccccccctggaggagcagcagatctag

SEQ ID NO: 10558 - DNA, 1974 bp, Artificial Sequence
  Description of Artificial Sequence: Synthetic coding sequence
atggacgagcaggaggccctgaacagcatcatgaacgacctggtggccctgcagatgaacagaagacacagaatgcccggctacgagaccatgaagaacaaggacaccggccacagcaacagacagaagaagcacaacagcagcagcagcgccctgctgaacagccccaccgtgaccaccagcagctgcgccggcgccagcgagaagaagaagttcctgagcgacgtgagaatcaagttcgagcacaacggcgagagaagaatcatcgccttcagcagacccgtgaagtacgaggacgtggagcacaaggtgaccaccgtgttcggccagcccctggacctgcactacatgaacaacgagctgagcatcctgctgaagaaccaggacgacctggacaaggccatcgacatcctggacagaagcagcagcatgaagagcctgagaatcctgctgctgagccaggacagaaaccacaacagcagcagcccccacagcggcgtgagcagacaggtgagaatcaaggccagccagagcgccggcgacatcaacaccatctaccagccccccgagcccagaagcagacacctgagcgtgagcagccagaaccccggcagaagcagccccccccccggctacgtgcccgagagacagcagcacatcgccagacagggcagctacaccagcatcaacagcgagggcgagttcatccccgagaccagcgagcagtgcatgctggaccccctgagcagcgccgagaacagcctgagcggcagctgccagagcctggacagaagcgccgacagccccagcttcagaaagagcagaatgagcagagcccagagcttccccgacaacagacaggagtacagcgacagagagacccagctgtacgacaagggcgtgaagggcggcacctaccccagaagataccacgtgagcgtgcaccacaaggactacagcgacggcagaagaaccttccccagaatcagaagacaccagggcaacctgttcaccctggtgcccagcagcagaagcctgagcaccaacggcgagaacatgggcctggccgtgcagtacctggaccccagaggcagactgagaagcgccgacagcgagaacgccctgagcgtgcaggagagaaacgtgcccaccaagagccccagcgcccccatcaactggagaagaggcaagctgctgggccagggcgccttcggcagagtgtacctgtgctacgacgtggacaccggcagagagctggccagcaagcaggtgcagttcgaccccgacagccccgagaccagcaaggaggtgagcgccctggagtgcgagatccagctgctgaagaacctgcagcacgagagaatcgtgcagtactacggctgcctgagagacagagccgagaagaccctgaccatcttcatggagtacatgcccggcggcagcgtgaaggaccagctgaaggcctacggcgccctgaccgagagcgtgaccagaaagtacaccagacagatcctggagggcatgagctacctgcacagcaacatgatcgtgcacagagacatcaagggcgccaacatcctgagagacagcgccggcaacgtgaagctgggcgacttcggcgccagcaagagactgcagaccatctgcatgagcggcaccggcatgagaagcgtgaccggcaccccctactggatgagccccgaggtgatcagcggcgagggctacggcagaaaggccgacgtgtggagcctgggctgcaccgtggtggagatgctgaccgagaagcccccctgggccgagtacgaggccatggccgccatcttcaagatcgccacccagcccaccaacccccagctgcccagccacatcagcgagcacggcagagacttcctgagaagaatcttcgtggaggccagacagagacccagcgccgaggagctgctgacccaccacttcgcccagctgatgtactag

SEQ ID NO: 10559 - DNA, 2547 bp, Artificial Sequence; identical to SEQ ID NO: 10552
  Description of Artificial Sequence: Synthetic coding sequence

SEQ ID NO: 10560 - DNA, 4074 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcaccacccagggcttccccgtgagaaacgtgagacccgtgcagaacgccatgaaccaggtgggcatcgtgctgaacgtgcagcagggccagaccgtgagacccatcaccctggtgcccgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggcccccagcttccccagcccccccgccgtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 10561 - DNA, 2904 bp, Artificial Sequence
  Description of Artificial Sequence: Synthetic coding sequence
atgggccccggccagcccgccagcacctgcgtgcacctggcccccagaacccagctggacggcagaagcgaccccaaggtgctgcagacccagaaccagctgcagttcaacagaaacgtgcccacccacagcagcaacctggccatcagatacagctgcccccacgccatcagaatcgagaagctgaagcacagctacaacgagagctaccactgcaaggacgccgactgcagagtgggccccgacctgggcagcagcgtgagcttcagcgtgatcagccaggagagactgagctacgccgtgcacctggccagaagagacgtgaagagaagacagttcgagaagcacatcaaggagcaccacctgagaagccagccccagagcagccagaagtgcggccacaccaagtacaagatccccgaccacagagtggagagaaaggagagcaagagccaggccgcctgccagtgcagccaccagcccagcaaggtggagatcagcagcagcggcgccaaggtgtacctgtacagcagccaccccggccagagcgacctgaccgtgcccaacagcccccccacccacgaccccggcctgcagccccaccccagaatcggcgaccacaagaacatcagcgagcagaagagcctgctggaggtgcagagactgcagaaggagctgagcagctgcatccacaagatcgaggaggtgaccaagaaggacagactggaggaggccctggaccccgacgaggagagaagaatcagaatcagaagacaggagcaggccgccagaagcgccagaatgctgtacgtgctgcagcagcaggtgaaggagatccaggaggagctggacaagctgagcccccacaagatcaagcacaccaagaagagctgggccatgagcaagctggccgccgcccacagaggcgccatcagagccctgcagatgttcgtgacccagttcaccgacagaggcgagcaccccctgcccgccagatgcaaggagctgggcagcctgatcagacagctgagcctgtgcagcgtgaagctggacgccgaccccagcgtgcccgacgtggtgatcgacatcctgcagcagatcgaggccctggagagcctgctggagaagaagctgagccccaagaaggtgaagaagtgcttcagcgagatcagaagcagattccccatcggcagccagaaggccctggagagatggcccagcaccagccccaagggcgagagaagacccctgaccgccaaggacaccttcccccaggagaccagcagacccagcgtggccaagcagctgctggccgacaagtaccagcccgacaccgagctgcccgagacccagagactgcagagcgagctggacgtgctggacgccgacatcgtgctggaggagggccccttcatcctggaccagagcgccagcttcaaggacgaggtgctggccgtggccaagaccaaggccggcaagaagaagcccgtgaccgagaacgtgcccttcagaaagaaggacaccctggcccccgccagacagcagggcctgagaaaggccgagagaggcagacagagccagccccacagcaagagcagagtgcagcagaccaccgtgagcagcagactgaagatgaacagacagcccgtgaaggacagaaaggccccctggatcccccccaaccccaccagcccccccgccagccccaagtgcgccgcctggctgaaggtgaagaccagccccagagacgccaccaaggagcccctgcagcaggaggacccccaggaggagagccacctgaccggcgccgtggagcacgaggccgccagactggcctggctggacgccgagaccagcaagagactgaaggagctggaggagctgaaggccaaggagatcgacagcatgcagaagcagagactggactggctggacgccgagaccagcagaagaaccaaggagctgaacgagctgaaggccgaggagatgtacagactgcagcagctgagcgtgagcgccacccacctggccgacaaggtggaggaggccgtgctggacagactgaagcccctgctggtgaaggcccagagagtgaacagcaccaccgaggccaacatccacctgaaggacggcagcagcgtgaacaccgccaaggcccagcccgcccaggaggtggccgccgtggacttcgagagcaacaacatcagacagctggacgacttcctggaggactgcgccagcgagctgtgggccgtgacccacgccaagatcctgggcagcgagaccctggccaccgtggaggacagcaaggacagccccgacctggagatcatgatgagaagaatggaggagatggagaagtaccaggagagcgtgagacagagatacaacaagatcgcctacgccgaccccagactgtggatgcaggaggagaacaacgaccagaagatcagcgccatcagcgagaagcccctgagcccccaccccatcagaatcaccaagaccgtggacagaaaggaccccgccgtgaacatcatgctggagagaccctgcaacggcaacagcctggacgagagcgtgggcaccgaggagggcagcgagaagagagaggcccccctgctgagcctggccgaggacagccagcagaaggagggcagagcccccctgttcgtgccccccggcatgcagcacagcatcggcgactactgcagcagattcgagcagtacctgagaatcatcagccacgaggccgtgggcagcttcaacccctggctgatcgccgagagcttcagcgaggagctggtggacgaggccctgggcgccgtggccgccgagctgcaggacatgtgcgaggactacgccgaggccgtgttcaccagcgagttcctggaggccgccacctag

SEQ ID NO: 10562 - DNA, 6840 bp, Artificial Sequence
  Description of Artificial Sequence: Synthetic coding sequence
atgtacagaagcagcgccagaagcagcgtgagcagccacagacccaaggacgacggcggcggcggccccagaagcggcagaagcagcggcagcagcagcggccccgccagaagaagcagccccccccccccccccagcggcagcagcagcagaacccccgccagaagacccagaagccccagcggccacagaggcagaagagccagccccagcccccccagaggcagaagagtgagccccagcccccccagagccagaagaggcagccccagcccccccagaggcagaagactgttcccccccggccccgccggcttcagaggcagcagcagaggcgagagcagagccgactacgccagagacggcagaggcgaccaccccggcgacagcggcagcagaagaagaagccccggcctgtgcagcgacagcctggagaagagcctgagaatcaccgtgggcaacgaccacttctgcgtgagcacccccgagagaagaagactgagcgacagactgggcagccccgtggacaacctggaggacatggacagagacgacctgaccgacgacagcgtgttcaccagaagcagccagtgcagcagaggcctggagagatacatcagccaggaggagggccccctgagccccttcctgggccagctggacgaggactacagaaccaaggagaccttcctgcacagaagcgactacagcccccacatcagctgccacgacgagctgctgagaggcaccgagagaaacagagagaagctgaagggctacagcatcagaagcgaggagagaagcagagaggccaagagacccagatacgacgacaccgtgaagatcaacagcatgggcggcgaccaccccagcttcaccagcggcaccagaaactacagacagagaagaagaagccccagccccagattcctggaccccgagttcagagagctggacctggccagaagaaagagagaggaggaggaggagagaagcagaagcctgagccaggagctggtgggcgtggacggcggcggcaccggctgcagcatccccggcctgagcggcgtgctgaccgccagcgagcccggctacagcctgcacagacccgaggaggtgagcgtgatgcccaagaagagcatcctgaagaagagaatcgaggtggacatcatggagcccagcatgcagctggagagcttcagcagcagcaccagcagcagccaggaccaccccctgtacagcggccaccccagcctgcccctgagcggcgccatcgccgccttcgccagcgagatcgagaacaagggcaccatggtggagaccgccctgaaggagccccagggcaacctgtaccagtggggccccctgcccggcatccccaaggacaacagccccctgagagagaagttcggcagcttcctgtgccacaaggacaacctggacctgaaggccgagggccccgagagacacaccgacttcctgctgccccacgagagagccagccaggacggcagcggcttcagcagaatcctgagcatgctggccgacagcaccagcacccaggagaagagaagaagaagcttccccgacatcgaggacgaggagaagttcctgtacggcgacgaggaggaggacctgaaggccgagagcgtgcccaagcccctgggcagcagcgagagcgaggtgatgagacagaaggccagcagcctgcccagcagcgcccccgccgtgaagctggagagcctggaggagaccaaccccgagtacgccaagatccacgacctgctgaagaccatcggcctggacatcggcgtggccgagatcagccagctggccgccagaacccaggagagactgcacggcaagaagcccagcctgagaagcagcgccgacagaagaagcagcgtggacagatacttcagcgccgaccactgcagcagcgtggaccacagattcagcgccgacagatgcagcagcgtggaccactgcttcagcgccgacagaagaagcagcgacccccacagactggagagcagagaggcccaccacagcaacacccacagccccgaggtgagccacccccacccccccagccccgtggacccctacctgctgaccaagaacagcccccccttcctgaagagcgaccaccccgtgggccacatcagcggccccgaggtggtgggcagcggcttccagagcagcgtggccgtgagatgcatgctgcccagcgcccccagcgcccccatcagactgccccacaccgccgccctgagccagttccacatgcccagagccagccagttcgccgccgccagaatcccccccaactaccagggccccgccatcccccccgccagcttcgacgcctacagacactacatggcctacgccgccagcagatggcccatgtaccccaccagccagcccagcaaccaccccgtgcccgagccccacagaatcatgcccatcaccaagcaggccaccagaagcagacccaacctgagagtgatccccaccgtgacccccgacaagcccaagcagaaggagagcctgagaggcagcatccccgccgcccaggtgcccgtgcaggtgagcatccccagcctgatcagatacaaccccgagaagatcagcgacgagaagaacagagccagccagaagcagaaggtgatcgaggagagagagaagctgaagaacgacagagaggccagacagaagaagatgtactacctgagaaccgagctggagagactgcacaagcagcagggcgagatgctgagaaagaagagaagagagaaggacggccacaaggaccccctgctggtggaggtgagcagactgcaggacaacatcatgaaggacatcgccgagctgagacaggaggccgaggaggccgagaagaagcagagcgagctggacaaggtggcccagatcctgggcatcaacatcttcgacaagagccagaagagcctgagcgacagcagagagcccaccgagaagcccggcaaggccgagaagagcaagagccccgagaaggtgagcagcttcagcaacagcagcagcaacaaggagagcaaggtgaacaacgagaagttcagaaccaagagccccaagcccgccgagagcccccagagcgccaccaagcagctggaccagcccaccgccgcctacgagtactacgacgccggcaaccactggtgcaaggactgcaacaccatctgcggcaccatgttcgacttcttcacccacatgcacaacaagaagcacacccagaccctggacccctacaacagaccctgggccagcaagacccagagcgaggccaagcaggacgccatcaagagaaccgacaagatcaccgtgcccgccaagggcagcgagttcctggtgcccatcagcggcttctactgccagctgtgcgaggagttcctgggcgaccccatcagcggcgagcagcacgtgaagggccaccagcacaacgagaagtacaagaagtacgtggacgagaaccccctgtacgaggagagaagaaacctggacagacaggccggcctggccgtggtgctggagaccgagagaagaagacagagcgagctgaagagaaagctgagcgagaagcccaaggaggagaagaaggagaagaaggccaaggccgtgaaggaggtgaaggaggacgacaaggtgagcgagaagctggaggaccagctgagcgagggcagaaacagccccgagaaggccgagaacaagagaaacaccggcatcaagctgcagctgaaggaggaggtgaagaaggagagccccaccagcagcagcttcggcaagttcagctggaagaagcccgagaaggaggaggagaagagcagcctggtgacccccagcatcagcaaggaggagatcctggagagcagcaaggacaaggaggacggcaagaccgaggccggcaaggccaagcccatcaagatcaagctgagcggcaagaccgtggtggcccacaccagcccctggatgcccgtggtgaccaccagcacccagaccaagatcagacccaacctgcccatccccagcaccgtgctgagaaagagctgcagcgccaccatgagcaagcccgcccccctgaacaccttcctgagcatcaagagcagcggcaccaccgccaagcccctgcccgtggtgaaggagagcagcgccgacctgctgctgccccccgacatcatcagcaaggccttcggcggcgaggaggtgatcctgaagggcagccccgaggagaaggtggtgctggccgagaagagcgagcccagccacctgcccgagcagatcctgcccccccccccccccccccccccccccccccccccccccccccccgtgatcccccaccccgccgcccccagcgccgcccaggccaacgccatcctggcccccgtgaagagcaaccccgtggtgagccagaccctgagccccggcttcgtgggccccaacatcctgaaccccgtgctgcccgtggccatcatggccagcgcccagcccgccgccatccccagcgacgagaccgcccccggcgtgagcgagagcgacagagaccagaccctgttcagcgtgctggtgagaccccccccccccctgagcagcgtgttcagcgagcaggccaagaagctggagaagagaaacagctgcctggccaccgccaacgccaaggacctgtacgacatcttctacagcagcggcggcaagggcgcccccgagaccaagggcgcccccgagaccaagctgagcggcggccccctggccaacggcgagaacagcaacctgagcagaaccaagagcagcgacaccagcagcaccagccccctgaacagcagcgccagccaggaggagctgcaccaggacgagggcctggtggccgcccccatcgtgagcaacagcgagaagcccatcgccaagaccctggtggccctgggcaagtggagcgtggtggagcacgtgggccccaagagcaccggcagcacctacggcttcctgcagcccctgaccagactgtgccagagcagaccctacgagaccatcacccccaagaccgacaccctggccatctggaccagcagcagcttccagagcgacaccagcagagacatcagccccgagaagagcgagctggacctgggcgagcccggcccccccggcgtggagccccccccccagctgctggacatccagtgcaaggagagccagaagctggtggagatccacctgagagagagcgtgaaccaggacaaggagagccaggagctgagaaagagcgaggactgcagagagagcgagatcgagaccaacaccgagctgaaggagagagtgaaggagctgagcgagggcatcgtggacgagggcgtgagcaccagcatcggcccccacagcatcgacgacagcaacctgaaccacggcaacagatacatgtgggagggcgaggtgaagcagcccaacctgctgatgatcgacaaggaggccgagcagagcaacaagctgatgaccggcagcgagacccccagcaaggtggtgatcaagctgagcccccaggcctgcagcttcaccaaggccaagctggacagcttcctgagcgaggccagaagcctgctgaacccccaggacacccccgtgaagatcagcgcccccgagctgctgctgcacagccccgccagaagcgccatgtgcctgaccggcagcccccaggagcagggcgtgagcgtggtgagcgaggagggcctggagaacagcgcccccgagagcgccagcagaaccagcagatacagaagcctgaagctgaagagagagagaagcaaggacttccaggtgaagaagatctacgagctggccgtgtgggacgagaacaagaagagacccgagacctgggagagccccgagaagcccaagaccgaggccctggagctgcaggacgtgcaccccgagctgaccgtgaccatcgagagcaaggccctggaggacttcgaggccaccgacctgaaggtggaggagctgaccgccctgggcaacctgggcgacatgcccgtggacttctgcaccaccagagtgagccccgcccacagaagccccaccgtgctgtgccagaaggtgtgcgaggagaacagcgtgagccccatcggctgcaacagcagcgaccccgccgacttcgagcccatccccagcttcagcggcttccccctggacagccccaagaccctggtgctggacttcgagaccgagggcgagagaaacagccccaaccccagaagcgtgagaatccccagccccaacatcctgaagaccggcctgaccgagaacgtggacagaggcctgggcggcctggagggcacccaccaggccctggacctgctggccggcggcatgatgcccgaggaggtgaaggagagcagccagctggacaagcaggagagcctgggcctggagctgaagaccatcaacagcgccggcctgggccccagcccctgcctgcccgacctggtggacttcgtgaccagaaccagcggcgtgcagaaggacaagctgtgcagccccctgagcgagcccggcgaccccagcaagtgcagcagcctggagctgggccccctgcagctggagatcagcaacgccagcaccaccgaggtggccatcctgcaggtggacgacgacagcggcgaccccctgaacctggtgaaggcccccgtgagcagaagcccccccagagagcaggtgatcgaggacaacatggtgccccagggcatgcccgagcaggagaccaccgtgggcgccatccaggaccacaccgagagcagcgtgcacaactag

SEQ ID NO: 10563 - DNA, 1932 bp, Artificial Sequence
  Description of Artificial Sequence: Synthetic coding sequence
atgggccaggagagcagcaagcccgtgtggcccaaccccaccggcggctaccagagcaacaccggcagaagatacggcagaagacacgcctacgtgagcttcagaccccccaccagccagagagagagaatcgccagccagagaaagaccaacagcgaggtgcccatgcacagaagcgcccccagccagaccaccaagagaagcagaagccccttcagcaccaccagaagaagctgggacgacagcgagagcagcggcaccaacctgaacatcgacaacgaggactacagcagatacccccccagagagtacagagccagcggcagcagaagaggcatggcctacggccacatcgacagctacggcgccgacgacagcgaggaggagggcgccggccccgtggagagaccccccgtgagaggcaagaccggcaagttcaaggacgacaagctgtacgaccccgagaagggcgccagaagcctggccggcccccccccccacttcagcagcttcagcagagacgtgagagaggagagagacaagctggaccccgtgcccgccgccagatgcagcgccagcagagccgacttcctgccccagagcagcgtggccagccagagcagcagcgagggcaagctggccaccaagggcgacagcagcgagagagagagaagagagcagaacctgcccgccagacccagcagagcccccgtgagcatctgcggcggcggcgagaacaccagcaagagcgccgaggagcccgtggtgagacccaagatcagaaacctggccagccccaactgcgtgaagcccaagatcttcttcgacaccgacgacgacgacgacatgccccacagcaccagcagatggagagacaccgccaacgacaacgagggccacagcgacggcctggccagaagaggcagaggcgagagcagcagcggctaccccgagcccaagtaccccgaggacaagagagaggccagaagcgaccaggtgaagcccgagaaggtgcccagaagaagaagaaccatggccgaccccgacttctggacccacagcgacgactactacaagtactgcgacgaggacagcgacagcgacaaggagtggatcgccgccctgagaagaaagtacagaagcagagagcagaccctgagcagcagcggcgagagctgggagaccctgcccggcaaggaggagagagagcccccccaggccaaggtgagcgccagcaccggcaccagccccggccccggcgccagcgccagcgccggcgccggcgccggcgccagcgccggcagcaacggcagcaactacctggaggaggtgagagagcccagcctgcaggaggagcaggccagcctggaggagggcgagatcccctggctgcagtaccacgagaacgacagcagcagcgagggcgacaacgacagcggccacgagctgatgcagcccggcgtgttcatgctggacggcaacaacaacctggaggacgacagcagcgtgagcgaggacctggaggtggactggagcctgttcgacggcttcgccgacggcctgggcgtggccgaggccatcagctacgtggacccccagttcctgacctacatggccctggaggagagactggcccaggccatggagaccgccctggcccacctggagagcctggccgtggacgtggaggtggccaacccccccgccagcaaggagagcatcgacgccctgcccgagatcctggtgaccgaggaccacggcgccgtgggccaggagatgtgctgccccatctgctgcagcgagtacgtgaagggcgaggtggccaccgagctgccctgccaccactacttccacaagccctgcgtgagcatctggctgcagaagagcggcacctgccccgtgtgcagatgcatgttccccccccccctgtag

SEQ ID NO: 10564 - DNA, 1113 bp, Artificial Sequence
  Description of Artificial Sequence: Synthetic coding sequence
atgcccaccgagaccctgcagaccggcagcatggtgaagcccgtgagccccgccggcaccttcaccagcgccgtgcccctgagaatcctgaacaagggccccgactacttcagaagacaggccgagcccaaccccaagagactgagcgccgtggagagactggaggccgacaaggccaagtacgtgaagagccaggaggtgatcaacgccaagcaggagcccgtgaagcccgccgtgctggccaagccccccgtgtgccccgccgccaagagagccctgggcagccccaccctgaaggtgttcggcaaccacgccaagaccgagagcggcgtgcagagagagaacctgaagctggagatcctgaagaacatcatcaacagcagcgagggcagcagcagcggcagcggccacaagcacagcagcagaaactggcccccccacagaagcgaggccaccgacctgcacagacacagcttcgccgagagcctgaaggtgtaccccacccagggcagaagaagcccccaggagggcggcagccacgtgggcagaagactgctggagcagagcgccgagagcttcctgcacgtgagccacagcagcagcgacatcagaaaggtgaccagcgtgaagcccctgaaggccatcccctgcagcagcagcgccccccccctgccccccaagcccaagatcgccgccatcgccagcatgaagagccccgaggccgaccccgtggagcccgcctgcggcgtgagcagaagacccagcctgcagagaagcaagagcgacctgagcgacagatacttcagagtggacgccgacgtggagagattcttcaactactgcggcctggaccccgaggagctggagaacctgggcatggagaacttcgccagagccaacagcgacatcatcagcctgaacttcagaagcgccagcatgatcagcagcgactgcgagcagagccaggacagcaacagcgacctgagaaacgacgacagcgccaacgacagagtgccctacggcatcagcgccatcgagagaaacgccagaatcatcaagtggctgtacagcatcaagcaggccagagagagccagaaggtgagccacgtgtag

SEQ ID NO: 10565 - DNA, 3126 bp, Artificial Sequence
  Description of Artificial Sequence: Synthetic coding sequence
atggccgccgccgccgccgccggcgccgccagcggcctgcccggccccgtggcccagggcctgaaggaggccctggtggacaccctgaccggcatcctgagccccgtgcaggaggtgagagccgccgccgaggagcagatcaaggtgctggaggtgaccgaggagttcggcgtgcacctggccgagctgaccgtggacccccagggcgccctggccatcagacagctggccagcgtgatcctgaagcagtacgtggagacccactggtgcgcccagagcgagaagttcagaccccccgagaccaccgagagagccaagatcgtgatcagagagctgctgcccaacggcctgagagagagcatcagcaaggtgagaagcagcgtggcctacgccgtgagcgccatcgcccactgggactggcccgaggcctggccccagctgttcaacctgctgatggagatgctggtgagcggcgacctgaacgccgtgcacggcgccatgagagtgctgaccgagttcaccagagaggtgaccgacacccagatgcccctggtggcccccgtgatcctgcccgagatgtacaagatcttcaccatggccgaggtgtacggcatcagaaccagaagcagagccgtggagatcttcaccacctgcgcccacatgatctgcaacatggaggagctggagaagggcgccgccaaggtgctgatcttccccgtggtgcagcagttcaccgaggccttcgtgcaggccctgcagatccccgacggccccaccagcgacagcggcttcaagatggaggtgctgaaggccgtgaccgccctggtgaagaacttccccaagcacatggtgagcagcatgcagcagatcctgcccatcgtgtggaacaccctgaccgagagcgccgccttctacgtgagaaccgaggtgaactacaccgaggaggtggaggaccccgtggacagcgacggcgaggtgctgggcttcgagaacctggtgttcagcatcttcgagttcgtgcacgccctgctggagaacagcaagttcaagagcaccgtgaagaaggccctgcccgagctgatctactacatcatcctgtacatgcagatcaccgaggagcagatcaaggtgtggaccgccaacccccagcagttcgtggaggacgaggacgacgacaccttcagctacaccgtgagaatcgccgcccaggacctgctgctggccgtggccaccgacttccagaacgagagcgccgccgccctggccgccgccgccaccagacacctgcaggaggccgagcagaccaagaacagcggcaccgagcactggtggaagatccacgaggcctgcatgctggccctgggcagcgtgaaggccatcatcaccgacagcgtgaagaacggcagaatccacttcgacatgcacggcttcctgaccaacgtgatcctggccgacctgaacctgagcgtgagccccttcctgctgggcagagccctgtgggccgccagcagattcaccgtggccatgagccccgagctgatccagcagttcctgcaggccaccgtgagcggcctgcacgagacccagccccccagcgtgagaatcagcgccgtgagagccatctggggctactgcgaccagctgaaggtgagcgagagcacccacgtgctgcagcccttcctgcccagcatcctggacggcctgatccacctggccgcccagttcagcagcgaggtgctgaacctggtgatggagaccctgtgcatcgtgtgcaccgtggaccccgagttcaccgccagcatggagagcaagatctgccccttcaccatcgccatcttcctgaagtacagcaacgaccccgtggtggccagcctggcccaggacatcttcaaggagctgagccagatcgaggcctgccagggccccatgcagatgagactgatccccaccctggtgagcatcatgcaggcccccgccgacaagatccccgccggcctgtgcgccaccgccatcgacatcctgaccaccgtggtgagaaacaccaagccccccctgagccagctgctgatctgccaggccttccccgccgtggcccagtgcaccctgcacaccgacgacaacgccaccatgcagaacggcggcgagtgcctgagagcctacgtgagcgtgaccctggagcaggtggcccagtggcacgacgagcagggccacaacggcctgtggtacgtgatgcaggtggtgagccagctgctggaccccagaaccagcgagttcaccgccgccttcgtgggcagactggtgagcaccctgatcagcaaggccggcagagagctgggcgagaacctggaccagatcctgagagccatcctgagcaagatgcagcaggccgagaccctgagcgtgatgcagagcctgatcatggtgttcgcccacctggtgcacacccagctggagcccctgctggagttcctgtgcagcctgcccggccccaccggcaagcccgccctggagttcgtgatggccgagtggaccagcagacagcacctgttctacggccagtacgagggcaaggtgagcagcgtggccctgtgcaagctgctgcagcacggcatcaacgccgacgacaagagactgcaggacatcagagtgaagggcgaggagatctacagcatggacgagggcatcagaaccagaagcaagagcgccaagaaccccgagagatggaccaacatccccctgctggtgaagatcctgaagctgatcatcaacgagctgagcaacgtgatggaggccaacgccgccagacaggccacccccgccgagtggagccaggacgacagcaacgacatgtgggaggaccaggaggaggaggaggaggaggaggaggacggcctggccggccagctgctgagcgacatcctggccaccagcaagtacgaggaggactactacgaggacgacgaggaggacgaccccgacgccctgaaggaccccctgtaccagatcgacctgcaggcctacctgaccgacttcctgtgccagttcgcccagcagccctgctacatcatgttcagcggccacctgaacgacaacgagagaagagtgctgcagaccatcggcatctag

SEQ ID NO: 10566 - DNA, 156 bp, Artificial Sequence
  Description of Artificial Sequence: Synthetic coding sequence
atgagcagccacaagaccttcagaatcaagagattcctggccaagaagcagaagcagaacagacccatcccccagtggatcagaatgaagaccggcaacaagatcagatacaacagcaagagaagacactggagaagaaccaagctgggcctgtag

SEQ ID NO: 10567 - DNA, 3627 bp, Artificial Sequence
  Description of Artificial Sequence: Synthetic coding sequence
atggacagcctgcccgacgagttcttcgtgagacaccccgccgtggaggaccagagaaaggaggagaccgagaacaagctggagaagagcagcggccagctgaacaagcaggagaacgacatccccaccgacctggtgcccgtgaacctgctgctggaggtgaagaagctgctgaacgccatcaacaccctgcccaagggcgtggtgccccacatcaagaagttcctgcaggaggacttcagcttccagaccatgcagagagaggtggccgccaacagccagaacggcgaggagatcgtgcccgccctgaccctgagattcctgatcacccagctggaggccgccctgagaaacatccaggccggcaactacaccgcccaccagatcaacatcggctactacctgaccctgctgttcctgtacggcgtggccctgaccgagagaggcaagaaggaggactacaccgaggccgagaacaagttcctggtgatgaagatgatgatccaggagaacgagatctgcgagaacttcatgagcctggtgtacttcggcagaggcctgctgagatgcgcccagaagagatacaacggcggcctgctggagttccacaagagcctgcaggagatcggcgacaagaacgaccactggttcgacatcgaccccaccgaggacgaggacctgcccaccaccttcaaggacctgctgaacaacttcatcaagaccaccgagagcaacatcatgaagcagaccatctgcagctacctggactgcgagagaagctgcgaggccgacatcctgaagaacaccagctacaagggcttcttccagctgatgtgcagcaagagctgctgcgtgtacttccacaagatctgctggaagaagttcaagaacctgaagtaccccggcgagaacgaccagagcttcagcggcaagaagtgcctgaaggagggctgcaccggcgacatggtgagaatgctgcagtgcgacgtgcccggcatcgtgaagatcctgttcgaggtggtgagaaaggacgagtacatcaccatcgagaacctgggcgccagctacagaaagctgatcagcctgaagatcaccgacaccgacatcagacccaagatcagcctgaagttcaacaccaaggacgagatgcccatcttcaagctggactacaactacttctaccacctgctgcacatcatcatcatcagcggcaccgacatcgtgagacagatcttcgacgaggccatgcccccccccctgctgaagaaggagctgctgatccacaagaacgtgctggagagctactacaaccacctgtggaccaaccaccccctgggcggcagctggcacctgctgtacccccccaacaaggagctgccccagagcaagcagttcgacctgtgcctgctgctggccctgatcaagcacctgaacgtgttccccgcccccaagaagggctggaacatggagccccccagcagcgacatcagcaagagcgccgacatcctgagactgtgcaagtacagagacatcctgctgagcgagatcctgatgaacggcctgaccgagagccagttcaacagcatctggaagaaggtgagcgacatcctgctgagactgggcatgatgcaggaggacatcgacaaggtgaaggagaaccccatcgagaacatcagcctggactaccaccagctgagcgtgtacctgggcatccccgtgcccgagatcatccagagaatgctgagctgctaccagcagggcatcgccctgcagagcatcaccggcagccagagaatcgagatcgaggagctgcagaacgaggaggaggagctgagcccccccctgatggagtacaacatcaacgtgaagagccaccccgagatccagttcgccgagatcaacaaggacggcaccagcatccccagcgagagcagcaccgagagcctgaaggacctgcaggaggtgaagagcaagcagagaaagaagaagaagaccaagaacaagaagaacaaggacagcaaggaggaccaggtgccctacgtggtggagaaggaggagcagctgagaaaggagcaggccaacccccacagcgtgagcagactgatcaaggacgacgccagcgacgtgcaggaggacagcgccatggaggacaagttctacagcctggacgagctgcacatcctggacatgatcgagcagggcagcgccggcaaggtgaccaccgactacggcgagaccgagaaggagagactggccagacagagacagctgtacaagctgcactaccagtgcgaggacttcaagagacagctgagaaccgtgaccttcagatggcaggagaaccagatgcagatcaagaagaaggacaagatcatcgccagcctgaaccagcaggtggccttcggcatcaacaaggtgagcaagctgcagagacagatccacgccaaggacaacgagatcaagaacctgaaggagcagctgagcatgaagagaagccagtgggagatggagaagcacaacctggagagcaccatgaagacctacgtgagcaagctgaacgccgagaccagcagagccctgaccgccgaggtgtacttcctgcagtgcagaagagacttcggcctgctgcacctggagcagaccgagaaggagtgcctgaaccagctggccagagtgacccacatggccgccagcaacctggagagcctgcagctgaaggccgccgtggacagctggaacgccatcgtggccgacgtgagaaacaagatcgccttcctgagaacccagtacaacgagcagatcaacaaggtgaagcagggcttcgccctgagcaccctgccccccgtgcagctgcccccccccccccccagccccgagatcctgatgcagcagttcctgggcagacccctggtgaaggagagcttcttcagacccatcctgaccgtgccccagatgcccgccgtgtgccccggcgtggtgagcgccaccggccagcccagagcccccctgatgaccggcatcgcctgggccctgcccgcccccgtgggcgacgccgtgccccccagcgccggcctgagaagcgaccccagcatcatgaactgggagagaatcaccgacagactgaagaccgccttcccccagcagaccagaaaggagctgaccgacttcctgagaaagctgaaggacgcctacggcaagagcctgagcgagctgaccttcgacgagatcgtgtgcaagatcagccagttcatcgaccccaagaagagccagagccagggcaagagcgtgagcaacgtgaactgcgtgagccccagccacagccccagccagcccgacgccgcccagccccccaagcccgcctggagacccctgaccagccagggccccgccacctgggagggcgccagcaaccccgacgaggaggaggaggaggaggagccctgcgtgatctgccacgagaacctgagccccgagaacctgagcgtgctgccctgcgcccacaagttccacgcccagtgcatcagaccctggctgatgcagcagggcacctgccccacctgcagactgcacgtgctgctgcccgaggagttccccggccaccccagcagacagctgcccaagatctag

SEQ ID NO: 10568 - DNA, 996 bp, Artificial Sequence
  Description of Artificial Sequence: Synthetic coding sequence
atgagcagacagctgagcagagccagacccgccaccgtgctgggcgccatggagatgggcagaagaatggacgcccccaccagcgccgccgtgaccagagccttcctggagagaggccacaccgagatcgacaccgccttcgtgtacagcgagggccagagcgagaccatcctgggcggcctgggcctgagactgggcggcagcgactgcagagtgaagatcgacaccaaggccatccccctgttcggcaacagcctgaagcccgacagcctgagattccagctggagaccagcctgaagagactgcagtgccccagagtggacctgttctacctgcacatgcccgaccacagcacccccgtggaggagaccctgagagcctgccaccagctgcaccaggagggcaagttcgtggagctgggcctgagcaactacgccgcctgggaggtggccgagatctgcaccctgtgcaagagcaacggctggatcctgcccaccgtgtaccagggcatgtacaacgccatcaccagacaggtggagaccgagctgttcccctgcctgagacacttcggcctgagattctacgccttcaaccccctggccggcggcctgctgaccggcaagtacaagtacgaggacaagaacggcaagcagcccgtgggcagattcttcggcaacacctgggccgagatgtacagaaacagatactggaaggagcaccacttcgagggcatcgccctggtggagaaggccctgcaggccgcctacggcgccagcgcccccagcatgaccagcgccaccctgagatggatgtaccaccacagccagctgcagggcgcccacggcgacgccgtgatcctgggcatgagcagcctggagcagctggagcagaacctggccgccgccgaggagggccccctggagcccgccgtggtggacgccttcaaccaggcctggcacctggtgacccacgagtgccccaactacttcagatag

SEQ ID NO: 10569 - DNA, 1131 bp, Artificial Sequence
  Description of Artificial Sequence: Synthetic coding sequence
atgagccccgaggtggccctgaacagaatcagccccatgctgagccccttcatcagcagcgtggtgagaaacggcaaggtgggcctggacgccaccaactgcctgagaatcaccgacctgaagagcggctgcaccagcctgacccccggccccaactgcgacagattcaagctgcacatcccctacgccggcgagaccctgaagtgggacatcatcttcaacgcccagtaccccgagctgccccccgacttcatcttcggcgaggacgccgagttcctgcccgaccccagcgccctgcagaacctggccagctggaaccccagcaaccccgagtgcctgctgctggtggtgaaggagctggtgcagcagtaccaccagttccagtgcagcagactgagagagagcagcagactgatgttcgagtaccagaccctgctggaggagccccagtacggcgagaacatggagatctacgccggcaagaagaacaactggaccggcgagttcagcgccagattcctgctgaagctgcccgtggacttcagcaacatccccacctacctgctgaaggacgtgaacgaggaccccggcgaggacgtggccctgctgagcgtgagcttcgaggacaccgaggccacccaggtgtaccccaagctgtacctgagccccagaatcgagcacgccctgggcggcagcagcgccctgcacatccccgccttccccggcggcggctgcctgatcgactacgtgccccaggtgtgccacctgctgaccaacaaggtgcagtacgtgatccagggctaccacaagagaagagagtacatcgccgccttcctgagccacttcggcaccggcgtggtggagtacgacgccgagggcttcaccaagctgaccctgctgctgatgtggaaggacttctgcttcctggtgcacatcgacctgcccctgttcttccccagagaccagcccaccctgaccttccagagcgtgtaccacttcaccaacagcggccagctgtacagccaggcccagaagaactacccctacagccccagatgggacggcaacgagatggccaagagagccaagagagagagcaacagagacggcgaggagagcagcagcgcctag

SEQ ID NO: 10570 - DNA, 1881 bp, Artificial Sequence
  Description of Artificial Sequence: Synthetic coding sequence
atggacgagcaggaggccctgaacagcatcatgaacgacctggtggccctgcagatgaacagaagacacagaatgcccggctacgagaccatgaagaacaaggacaccggccacagcaacagacagagcgacgtgagaatcaagttcgagcacaacggcgagagaagaatcatcgccttcagcagacccgtgaagtacgaggacgtggagcacaaggtgaccaccgtgttcggccagcccctggacctgcactacatgaacaacgagctgagcatcctgctgaagaaccaggacgacctggacaaggccatcgacatcctggacagaagcagcagcatgaagagcctgagaatcctgctgctgagccaggacagaaaccacaacagcagcagcccccacagcggcgtgagcagacaggtgagaatcaaggccagccagagcgccggcgacatcaacaccatctaccagccccccgagcccagaagcagacacctgagcgtgagcagccagaaccccggcagaagcagccccccccccggctacgtgcccgagagacagcagcacatcgccagacagggcagctacaccagcatcaacagcgagggcgagttcatccccgagaccagcgagcagtgcatgctggaccccctgagcagcgccgagaacagcctgagcggcagctgccagagcctggacagaagcgccgacagccccagcttcagaaagagcagaatgagcagagcccagagcttccccgacaacagacaggagtacagcgacagagagacccagctgtacgacaagggcgtgaagggcggcacctaccccagaagataccacgtgagcgtgcaccacaaggactacagcgacggcagaagaaccttccccagaatcagaagacaccagggcaacctgttcaccctggtgcccagcagcagaagcctgagcaccaacggcgagaacatgggcctggccgtgcagtacctggaccccagaggcagactgagaagcgccgacagcgagaacgccctgagcgtgcaggagagaaacgtgcccaccaagagccccagcgcccccatcaactggagaagaggcaagctgctgggccagggcgccttcggcagagtgtacctgtgctacgacgtggacaccggcagagagctggccagcaagcaggtgcagttcgaccccgacagccccgagaccagcaaggaggtgagcgccctggagtgcgagatccagctgctgaagaacctgcagcacgagagaatcgtgcagtactacggctgcctgagagacagagccgagaagaccctgaccatcttcatggagtacatgcccggcggcagcgtgaaggaccagctgaaggcctacggcgccctgaccgagagcgtgaccagaaagtacaccagacagatcctggagggcatgagctacctgcacagcaacatgatcgtgcacagagacatcaagggcgccaacatcctgagagacagcgccggcaacgtgaagctgggcgacttcggcgccagcaagagactgcagaccatctgcatgagcggcaccggcatgagaagcgtgaccggcaccccctactggatgagccccgaggtgatcagcggcgagggctacggcagaaaggccgacgtgtggagcctgggctgcaccgtggtggagatgctgaccgagaagcccccctgggccgagtacgaggccatggccgccatcttcaagatcgccacccagcccaccaacccccagctgcccagccacatcagcgagcacggcagagacttcctgagaagaatcttcgtggaggccagacagagacccagcgccgaggagctgctgacccaccacttcgcccagctgatgtactag

SEQ ID NO: 10571 - DNA, 1701 bp, Artificial Sequence; identical to SEQ ID NO: 10391
  Description of Artificial Sequence: Synthetic coding sequence

SEQ ID NO: 10572 - DNA, 456 bp, Artificial Sequence
  Description of Artificial Sequence: Synthetic coding sequence
atggagggctgcgtgagcaacctgatggtgtgcaacctggcctacagcggcaagctggaggagctgaaggagagcatcctggccgacaagagcctggccaccagaaccgaccaggacagcagaaccgccctgcactgggcctgcagcgccggccacaccgagatcgtggagttcctgctgcagctgggcgtgcccgtgaacgacaaggacgacgccggctggagccccctgcacatcgccgccagcgccggcagagacgagatcgtgaaggccctgctgggcaagggcgcccaggtgaacgccgtgaaccagaacggctgcacccccctgcactacgccgccagcaagaacagacacgagatcgccgtgatgctgctggagggcggcgccaaccccgacgccaaggaccactacgaggccaccgccatgcacagagccgccgccaaggacacctag

SEQ ID NO: 10573 - DNA, 2220 bp, Artificial Sequence; identical to SEQ ID NO: 10489
  Description of Artificial Sequence: Synthetic coding sequence

SEQ ID NO: 10574 - DNA, 1692 bp, Artificial Sequence
  Description of Artificial Sequence: Synthetic coding sequence
atgagcagacccagcagcagagccatctacctgcacagaaaggagtacagccagaacctgaccagcgagcccaccctgctgcagcacagagtggagcacctgatgacctgcaagcagggcagccagagagtgcagggccccgaggacgccctgcagaagctgttcgagatggacgcccagggcagagtgtggagccaggacctgatcctgcaggtgagagacggctggctgcagctgctggacatcgagaccaaggaggagctggacagctacagactggacagcatccaggccatgaacgtggccctgaacacctgcagctacaacagcatcctgagcatcaccgtgcaggagcccggcctgcccggcaccagcaccctgctgttccagtgccaggaggtgggcgccgagagactgaagaccagcctgcagaaggccctggaggaggagctggagcagagacccagactgggcggcctgcagcccggccaggacagatggagaggccccgccatggagagacccctgcccatggagcaggccagatacctggagcccggcatcccccccgagcagccccaccagagaaccctggagcacagcctgccccccagccccagacccctgcccagacacaccagcgccagagagcccagcgccttcaccctgcccccccccagaagaagcagcagccccgaggaccccgagagagacgaggaggtgctgaaccacgtgctgagagacatcgagctgttcatgggcaagctggagaaggcccaggccaagaccagcagaaagaagaagttcggcaagaagaacaaggaccagggcggcctgacccaggcccagtacatcgactgcttccagaagatcaagcacagcttcaacctgctgggcagactggccacctggctgaaggagaccagcgcccccgagctggtgcacatcctgttcaagagcctgaacttcatcctggccagatgccccgaggccggcctggccgcccaggtgatcagccccctgctgacccccaaggccatcaacctgctgcagagctgcctgagcccccccgagagcaacctgtggatgggcctgggccccgcctggaccaccagcagagccgactggaccggcgacgagcccctgccctaccagcccaccttcagcgacgactggcagctgcccgagcccagcagccaggcccccctgggctaccaggaccccgtgagcctgagacccagcagccccaagcccgcccagcccgccctgaagatgcaggtgctgtacgagttcgaggccagaaaccccagagagctgaccgtggtgcagggcgagaagctggaggtgctggaccacagcaagagatggtggctggtgaagaacgaggccggcagaagcggctacatccccagcaacatcctggagcccctgcagcccggcacccccggcacccagggccagagccccagcagagtgcccatgctgagactgagcagcagacccgaggaggtgaccgactggctgcaggccgagaacttcagcaccgccaccgtgagaaccctgggcagcctgaccggcagccagctgctgagaatcagacccggcgagctgcagatgctgtgcccccaggaggcccccagaatcctgagcagactggaggccgtgagaagaatgctgggcatcagcccctag

SEQ ID NO: 10575 - DNA, 525 bp, Artificial Sequence
  Description of Artificial Sequence: Synthetic coding sequence
atgacctgctgccagaccagcttctgcggctaccccagcttcagcatcagcggcacctgcggcagcagctgctgccagcccagctgctgcgagaccagctgctgccagcccagaagctgccagaccagcttctgcggcttccccagcttcagcaccagcggcacctgcagcagcagctgctgccagcccagctgctgcgagaccagctgctgccagcccagctgctgcgagaccagctgctgccagcccagctgctgccagatcagcagctgcggcaccggctgcggcatcggcggcggcatcagctacggccaggagggcagcagcggcgccgtgagcaccagaatcagatggtgcagacccgacagcagagtggagggcacctacctgcccccctgctgcgtggtgagctgcaccccccccagctgctgccagctgcaccacgcccaggccagctgctgcagacccagctactgcggccagagctgctgcagacccgtgtgctgctgcgagcccacctgctag

SEQ ID NO: 10576 - DNA, 1173 bp, Artificial Sequence
  Description of Artificial Sequence: Synthetic coding sequence
atgagaggcgacagaggcagaggcagaggcggcagattcggcagcagaggcggccccggcggcggcttcagacccttcgtgccccacatccccttcgacttctacctgtgcgagatggccttccccagagtgaagcccgcccccgacgagaccagcttcagcgaggccctgctgaagagaaaccaggacctggcccccaacagcgccgagcaggccagcatcctgagcctggtgaccaagatcaacaacgtgatcgacaacctgatcgtggcccccggcaccttcgaggtgcagatcgaggaggtgagacaggtgggcagctacaagaagggcaccatgaccaccggccacaacgtggccgacctggtggtgatcctgaagatcctgcccaccctggaggccgtggccgccctgggcaacaaggtggtggagagcctgagagcccaggaccccagcgaggtgctgaccatgctgaccaacgagaccggcttcgagatcagcagcagcgacgccaccgtgaagatcctgatcaccaccgtgccccccaacctgagaaagctggaccccgagctgcacctggacatcaaggtgctgcagagcgccctggccgccatcagacacgccagatggttcgaggagaacgccagccagagcaccgtgaaggtgctgatcagactgctgaaggacctgagaatcagattccccggcttcgagcccctgaccccctggatcctggacctgctgggccactacgccgtgatgaacaaccccaccagacagcccctggccctgaacgtggcctacagaagatgcctgcagatcctggccgccggcctgttcctgcccggcagcgtgggcatcaccgacccctgcgagagcggcaacttcagagtgcacaccgtgatgaccctggagcagcaggacatggtgtgctacaccgcccagaccctggtgagaatcctgagccacggcggcttcagaaagatcctgggccaggagggcgacgccagctacctggccagcgagatcagcacctgggacggcgtgatcgtgacccccagcgagaaggcctacgagaagccccccgagaagaaggagggcgaggaggaggaggagaacaccgaggagcccccccagggcgaggaggaggagagcatggagacccaggagtag

SEQ ID NO: 10577 - DNA, 3606 bp, Artificial Sequence
  Description of Artificial Sequence: Synthetic coding sequence
atgcccagaggcgaggcccccggccccggcagaagaggcgccaaggacgaggccctgggcgaggagagcggcgagagatggagccccgagttccacctgcagagaaagctggccgacagcagccacagcgagcagcaggacagaaacagagtgagcgaggagctgatcatggtggtgcaggagatgaagaagtacttccccagcgagagaagaaacaagcccagcaccctggacgccctgaactacgccctgagatgcgtgcacagcgtgcaggccaacagcgagttcttccagatcctgagccagaacggcgccccccaggccgacgtgagcatgtacagcctggaggagctggccaccatcgccagcgagcacaccagcaagaacaccgacaccttcgtggccgtgttcagcttcctgagcggcagactggtgcacatcagcgagcaggccgccctgatcctgaacagaaagaaggacgtgctggccagcagccacttcgtggacctgctggccccccaggacatgagagtgttctacgcccacaccgccagagcccagctgcccttctggaacaactggacccagagagccgccagatacgagtgcgcccccgtgaagcccttcttctgcagaatcagaggcggcgaggacagaaagcaggagaagtgccacagccccttcagaatcatcccctacctgatccacgtgcaccaccccgcccagcccgagctggagagcgagccctgctgcctgaccgtggtggagaagatccacagcggctacgaggcccccagaatccccgtgaacaagagaatcttcaccaccacccacacccccggctgcgtgttcctggaggtggacgagaaggccgtgcccctgctgggctacctgccccaggacctgatcggcaccagcatcctgagctacctgcaccccgaggacagaagcctgatggtggccatccaccagaaggtgctgaagtacgccggccacccccccttcgagcacagccccatcagattctgcacccagaacggcgactacatcatcctggacagcagctggagcagcttcgtgaacccctggagcagaaagatcagcttcatcatcggcagacacaaggtgagaaccagccccctgaacgaggacgtgttcgccaccaagatcaagaagatgaacgacaacgacaaggacatcaccgagctgcaggagcagatctacaagctgctgctgcagcccgtgcacgtgagcgtgagcagcggctacggcagcctgggcagcagcggcagccaggagcagctggtgagcatcgccagcagcagcgaggccagcggccacagagtggaggagaccaaggccgagcagatgaccctgcagcaggtgtacgccagcgtgaacaagatcaagaacctgggccagcagctgtacatcgagagcatgaccaagagcagcttcaagcccgtgaccggcaccagaaccgagcccaacggcggcggcgagtgcaagaccttcaccagcttccaccagaccctgaagaacaacagcgtgtacaccgagccctgcgaggacctgagaaacgacgagcacagccccagctaccagcagatcaactgcatcgacagcgtgatcagatacctgaagagctacaacatccccgccctgaagagaaagtgcatcagctgcaccaacaccaccagcagcagcagcgaggaggacaagcagaaccacaaggccgacgacgtgcaggccctgcaggccggcctgcagatccccgccatccccaagagcgagatgcccaccaacggcagaagcatcgacaccggcggcggcgccccccagatcctgagcaccgccatgctgagcctgggcagcggcatcagccagtgcggctacagcagcaccatcgtgcacgtgcccccccccgagaccgccagagacgccaccctgttctgcgagccctggaccctgaacatgcagcccgcccccctgaccagcgaggagttcaagcacgtgggcctgaccgccgccgtgctgagcgcccacacccagaaggaggagcagaactacgtggacaagttcagagagaagatcctgagcagcccctacagcagctacctgcagcaggagagcagaagcaaggccaagtacagctacttccagggcgacagcaccagcaagcagaccagaagcgccggctgcagaaagggcaagcacaagagaaagaagctgcccgagccccccgacagcagcagcagcaacaccggcagcggccccagaagaggcgcccaccagaacgcccagccctgctgccccagcgccgccagcagcccccacaccagcagccccaccttcccccccgccgccatggtgcccagccaggccccctacctggtgcccgccttccccctgcccgccgccaccagccccggcagagagtacgccgcccccggcaccgcccccgagggcctgcacggcctgcccctgagcgagggcctgcagccctaccccgccttccccttcccctacctggacaccttcatgaccgtgttcctgcccgacccccccgtgtgccccctgctgagccccagcttcctgccctgccccttcctgggcgccaccgccagcagcgccatcagccccagcatgagcagcgccatgagccccaccctggaccccccccccagcgtgaccagccagagaagagaggaggagaagtgggaggcccagagcgagggccaccccttcatcaccagcagaagcagcagccccctgcagctgaacctgctgcaggaggagatgcccagacccagcgagagccccgaccagatgagaagaaacacctgcccccagaccgagtactgcgtgaccggcaacaacggcagcgagagcagccccgccaccaccggcgccctgagcaccggcagcccccccagagagaaccccagccaccccaccgccagcgccctgagcaccggcagcccccccatgaagaaccccagccaccccaccgccagcgccctgagcaccggcagcccccccatgaagaaccccagccaccccaccgccagcaccctgagcatgggcctgccccccagcagaacccccagccaccccaccgccaccgtgctgagcaccggcagcccccccagcgagagccccagcagaaccggcagcgccgccagcggcagcagcgacagcagcatctacctgaccagcagcgtgtacagcagcaagatcagccagaacggccagcagagccaggacgtgcagaagaaggagaccttccccaacgtggccgaggagcccatctggagaatgatcagacagacccccgagagaatcctgatgacctaccaggtgcccgagagagtgaaggaggtggtgctgaaggaggacctggagaagctggagagcatgagacagcagcagccccagttcagccacggccagaaggaggagctggccaaggtgtacaactggatccagagccagaccgtgacccaggagatcgacatccaggcctgcgtgacctgcgagaacgaggacagcgccgacggcgccgccaccagctgcggccaggtgctggtggaggacagctgctag

SEQ ID NO: 10578 - DNA, 1296 bp, Artificial Sequence
  Description of Artificial Sequence: Synthetic coding sequence
atgagcgaccagatcaagttcatcatggacagcctgaacaaggagcccttcagaaagaactacaacctgatcaccttcgacagcctggagcccatgcagctgctgcaggtgctgagcgacgtgctggccgagatcgaccccaagcagctggtggacatcagagaggagatgcccgagcagaccgccaagagaatgctgagcctgctgggcatcctgaagtacaagcccagcggcaacgccaccgacatgagcaccttcagacagggcctggtgatcggcagcaagcccgtgatctaccccgtgctgcactggctgctgcagagaaccaacgagctgaagaagagagcctacctggccagattcctgatcaagctggaggtgcccagcgagttcctgcaggacgagaccgtggccgacaccaacaagcagtacgaggagctgatggaggccttcaagaccctgcacaaggagtacgagcagctgaagatcagcggcttcagcaccgccgagatcagaaaggacatcagcgccatggaggaggagaaggaccagctgatcaagagagtggagcacctgaagaagagagtggagaccgcccagaaccaccagtggatgctgaagatcgccagacagctgagagtggagaaggagagagaggagtacctggcccagcagaagcaggagcagaagaaccagctgttccacgccgtgcagagactgcagagagtgcagaaccagctgaagagcatgagacaggccgccgccgacgccaagcccgagagcctgatgaagagactggaggaggagatcaagttcaacctgtacatggtgaccgagaagttccccaaggagctggagaacaagaagaaggagctgcacttcctgcagaaggtggtgagcgagcccgccatgggccacagcgacctgctggagctggagagcaagatcaacgagatcaacaccgagatcaaccagctgatcgagaagaagatgatgagaaacgagcccatcgagggcaagctgagcctgtacagacagcaggccagcatcatcagcagaaagaaggaggccaaggccgaggagctgcaggaggccaaggagaagctggccagcctggagagagaggccagcgtgaagagaaaccagaccagagagttcgacggcaccgaggtgctgaagggcgacgagagacaggacctgaccctgagccccagactggagtgcggcggcgtgatcatggcctactgcagcctgaagctgctgggcagcagcgacccccccaccagcgccagctag

SEQ ID NO: 10579 - DNA, 1119 bp, Artificial Sequence
  Description of Artificial Sequence: Synthetic coding sequence
atggccagcagcgccagcgccagaacccccgccggcaagagagtgatcaaccaggaggagctgagaagactgatgaaggagaagcagagactgagcaccagcagaaagagaatcgagagccccttcgccaagtacaacagactgggccagctgagctgcgccctgtgcaacacccccgtgaagagcgagctgctgtggcagacccacgtgctgggcaagcagcacagagagaaggtggccgagctgaagggcgccaaggaggccagccagggcagcagcgccagcagcgccccccacagcgtgaagagaaaggcccccgacgccgacgaccaggacgtgaagagagccaaggccaccctggtgccccaggtgcagcccagcaccagcgcctggaccaccaacttcgacaagatcggcaaggagttcatcagagccacccccagcaagcccagcggcctgagcctgctgcccgactacgaggacgaggaggaggaggaggaggaggaggagggcgacggcgagagaaagagaggcgacgccagcaagcccctgagcgacgcccagggcaaggagcacagcgtgagcagcagcagagaggtgaccagcagcgtgctgcccaacgacttcttcagcaccaacccccccaaggcccccatcatcccccacagcggcagcatcgagaaggccgagatccacgagaaggtggtggagagaagagagaacaccgccgaggccctgcccgagggcttcttcgacgaccccgaggtggacgccagagtgagaaaggtggacgcccccaaggaccagatggacaaggagtgggacgagttccagaaggccatgagacaggtgaacaccatcagcgaggccatcgtggccgaggaggacgaggagggcagactggacagacagatcggcgagatcgacgagcagatcgagtgctacagaagagtggagaagctgagaaacagacaggacgagatcaagaacaagctgaaggagatcctgaccatcaaggagctgcagaagaaggaggaggagaacgccgacagcgacgacgagggcgagctgcaggacctgctgagccaggactggagagtgaagggcgccctgctgtag

SEQ ID NO: 10580 - DNA, 1782 bp, Artificial Sequence
  Description of Artificial Sequence: Synthetic coding sequence
atgagcagacccagcagcagagccatctacctgcacagaaaggagtacagccagaacctgaccagcgagcccaccctgctgcagcacagagtggagcacctgatgacctgcaagcagggcagccagagagtgcagggccccgaggacgccctgcagaagctgttcgagatggacgcccagggcagagtgtggagccaggacctgatcctgcaggtgagagacggctggctgcagctgctggacatcgagaccaaggaggagctggacagctacagactggacagcatccaggccatgaacgtggccctgaacacctgcagctacaacagcatcctgagcatcaccgtgcaggagcccggcctgcccggcaccagcaccctgctgttccagtgccaggaggtgggcgccgagagactgaagaccagcctgcagaaggccctggaggaggagctggagcagagacccagactgggcggcctgcagcccggccaggacagatggagaggccccgccatggagagacccctgcccatggagcaggccagatacctggagcccggcatcccccccgagcagccccaccagagaaccctggagcacagcctgccccccagccccagacccctgcccagacacaccagcgccagagagcccagcgccttcaccctgcccccccccagaagaagcagcagccccgaggaccccgagagagacgaggaggtgctgaaccacgtgctgagagacatcgagctgttcatgggcaagctggagaaggcccaggccaagaccagcagaaagaagaagttcggcaagaagaacaaggaccagggcggcctgacccaggcccagtacatcgactgcttccagaagatcaagcacagcttcaacctgctgggcagactggccacctggctgaaggagaccagcgcccccgagctggtgcacatcctgttcaagagcctgaacttcatcctggccagatgccccgaggccggcctggccgcccaggtgatcagccccctgctgacccccaaggccatcaacctgctgcagagctgcctgagcccccccgagagcaacctgtggatgggcctgggccccgcctggaccaccagcagagccgactggaccggcgacgagcccctgccctaccagcccaccttcagcgacgactggcagctgcccgagcccagcagccaggcccccctgggctaccaggaccccgtgagcctgagaagaggcagccacagactgggcagcaccagccacttcccccaggagaagacccacaaccacgacccccagcccggcgaccccaacagcagacccagcagccccaagcccgcccagcccgccctgaagatgcaggtgctgtacgagttcgaggccagaaaccccagagagctgaccgtggtgcagggcgagaagctggaggtgctggaccacagcaagagatggtggctggtgaagaacgaggccggcagaagcggctacatccccagcaacatcctggagcccctgcagcccggcacccccggcacccagggccagagccccagcagagtgcccatgctgagactgagcagcagacccgaggaggtgaccgactggctgcaggccgagaacttcagcaccgccaccgtgagaaccctgggcagcctgaccggcagccagctgctgagaatcagacccggcgagctgcagatgctgtgcccccaggaggcccccagaatcctgagcagactggaggccgtgagaagaatgctgggcatcagcccctag

SEQ ID NO: 10581 - DNA, 1050 bp, Artificial Sequence
  Description of Artificial Sequence: Synthetic coding sequence
atgaagctgaccagcgagaagctgcccaagaaccccttctacgccagcgtgagccagtacgccgccaagaaccagaagttcttccagtggaagaaggagaagaccgagagcgactacacccacgccaacctggtggacaaggccctgcagctgctgaaggagagaatcctgaagggcgacaccctggcctacttcctgagaggccagctgtacttcgaggagggctggtacgaggaggccctggagcagttcgaggagatcaaggagaaggaccaccaggccacctaccagctgggcgtgatgtactacgacggcctgggcaccaccctggacgccgagaagggcgtggactacatgaagaagatcctggacagcccctgccccaaggccagacacctgaagttcgccgccgcctacaacctgggcagagcctactacgagggcaagggcgtgaagagaagcaacgaggaggccgagagactgtggctgatcgccgccgacaacggcaaccccaaggccagcgtgaaggcccagagcatgctgggcctgtactacagcaccaaggagcccaaggagctggagaaggccttctactggcacagcgaggcctgcggcaacggcaacctggagagccagggcgccctgggcctgatgtacctgtacggccagggcatcagacaggacaccgaggccgccctgcagtgcctgagagaggccgccgagagaggcaacgtgtacgcccagggcaacctggtggagtactactacaagatgaagttcttcaccaagtgcgtggccttcagcaagagaatcgccgactacgacgaggtgcacgacatccccatgatcgcccaggtgaccgactgcctgcccgagttcatcggcagaggcatggccatggccagcttctaccacgccagatgcctgcagctgggcctgggcatcaccagagacgagaccaccgccaagcactactacagcaaggcctgcagactgaaccccgccctggccgacgagctgcacagcctgctgatcagacagagaatctag

SEQ ID NO: 10582 - DNA, 1236 bp, Artificial Sequence
  Description of Artificial Sequence: Synthetic coding sequence
atgggcctgaagaagatgaagggcctgagctacgacgaggccttcgccatggccaacgaccccctggagggcttccacgaggtgaacctggccagccccaccagccccgacctgctgggcgtgtacgagagcggcacccaggagcagaccaccagccccagcgtgatctacagaccccaccccagcgccctgagcagcgtgcccatccaggccaacgccctggacgtgagcgagctgcccacccagcccgtgtacagcagccccagaagactgaactgcgccgagatcagcagcatcagcttccacgtgaccgaccccgccccctgcagcaccagcggcgtgaccgccggcctgaccaagctgaccaccagaaaggacaactacaacgccgagagagagttcctgcagggcgccaccatcaccgaggcctgcgacggcagcgacgacatcttcggcctgagcaccgacagcctgagcagactgagaagccccagcgtgctggaggtgagagagaagggctacgagagactgaaggaggagctggccaaggcccagagagagctgaagctgaaggacgaggagtgcgagagactgagcaaggtgagagaccagctgggccaggagctggaggagctgaccgccagcctgttcgaggaggcccacaagatggtgagagaggccaacatcaagcaggccaccgccgagaagcagctgaaggaggcccagggcaagatcgacgtgctgcaggccgaggtggccgccctgaagaccctggtgctgagcagcagccccaccagccccacccaggagcccctgcccggcggcaagacccccttcaagaagggccacaccagaaacaagagcaccagcagcgccatgagcggcagccaccaggacctgagcgtgatccagcccatcgtgaaggactgcaaggaggccgacctgagcctgtacaacgagttcagactgtggaaggacgagcccaccatggacagaacctgccccttcctggacaagatctaccaggaggacatcttcccctgcctgaccttcagcaagagcgagctggccagcgccgtgctggaggccgtggagaacaacaccctgagcatcgagcccgtgggcctgcagcccatcagattcgtgaaggccagcgccgtggagtgcggcggccccaagagcctgctgtacgtgaccttcctgcacaccttcgacaccttcagcagagacagctag

SEQ ID NO: 10583 - DNA, 2148 bp, Artificial Sequence
  Description of Artificial Sequence: Synthetic coding sequence
atgttcggcagaaagagaagcgtgagcttcggcggcttcggctggatcgacaagaccatgctggccagcctgaaggtgaagaagcaggagctggccaacagcagcgacgccaccctgcccgacagacccctgagcccccccctgaccgccccccccaccatgaagagcagcgagttcttcgagatgctggagaagatgcaggacgactacatcccctaccccagcatcgacgaggtggtggagaagggcggcccctacccccaggtgatcctgccccagttcggcggctactggatcgaggaccccgagaacgtgggcacccccaccagcctgggcagcagcatctgcgaggaggaggaggaggacaacctgagccccaacaccttcggctacaagctggagtgcaagggcgaggccagagcctacagaagacacttcctgggcaaggaccacctgaacttctactgcaccggcagcagcctgggcaacctgatcctgagcgtgaagtgcgaggaggccgagggcatcgagtacctgagagtgatcctgagaagcaagctgaagaccgtgcacgagagaatccccctggccggcctgagcaagctgcccagcgtgccccagatcgccaaggccttctgcgacgacgccgtgggcctgagattcaaccccgtgctgtaccccaaggccagccagatgatcgtgagctacgacgagcacgaggtgaacaacaccttcaagttcggcgtgatctaccagaaggccagacagaccctggaggaggagctgttcggcaacaacgaggagagccccgccttcaaggagttcctggacctgctgggcgacaccatcaccctgcaggacttcaagggcttcagaggcggcctggacgtgacccacggccagaccggcgtggagagcgtgtacaccaccttcagagacagagagatcatgttccacgtgagcaccaagctgcccttcaccgacggcgacgcccagcagctgcagagaaagagacacatcggcaacgacatcgtggccatcatcttccaggaggagaacacccccttcgtgcccgacatgatcgccagcaacttcctgcacgcctacatcgtggtgcaggtggagacccccggcaccgagacccccagctacaaggtgagcgtgaccgccagagaggacgtgcccaccttcggcccccccctgcccagcccccccgtgttccagaagggccccgagttcagagagttcctgctgaccaagctgaccaacgccgagaacgcctgctgcaagagcgacaagttcgccaagctggaggacagaaccagagccgccctgctggacaacctgcacgacgagctgcacgcccacacccaggccatgctgggcctgggccccgaggaggacaagttcgagaacggcggccacggcggcttcctggagagcttcaagagagccatcagagtgagaagccacagcatggagaccatggtgggcggccagaagaagagccacagcggcggcatccccggcagcctgagcggcggcatcagccacaacagcatggaggtgaccaagaccaccttcagcccccccgtggtggccgccaccgtgaagaaccagagcagaagccccatcaagagaagaagcggcctgttccccagactgcacaccggcagcgagggccagggcgacagcagagccagatgcgacagcaccagcagcacccccaagacccccgacggcggccacagcagccaggagatcaagagcgagaccagcagcaaccccagcagccccgagatctgccccaacaaggagaagcccttcatgaagctgaaggagaacggcagagccatcagcagaagcagcagcagcaccagcagcgtgagcagcaccgccggcgagggcgaggccatggaggagggcgacagcggcggcagccagcccagcaccaccagccccttcaagcaggaggtgttcgtgtacagccccagccccagcagcgagagccccagcctgggcgccgccgccacccccatcatcatgagcagaagccccaccgacgccaagagcagaaacagccccagaagcaacctgaagttcagattcgacaagctgagccacgccagcagcggcgccggccactag

SEQ ID NO: 10584 - DNA, 2271 bp, Artificial Sequence
  Description of Artificial Sequence: Synthetic coding sequence
atggaggaggagctgaagtgccccgtgtgcggcagcctgttcagagagcccatcatcctgccctgcagccacaacgtgtgcctgccctgcgccagaaccatcgccgtgcagacccccgacggcgagcagcacctgccccagcccctgctgctgagcagaggcagcggcctgcaggccggcgccgccgccgccgccagcctggagcacgacgccgccgccggccccgcctgcggcggcgccggcggcagcgccgccggcggcctgggcggcggcgccggcggcggcggcgaccacgccgacaagctgagcctgtacagcgagaccgacagcggctacggcagctacacccccagcctgaagagccccaacggcgtgagagtgctgcccatggtgcccgccccccccggcagcagcgccgccgccgccagaggcgccgcctgcagcagcctgagcagcagcagcagcagcatcacctgcccccagtgccacagaagcgccagcctggaccacagaggcctgagaggcttccagagaaacagactgctggaggccatcgtgcagagataccagcagggcagaggcgccgtgcccggcaccagcgccgccgccgccgtggccatctgccagctgtgcgacagaaccccccccgagcccgccgccaccctgtgcgagcagtgcgacgtgctgtactgcagcgcctgccagctgaagtgccaccccagcagaggccccttcgccaagcacagactggtgcagccccccccccccccccccccccccgccgaggccgccagcggccccaccggcaccgcccagggcgcccccagcggcggcggcggctgcaagagccccggcggcgccggcgccggcgccaccggcggcagcaccgccagaaagttccccacctgccccgagcacgagatggagaactacagcatgtactgcgtgagctgcagaacccccgtgtgctacctgtgcctggaggagggcagacacgccaagcacgaggtgaagcccctgggcgccatgtggaagcagcacaaggcccagctgagccaggccctgaacggcgtgagcgacaaggccaaggaggccaaggagttcctggtgcagctgaagaacatcctgcagcagatccaggagaacggcctggactacgaggcctgcctggtggcccagtgcgacgccctggtggacgccctgaccagacagaaggccaagctgctgaccaaggtgaccaaggagagagagcacaagctgaagatggtgtgggaccagatcaaccactgcaccctgaagctgagacagagcaccggcctgatggagtactgcctggaggtgatcaaggagaacgaccccagcggcttcctgcagatcagcgacgccctgatcaagagagtgcaggtgagccaggagcagtgggtgaagggcgccctggagcccaaggtgagcgccgagttcgacctgaccctggacagcgagcccctgctgcaggccatccaccagctggacttcatccagatgaagtgcagagtgccccccgtgcccctgctgcagctggagaagtgctgcaccagaaacaacagcgtgaccctggcctggagaatgccccccttcacccacagccccgtggacggctacatcctggagctggacgacggcgccggcggccagttcagagaggtgtacgtgggcaaggagaccctgtgcaccatcgacggcctgcacttcaacagcacctacaacgccagagtgaaggccttcaacagcagcggcgtgggcccctacagcaagaccgtggtgctgcagaccagcgacgtggcctggttcaccttcgaccccaacagcggccacagagacatcatcctgagcaacgacaaccagaccgccacctgcagcagctacgacgacagagtggtgctgggcaccgccgccttcagcaagggcgtgcactactgggagctgcacgtggacagatacgacaaccaccccgaccccgccttcggcgtggccagagccagcgtggtgaaggacatgatgctgggcaaggacgacaaggcctgggccatgtacgtggacaacaacagaagctggttcatgcactgcaacagccacaccaacagaaccgagggcggcgtgtgcaagggcgccaccgtgggcgtgctgctggacctgaacaagcacaccctgaccttcttcatcaacggccagcagcagggccccaccgccttcagccacgaggtgcagcccagcgtgaccagcctgttctag

SEQ ID NO: 10585 - DNA, 2352 bp, Artificial Sequence
  Description of Artificial Sequence: Synthetic coding sequence
atggaggaggagctgaagtgccccgtgtgcggcagcctgttcagagagcccatcatcctgccctgcagccacaacgtgtgcctgccctgcgccagaaccatcgccgtgcagacccccgacggcgagcagcacctgccccagcccctgctgctgagcagaggcagcggcctgcaggccggcgccgccgccgccgccagcctggagcacgacgccgccgccggccccgcctgcggcggcgccggcggcagcgccgccggcggcctgggcggcggcgccggcggcggcggcgaccacgccgacaagctgagcctgtacagcgagaccgacagcggctacggcagctacacccccagcctgaagagccccaacggcgtgagagtgctgcccatggtgcccgccccccccggcagcagcgccgccgccgccagaggcgccgcctgcagcagcctgagcagcagcagcagcagcatcacctgcccccagtgccacagaagcgccagcctggaccacagaggcctgagaggcttccagagaaacagactgctggaggccatcgtgcagagataccagcagggcagaggcgccgtgcccggcaccagcgccgccgccgccgtggccatctgccagctgtgcgacagaaccccccccgagcccgccgccaccctgtgcgagcagtgcgacgtgctgtactgcagcgcctgccagctgaagtgccaccccagcagaggccccttcgccaagcacagactggtgcagccccccccccccccccccccccccgccgaggccgccagcggccccaccggcaccgcccagggcgcccccagcggcggcggcggctgcaagagccccggcggcgccggcgccggcgccaccggcggcagcaccgccagaaagttccccacctgccccgagcacgagatggagaactacagcatgtactgcgtgagctgcagaacccccgtgtgctacctgtgcctggaggagggcagacacgccaagcacgaggtgaagcccctgggcgccatgtggaagcagcacaaggcccagctgagccaggccctgaacggcgtgagcgacaaggccaaggaggccaaggagttcctggtgcagctgaagaacatcctgcagcagatccaggagaacggcctggactacgaggcctgcctggtggcccagtgcgacgccctggtggacgccctgaccagacagaaggccaagctgctgaccaaggtgaccaaggagagagagcacaagctgaagatggtgtgggaccagatcaaccactgcaccctgaagctgagacagagcaccggcctgatggagtactgcctggaggtgatcaaggagaacgaccccagcggcttcctgcagatcagcgacgccctgatcaagagagtgcaggtgagccaggagcagtgggtgaagggcgccctggagcccaaggtgagcgccgagttcgacctgaccctggacagcgagcccctgctgcaggccatccaccagctggacttcatccagatgaagtgcagagtgccccccgtgcccctgctgcagctggagaagtgctgcaccagaaacaacagcgtgaccctggcctggagaatgccccccttcacccacagccccgtggacggctacatcctggagctggacgacggcgccggcggccagttcagagaggtgtacgtgggcaaggagaccctgtgcaccatcgacggcctgcacttcaacagcacctacaacgccagagtgaaggccttcaacagcagcggcgtgggcccctacagcaagaccgtggtgctgcagaccagcgacgtggcctggttcaccttcgaccccaacagcggccacagagacatcatcctgagcaacgacaaccagaccgccacctgcagcagctacgacgacagagtggtgctgggcaccgccgccttcagcaagggcgtgcactactgggagctgcacgtggacagatacgacaaccaccccgaccccgccttcggcgtggccagagccagcgtggtgaaggacatgatgctgggcaaggacgacaaggcctgggccatgtacgtggacaacaacagaagctggttcatgcactgcaacagccacaccaacagaaccgagggcggcgtgtgcaagggcgccaccgtgggcgtgctgctggacctgaacaagcacaccctgaccttcttcatcaacggccagcagcagggccccaccgccttcagccacgtggacggcgtgttcatgcccgccctgagcctgaacagaaacgtgcaggtgaccctgcacaccggcctggaggtgcccaccaacctgggcagacccaagctgagcggcaactag

SEQ ID NO: 10586 - DNA, 471 bp, Artificial Sequence
  Description of Artificial Sequence: Synthetic coding sequence
atggtgcccgtgttcaccagcagcgccctgcccgtgaaggacgtggaggacaagcccgagcagcagaccagaaccagagagaccgacaagagccccaccagcaccgagcccagacagcagcccagcgccctgttcgccagaggcaacagaaaggccgtgaagagcccccagagaagcagcagcaagatcaaggagaacaagcaccccttcgccctgtacggctggggcgagaagcagaccgacaccggcagccagaagacccacaacgtgtgcgccagcgcccccgtgcacgagatccacgagagcgccctgagagccaagaacagaagacaggtggagaagagaaagctggtggcccagagacagagagcccacagcgtggacgtggagaagaacagaaagatgaaggccagcagcagcgagaacccctggatgaccgagtacatgagatgctacagcgccagagcctag

SEQ ID NO: 10587 - DNA, 813 bp, Artificial Sequence; identical to SEQ ID NO: 9598
  Description of Artificial Sequence: Synthetic coding sequence

SEQ ID NO: 10588 - DNA, 1158 bp, Artificial Sequence
  Description of Artificial Sequence: Synthetic coding sequence
atggccgcccccgacctgagcaccaacctgcaggaggaggccacctgcgccatctgcctggactacttcaccgaccccgtgatgaccgactgcggccacaacttctgcagagagtgcatcagaagatgctggggccagcccgagggcccctacgcctgccccgagtgcagagagctgagcccccagagaaacctgagacccaacagacccctggccaagatggccgagatggccagaagactgcacccccccagccccgtgccccagggcgtgtgccccgcccacagagagcccctggccgccttctgcggcgacgagctgagactgctgtgcgccgcctgcgagagaagcggcgagcactgggcccacagagtgagacccctgcaggacgccgccgaggacctgaaggccaagctggagaagagcctggagcacctgagaaagcagatgcaggacgccctgctgttccaggcccaggccgacgagacctgcgtgctgtggcagaagatggtggagagccagagacagaacgtgctgggcgagttcgagagactgagaagactgctggccgaggaggagcagcagctgctgcagagactggaggaggaggagctggaggtgctgcccagactgagagagggcgccgcccacctgggccagcagagcgcccacctggccgagctgatcgccgagctggagggcagatgccagctgcccgccctgggcctgctgcaggacatcaaggacgccctgagaagagtgcaggacgtgaagctgcagccccccgaggtggtgcccatggagctgagaaccgtgtgcagagtgcccggcctggtggagaccctgagaagattcagaggcagatgcggcggccccagatggggcgacgacagcagaagaggccccgccaaggacctgggcagccagcccagagtgctgtgccccgccaccgccagcagcaagctgaccgtgagctggtggtgggtggtgggcaagaccagcagcgcccacaccagcgacatcagctgcgtgggcatcttcacccccaacaacagcagcaccagcggcaacgagctgggcatccagggcttccacagcgccctgaacagaatcgccagcgccgacaccaccggcgtgagcaccgaccccaccgactag

SEQ ID NO: 10589 - DNA, 1251 bp, Artificial Sequence
  Description of Artificial Sequence: Synthetic coding sequence
atgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcgaggccgccaagtgcgccagagcctag

SEQ ID NO: 10590 - DNA, 2130 bp, Artificial Sequence
  Description of Artificial Sequence: Synthetic coding sequence
atggagaagcacagaggcgtgctggagtgccaggtgagcagagccagcgcccaggtgagatggttcaagggcagccaggagctgcagcccggccccaagtacgagctggtgagcgacggcctgtacagaaagctgatcatcagcgacgtgcacgccgaggacgaggacacctacacctgcgacgccggcgacgtgaagaccagcgcccagttcttcgtggaggagcagagcatcaccatcgtgagaggcctgcaggacgtgaccgtgatggagcccgcccccgcctggttcgagtgcgagaccagcatccccagcgtgagaccccccaagtggctgctgggcaagaccgtgctgcaggccggcggcaacgtgggcctggagcaggagggcaccgtgcacagactgatgctgagaagaacctgcagcaccatgaccggccccgtgcacttcaccgtgggcaagagcagaagcagcgccagactggtggtgagcgacatccccgtggtgctgaccagacccctggagcccaagaccggcagagagctgcagagcgtggtgctgagctgcgacttcagacccgcccccaaggccgtgcagtggtacaaggacgacacccccctgagccccagcgagaagttcaagatgagcctggagggccagatggccgagctgagaatcctgagactgatgcccgccgacgccggcgtgtacagatgccaggccggcagcgcccacagcagcaccgaggtgaccgtggaggccagagaggtgaccgtgaccggccccctgcaggacgccgaggccaccgaggagggctgggccagcttcagctgcgagctgagccacgaggacgaggaggtggagtggagcctgaacggcatgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcgaggccgccaagtgcgccagagcctag

SEQ ID NO: 10591 - DNA, 16809 bp, Artificial Sequence
  Description of Artificial Sequence: Synthetic coding sequence
atgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccctgcccgccagattcacccaggacctgaagaccaaggaggccagcgagggcgccaccgccaccctgcagtgcgagctgagcaaggtggcccccgtggagtggaagaagggccccgagaccctgagagacggcggcagatacagcctgaagcaggacggcaccagatgcgagctgcagatccacgacctgagcgtggccgacgccggcgagtacagctgcatgtgcggccaggagagaaccagcgccaccctgaccgtgagagccctgcccgccagattcaccgagggcctgagaaacgaggaggccatggagggcgccaccgccaccctgcagtgcgagctgagcaaggccgcccccgtggagtggagaaagggcctggaggccctgagagacggcgacaagtacagcctgagacaggacggcgccgtgtgcgagctgcagatccacggcctggccatggccgacaacggcgtgtacagctgcgtgtgcggccaggagagaaccagcgccaccctgaccgtgagagccctgcccgccagattcatcgaggacatgagaaaccagaaggccaccgagggcgccaccgtgaccctgcagtgcaagctgagaaaggccgcccccgtggagtggagaaagggccccaacaccctgaaggacggcgacagatacagcctgaagcaggacggcaccagctgcgagctgcagatcagaggcctggtgatcgccgacgccggcgagtacagctgcatctgcgagcaggagagaaccagcgccaccctgaccgtgagagccctgcccgccagattcatcgaggacgtgagaaaccacgaggccaccgagggcgccaccgccgtgctgcagtgcgagctgagcaaggccgcccccgtggagtggagaaagggcagcgagaccctgagagacggcgacagatacagcctgagacaggacggcaccagatgcgagctgcagatcagaggcctggccgtggaggacaccggcgagtacctgtgcgtgtgcggccaggagagaaccagcgccaccctgaccgtgagagccctgcccgccagattcatcgacaacatgaccaaccaggaggccagagagggcgccaccgccaccctgcactgcgagctgagcaaggtggcccccgtggagtggagaaagggccccgagaccctgagagacggcgacagacacagcctgagacaggacggcaccagatgcgagctgcagatcagaggcctgagcgtggccgacgccggcgagtacagctgcgtgtgcggccaggagagaaccagcgccaccctgaccatcagagaggccaccgagggcgccaccgccatgctgcagtgcgagctgagcaaggtggcccccgtggagtggagaaagggccccgagaccctgagagacggcgacagatacaacctgagacaggacggcaccagatgcgagctgcagatccacggcctgagcgtggccgacaccggcgagtacagctgcgtgtgcggccaggagaagaccagcgccaccctgaccgtgaaggccccccagcccgtgttcagagagcccctgcagagcctgcaggccgaggagggcagcaccgccaccctgcagtgcgagctgagcgagcccaccgccaccgtggtgtggagcaagggcggcctgcagctgcaggccaacggcagaagagagcccagactgcagggctgcaccgccgagctggtgctgcaggacctgcagagagaggacaccggcgagtacacctgcacctgcggcagccaggccaccagcgccaccctgaccgtgaccgccgcccccgtgagattcctgagagagctgcagcaccaggaggtggacgagggcggcaccgcccacctgtgctgcgagctgagcagagccggcgccagcgtggagtggagaaagggcagcctgcagctgttcccctgcgccaagtaccagatggtgcaggacggcgccgccgccgagctgctggtgagaggcgtggagcaggaggacgccggcgactacacctgcgacaccggccacacccagagcatggccagcctgagcgtgagagtgcccagacccaagttcaagaccagactgcagagcctggagcaggagaccggcgacatcgccagactgtgctgccagctgagcgacgccgagagcggcgccgtggtgcagtggctgaaggagggcgtggagctgcacgccggccccaagtacgagatgagaagccagggcgccaccagagagctgctgatccaccagctggaggccaaggacaccggcgagtacgcctgcgtgaccggcggccagaagaccgccgccagcctgagagtgaccgagcccgaggtgaccatcgtgagaggcctggtggacgccgaggtgaccgccgacgaggacgtggagttcagctgcgaggtgagcagagccggcgccaccggcgtgcagtggtgcctgcagggcctgcccctgcagagcaacgaggtgaccgaggtggccgtgagagacggcagaatccacaccctgagactgaagggcgtgacccccgaggacgccggcaccgtgagcttccacctgggcaaccacgccagcagcgcccagctgaccgtgagagcccccgaggtgaccatcctggagcccctgcaggacgtgcagctgagcgagggccaggacgccagcttccagtgcagactgagcagagccagcggccaggaggccagatgggccctgggcggcgtgcccctgcaggccaacgagatgaacgacatcaccgtggagcagggcaccctgcacctgctgaccctgcacaaggtgaccctggaggacgccggcaccgtgagcttccacgtgggcacctgcagcagcgaggcccagctgaaggtgaccgccaagaacaccgtggtgagaggcctggagaacgtggaggccctggagggcggcgaggccctgttcgagtgccagctgagccagcccgaggtggccgcccacacctggctgctggacgacgagcccgtgcacaccagcgagaacgccgaggtggtgttcttcgagaacggcctgagacacctgctgctgctgaagaacctgagaccccaggacagctgcagagtgaccttcctggccggcgacatggtgaccagcgccttcctgaccgtgagaggctggagactggagatcctggagcccctgaagaacgccgccgtgagagccggcgcccaggcctgcttcacctgcaccctgagcgaggccgtgcccgtgggcgaggccagctggtacatcaacggcgccgccgtgcagcccgacgacagcgactggaccgtgaccgccgacggcagccaccacgccctgctgctgagaagcgcccagccccaccacgccggcgaggtgaccttcgcctgcagagacgccgtggccagcgccagactgaccgtgctgggcctgcccgacccccccgaggacgccgaggtggtggccagaagcagccacaccgtgaccctgagctgggccgcccccatgagcgacggcggcggcggcctgtgcggctacagagtggaggtgaaggagggcgccaccggccagtggagactgtgccacgagctggtgcccggccccgagtgcgtggtggacggcctggcccccggcgagacctacagattcagagtggccgccgtgggccccgtgggcgccggcgagcccgtgcacctgccccagaccgtgagactggccgagccccccaagcccgtgcccccccagcccagcgcccccgagagcagacaggtggccgccggcgaggacgtgagcctggagctggaggtggtggccgaggccggcgaggtgatctggcacaagggcatggagagaatccagcccggcggcagattcgaggtggtgagccagggcagacagcagatgctggtgatcaagggcttcaccgccgaggaccagggcgagtaccactgcggcctggcccagggcagcatctgccccgccgccgccaccttccaggtggccctgagccccgccagcgtggacgaggccccccagcccagcctgccccccgaggccgcccaggagggcgacctgcacctgctgtgggaggccctggccagaaagagaagaatgagcagagagcccaccctggacagcatcagcgagctgcccgaggaggacggcagaagccagagactgccccaggaggccgaggaggtggcccccgacctgagcgagggctacagcaccgccgacgagctggccagaaccggcgacgccgacctgagccacaccagcagcgacgacgagagcagagccggcacccccagcctggtgacctacctgaagaaggccggcagacccggcaccagccccctggccagcaaggtgggcgcccccgccgcccccagcgtgaagccccagcagcagcaggagcccctggccgccgtgagaccccccctgggcgacctgagcaccaaggacctgggcgaccccagcatggacaaggccgccgtgaagatccaggccgccttcaagggctacaaggtgagaaaggagatgaagcagcaggagggccccatgttcagccacaccttcggcgacaccgaggcccaggtgggcgacgccctgagactggagtgcgtggtggccagcaaggccgacgtgagagccagatggctgaaggacggcgtggagctgaccgacggcagacaccaccacatcgaccagctgggcgacggcacctgcagcctgctgatcaccggcctggacagagccgacgccggctgctacacctgccaggtgagcaacaagttcggccaggtgacccacagcgcctgcgtggtggtgagcggcagcgagagcgaggccgagagcagcagcggcggcgagctggacgacgccttcagaagagccgccagaagactgcacagactgttcagaaccaagagccccgccgaggtgagcgacgaggagctgttcctgagcgccgacgagggccccgccgagcccgaggagcccgccgactggcagacctacagagaggacgagcacttcatctgcatcagattcgaggccctgaccgaggccagacaggccgtgaccagattccaggagatgttcgccaccctgggcatcggcgtggagatcaagctggtggagcagggccccagaagagtggagatgtgcatcagcaaggagacccccgcccccgtggtgccccccgagcccctgcccagcctgctgaccagcgacgccgcccccgtgttcctgaccgagctgcagaaccaggaggtgcaggacggctaccccgtgagcttcgactgcgtggtgaccggccagcccatgcccagcgtgagatggttcaaggacggcaagctgctggaggaggacgaccactacatgatcaacgaggaccagcagggcggccaccagctgatcatcaccgccgtggtgcccgccgacatgggcgtgtacagatgcctggccgagaacagcatgggcgtgagcagcaccaaggccgagctgagagtggacctgaccagcaccgactacgacaccgccgccgacgccaccgagagcagcagctacttcagcgcccagggctacctgagcagcagagagcaggagggcaccgagagcaccaccgacgagggccagctgccccaggtggtggaggagctgagagacctgcaggtggcccccggcaccagactggccaagttccagctgaaggtgaagggctaccccgcccccagactgtactggttcaaggacggccagcccctgaccgccagcgcccacatcagaatgaccgacaagaagatcctgcacaccctggagatcatcagcgtgaccagagaggacagcggccagtacgccgcctacatcagcaacgccatgggcgccgcctacagcagcgccagactgctggtgagaggccccgacgagcccgaggagaagcccgccagcgacgtgcacgagcagctggtgccccccagaatgctggagagattcacccccaagaaggtgaagaagggcagcagcatcaccttcagcgtgaaggtggagggcagacccgtgcccaccgtgcactggctgagagaggaggccgagagaggcgtgctgtggatcggccccgacacccccggctacaccgtggccagcagcgcccagcagcacagcctggtgctgctggacgtgggcagacagcaccagggcacctacacctgcatcgccagcaacgccgccggccaggccctgtgcagcgccagcctgcacgtgagcggcctgcccaaggtggaggagcaggagaaggtgaaggaggccctgatcagcaccttcctgcagggcaccacccaggccatcagcgcccagggcctggagaccgccagcttcgccgacctgggcggccagagaaaggaggagcccctggccgccaaggaggccctgggccacctgagcctggccgaggtgggcaccgaggagttcctgcagaagctgaccagccagatcaccgagatggtgagcgccaagatcacccaggccaagctgcaggtgcccggcggcgacagcgacgaggacagcaagacccccagcgccagccccagacacggcagaagcagacccagcagcagcatccaggagagcagcagcgagagcgaggacggcgacgccagaggcgagatcttcgacatctacgtggtgaccgccgactacctgcccctgggcgccgagcaggacgccatcaccctgagagagggccagtacgtggaggtgctggacgccgcccaccccctgagatggctggtgagaaccaagcccaccaagagcagccccagcagacagggctgggtgagccccgcctacctggacagaagactgaagctgagccccgagtggggcgccgccgaggcccccgagttccccggcgaggccgtgagcgaggacgagtacaaggccagactgagcagcgtgatccaggagctgctgagcagcgagcaggccttcgtggaggagctgcagttcctgcagagccaccacctgcagcacctggagagatgcccccacgtgcccatcgccgtggccggccagaaggccgtgatcttcagaaacgtgagagacatcggcagattccacagcagcttcctgcaggagctgcagcagtgcgacaccgacgacgacgtggccatgtgcttcatcaagaaccaggccgccttcgagcagtacctggagttcctggtgggcagagtgcaggccgagagcgtggtggtgagcaccgccatccaggagttctacaagaagtacgccgaggaggccctgctggccggcgaccccagccagcccccccccccccccctgcagcactacctggagcagcccgtggagagagtgcagagataccaggccctgctgaaggagctgatcagaaacaaggccagaaacagacagaactgcgccctgctggagcaggcctacgccgtggtgagcgccctgccccagagagccgagaacaagctgcacgtgagcctgatggagaactaccccggcaccctgcaggccctgggcgagcccatcagacagggccacttcatcgtgtgggagggcgcccccggcgccagaatgccctggaagggccacaacagacacgtgttcctgttcagaaaccacctggtgatctgcaagcccagaagagacagcagaaccgacaccgtgagctacgtgttcagaaacatgatgaagctgagcagcatcgacctgaacgaccaggtggagggcgacgacagagccttcgaggtgtggcaggagagagaggacagcgtgagaaagtacctgctgcaggccagaaccgccatcatcaagagcagctgggtgaaggagatctgcggcatccagcagagactggccctgcccgtgtggagaccccccgacttcgaggaggagctggccgactgcaccgccgagctgggcgagaccgtgaagctggcctgcagagtgaccggcacccccaagcccgtgatcagctggtacaaggacggcaaggccgtgcaggtggacccccaccacatcctgatcgaggaccccgacggcagctgcgccctgatcctggacagcctgaccggcgtggacagcggccagtacatgtgcttcgccgccagcgccgccggcaactgcagcaccctgggcaagatcctggtgcaggtgccccccagattcgtgaacaaggtgagagccagccccttcgtggagggcgaggacgcccagttcacctgcaccatcgagggcgccccctacccccagatcagatggtacaaggacggcgccctgctgaccaccggcaacaagttccagaccctgagcgagcccagaagcggcctgctggtgctggtgatcagagccgccagcaaggaggacctgggcctgtacgagtgcgagctggtgaacagactgggcagcgccagagccagcgccgagctgagaatccagagccccatgctgcaggcccaggagcagtgccacagagagcagctggtggccgccgtggaggacaccaccctggagagagccgaccaggaggtgaccagcgtgctgaagagactgctgggccccaaggcccccggccccagcaccggcgacctgaccggccccggcccctgccccagaggcgcccccgccctgcaggagaccggcagccagccccccgtgaccggcaccagcgaggcccccgccgtgccccccagagtgccccagcccctgctgcacgagggccccgagcaggagcccgaggccatcgccagagcccaggagtggaccgtgcccatcagaatggagggcgccgcctggcccggcgccggcaccggcgagctgctgtgggacgtgcacagccacgtggtgagagagaccacccagagaacctacacctaccaggccatcgacacccacaccgccagaccccccagcatgcaggtgaccatcgaggacgtgcaggcccagaccggcggcaccgcccagttcgaggccatcatcgagggcgacccccagcccagcgtgacctggtacaaggacagcgtgcagctggtggacagcaccagactgagccagcagcaggagggcaccacctacagcctggtgctgagacacgtggccagcaaggacgccggcgtgtacacctgcctggcccagaacaccggcggccaggtgctgtgcaaggccgagctgctggtgctgggcggcgacaacgagcccgacagcgagaagcagagccacagaagaaagctgcacagcttctacgaggtgaaggaggagatcggcagaggcgtgttcggcttcgtgaagagagtgcagcacaagggcaacaagatcctgtgcgccgccaagttcatccccctgagaagcagaaccagagcccaggcctacagagagagagacatcctggccgccctgagccaccccctggtgaccggcctgctggaccagttcgagaccagaaagaccctgatcctgatcctggagctgtgcagcagcgaggagctgctggacagactgtacagaaagggcgtggtgaccgaggccgaggtgaaggtgtacatccagcagctggtggagggcctgcactacctgcacagccacggcgtgctgcacctggacatcaagcccagcaacatcctgatggtgcaccccgccagagaggacatcaagatctgcgacttcggcttcgcccagaacatcacccccgccgagctgcagttcagccagtacggcagccccgagttcgtgagccccgagatcatccagcagaaccccgtgagcgaggccagcgacatctgggccatgggcgtgatcagctacctgagcctgacctgcagcagccccttcgccggcgagagcgacagagccaccctgctgaacgtgctggagggcagagtgagctggagcagccccatggccgcccacctgagcgaggacgccaaggacttcatcaaggccaccctgcagagagccccccaggccagacccagcgccgcccagtgcctgagccacccctggttcctgaagagcatgcccgccgaggaggcccacttcatcaacaccaagcagctgaagttcctgctggccagaagcagatggcagagaagcctgatgagctacaagagcatcctggtgatgagaagcatccccgagctgctgagaggcccccccgacagccccagcctgggcgtggccagacacctgtgcagagacaccggcggcagcagcagcagcagcagcagcagcgacaacgagctggcccccttcgccagagccaagagcctgccccccagccccgtgacccacagccccctgctgcaccccagaggcttcctgagacccagcgccagcctgcccgaggaggccgaggccagcgagagaagcaccgaggcccccgccccccccgccagccccgagggcgccggcccccccgccgcccagggctgcgtgcccagacacagcgtgatcagaagcctgttctaccaccaggccggcgagagccccgagcacggcgccctggcccccggcagcagaagacaccccgccagaagaagacacctgctgaagggcggctacatcgccggcgccctgcccggcctgagagagcccctgatggagcacagagtgctggaggaggaggccgccagagaggagcaggccaccctgctggccaaggcccccagcttcgagaccgccctgagactgcccgccagcggcacccacctggcccccggccacagccacagcctggagcacgacagccccagcacccccagacccagcagcgaggcctgcggcgaggcccagagactgcccagcgcccccagcggcggcgcccccatcagagacatgggccacccccagggcagcaagcagctgcccagcaccggcggccaccccggcaccgcccagcccgagagacccagccccgacagcccctggggccagcccgcccccttctgccaccccaagcagggcagcgccccccaggagggctgcagcccccaccccgccgtggccccctgcccccccggcagcttcccccccggcagctgcaaggaggcccccctggtgcccagcagccccttcctgggccagccccaggccccccccgcccccgccaaggccagcccccccctggacagcaagatgggccccggcgacatcagcctgcccggcagacccaagcccggcccctgcagcagccccggcagcgccagccaggccagcagcagccaggtgagcagcctgagagtgggcagcagccaggtgggcaccgagcccggccccagcctggacgccgagggctggacccaggaggccgaggacctgagcgacagcacccccaccctgcagagaccccaggagcaggccaccatgagaaagttcagcctgggcggcagaggcggctacgccggcgtggccggctacggcaccttcgccttcggcggcgacgccggcggcatgctgggccagggccccatgtgggccagaatcgcctgggccgtgagccagagcgaggaggaggagcaggaggaggccagagccgagagccagagcgaggagcagcaggaggccagagccgagagccccctgccccaggtgagcgccagacccgtgcccgaggtgggcagagcccccaccagaagcagccccgagcccaccccctgggaggacatcggccaggtgagcctggtgcagatcagagacctgagcggcgacgccgaggccgccgacaccatcagcctggacatcagcgaggtggaccccgcctacctgaacctgagcgacctgtacgacatcaagtacctgcccttcgagttcatgatcttcagaaaggtgcccaagagcgcccagcccgagccccccagccccatggccgaggaggagctggccgagttccccgagcccacctggccctggcccggcgagctgggcccccacgccggcctggagatcaccgaggagagcgaggacgtggacgccctgctggccgaggccgccgtgggcagaaagagaaagtggagcagccccagcagaagcctgttccacttccccggcagacacctgcccctggacgagcccgccgagctgggcctgagagagagagtgaaggccagcgtggagcacatcagcagaatcctgaagggcagacccgagggcctggagaaggagggcccccccagaaagaagcccggcctggccagcttcagactgagcggcctgaagagctgggacagagcccccaccttcctgagagagctgagcgacgagaccgtggtgctgggccagagcgtgaccctggcctgccaggtgagcgcccagcccgccgcccaggccacctggagcaaggacggcgcccccctggagagcagcagcagagtgctgatcagcgccaccctgaagaacttccagctgctgaccatcctggtggtggtggccgaggacctgggcgtgtacacctgcagcgtgagcaacgccctgggcaccgtgaccaccaccggcgtgctgagaaaggccgagagacccagcagcagcccctgccccgacatcggcgaggtgtacgccgacggcgtgctgctggtgtggaagcccgtggagagctacggccccgtgacctacatcgtgcagtgcagcctggagggcggcagctggaccaccctggccagcgacatcttcgactgctgctacctgaccagcaagctgagcagaggcggcacctacaccttcagaaccgcctgcgtgagcaaggccggcatgggcccctacagcagccccagcgagcaggtgctgctgggcggccccagccacctggccagcgaggaggagagccagggcagaagcgcccagcccctgcccagcaccaagaccttcgccttccagacccagatccagagaggcagattcagcgtggtgagacagtgctgggagaaggccagcggcagagccctggccgccaagatcatcccctaccaccccaaggacaagaccgccgtgctgagagagtacgaggccctgaagggcctgagacacccccacctggcccagctgcacgccgcctacctgagccccagacacctggtgctgatcctggagctgtgcagcggccccgagctgctgccctgcctggccgagagagccagctacagcgagagcgaggtgaaggactacctgtggcagatgctgagcgccacccagtacctgcacaaccagcacatcctgcacctggacctgagaagcgagaacatgatcatcaccgagtacaacctgctgaaggtggtggacctgggcaacgcccagagcctgagccaggagaaggtgctgcccagcgacaagttcaaggactacctggagaccatggcccccgagctgctggagggccagggcgccgtgccccagaccgacatctgggccatcggcgtgaccgccttcatcatgctgagcgccgagtaccccgtgagcagcgagggcgccagagacctgcagagaggcctgagaaagggcctggtgagactgagcagatgctacgccggcctgagcggcggcgccgtggccttcctgagaagcaccctgtgcgcccagccctggggcagaccctgcgccagcagctgcctgcagtgcccctggctgaccgaggagggccccgcctgcagcagacccgcccccgtgaccttccccaccgccagactgagagtgttcgtgagaaacagagagaagagaagagccctgctgtacaagagacacaacctggcccaggtgagatag

SEQ ID NO: 10592 - DNA, 11220 bp, Artificial Sequence
  Description of Artificial Sequence: Synthetic coding sequence
atgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccccccagcccgtgttcagagagcccctgcagagcctgcaggccgaggagggcagcaccgccaccctgcagtgcgagctgagcgagcccaccgccaccgtggtgtggagcaagggcggcctgcagctgcaggccaacggcagaagagagcccagactgcagggctgcaccgccgagctggtgctgcaggacctgcagagagaggacaccggcgagtacacctgcacctgcggcagccaggccaccagcgccaccctgaccgtgaccgccgcccccgtgagattcctgagagagctgcagcaccaggaggtggacgagggcggcaccgcccacctgtgctgcgagctgagcagagccggcgccagcgtggagtggagaaagggcagcctgcagctgttcccctgcgccaagtaccagatggtgcaggacggcgccgccgccgagctgctggtgagaggcgtggagcaggaggacgccggcgactacacctgcgacaccggccacacccagagcatggccagcctgagcgtgagagtgcccagacccaagttcaagaccagactgcagagcctggagcaggagaccggcgacatcgccagactgtgctgccagctgagcgacgccgagagcggcgccgtggtgcagtggctgaaggagggcgtggagctgcacgccggccccaagtacgagatgagaagccagggcgccaccagagagctgctgatccaccagctggaggccaaggacaccggcgagtacgcctgcgtgaccggcggccagaagaccgccgccagcctgagagtgaccgagcccgaggtgaccatcgtgagaggcctggtggacgccgaggtgaccgccgacgaggacgtggagttcagctgcgaggtgagcagagccggcgccaccggcgtgcagtggtgcctgcagggcctgcccctgcagagcaacgaggtgaccgaggtggccgtgagagacggcagaatccacaccctgagactgaagggcgtgacccccgaggacgccggcaccgtgagcttccacctgggcaaccacgccagcagcgcccagctgaccgtgagagcccccgaggtgaccatcctggagcccctgcaggacgtgcagctgagcgagggccaggacgccagcttccagtgcagactgagcagagccagcggccaggaggccagatgggccctgggcggcgtgcccctgcaggccaacgagatgaacgacatcaccgtggagcagggcaccctgcacctgctgaccctgcacaaggtgaccctggaggacgccggcaccgtgagcttccacgtgggcacctgcagcagcgaggcccagctgaaggtgaccgccaagaacaccgtggtgagaggcctggagaacgtggaggccctggagggcggcgaggccctgttcgagtgccagctgagccagcccgaggtggccgcccacacctggctgctggacgacgagcccgtgcacaccagcgagaacgccgaggtggtgttcttcgagaacggcctgagacacctgctgctgctgaagaacctgagaccccaggacagctgcagagtgaccttcctggccggcgacatggtgaccagcgccttcctgaccgtgagaggctggagactggagatcctggagcccctgaagaacgccgccgtgagagccggcgcccaggcctgcttcacctgcaccctgagcgaggccgtgcccgtgggcgaggccagctggtacatcaacggcgccgccgtgcagcccgacgacagcgactggaccgtgaccgccgacggcagccaccacgccctgctgctgagaagcgcccagccccaccacgccggcgaggtgaccttcgcctgcagagacgccgtggccagcgccagactgaccgtgctgggcctgcccgacccccccgaggacgccgaggtggtggccagaagcagccacaccgtgaccctgagctgggccgcccccatgagcgacggcggcggcggcctgtgcggctacagagtggaggtgaaggagggcgccaccggccagtggagactgtgccacgagctggtgcccggccccgagtgcgtggtggacggcctggcccccggcgagacctacagattcagagtggccgccgtgggccccgtgggcgccggcgagcccgtgcacctgccccagaccgtgagactggccgagccccccaagcccgtgcccccccagcccagcgcccccgagagcagacaggtggccgccggcgaggacgtgagcctggagctggaggtggtggccgaggccggcgaggtgatctggcacaagggcatggagagaatccagcccggcggcagattcgaggtggtgagccagggcagacagcagatgctggtgatcaagggcttcaccgccgaggaccagggcgagtaccactgcggcctggcccagggcagcatctgccccgccgccgccaccttccaggtggccctgagccccgccagcgtggacgaggccccccagcccagcctgccccccgaggccgcccaggagggcgacctgcacctgctgtgggaggccctggccagaaagagaagaatgagcagagagcccaccctggacagcatcagcgagctgcccgaggaggacggcagaagccagagactgccccaggaggccgaggaggtggcccccgacctgagcgagggctacagcaccgccgacgagctggccagaaccggcgacgccgacctgagccacaccagcagcgacgacgagagcagagccggcacccccagcctggtgacctacctgaagaaggccggcagacccggcaccagccccctggccagcaaggtgggcgcccccgccgcccccagcgtgaagccccagcagcagcaggagcccctggccgccgtgagaccccccctgggcgacctgagcaccaaggacctgggcgaccccagcatggacaaggccgccgtgaagatccaggccgccttcaagggctacaaggtgagaaaggagatgaagcagcaggagggccccatgttcagccacaccttcggcgacaccgaggcccaggtgggcgacgccctgagactggagtgcgtggtggccagcaaggccgacgtgagagccagatggctgaaggacggcgtggagctgaccgacggcagacaccaccacatcgaccagctgggcgacggcacctgcagcctgctgatcaccggcctggacagagccgacgccggctgctacacctgccaggtgagcaacaagttcggccaggtgacccacagcgcctgcgtggtggtgagcggcagcgagagcgaggccgagagcagcagcggcggcgagctggacgacgccttcagaagagccgccagaagactgcacagactgttcagaaccaagagccccgccgaggtgagcgacgaggagctgttcctgagcgccgacgagggccccgccgagcccgaggagcccgccgactggcagacctacagagaggacgagcacttcatctgcatcagattcgaggccctgaccgaggccagacaggccgtgaccagattccaggagatgttcgccaccctgggcatcggcgtggagatcaagctggtggagcagggccccagaagagtggagatgtgcatcagcaaggagacccccgcccccgtggtgccccccgagcccctgcccagcctgctgaccagcgacgccgcccccgtgttcctgaccgagctgcagaaccaggaggtgcaggacggctaccccgtgagcttcgactgcgtggtgaccggccagcccatgcccagcgtgagatggttcaaggacggcaagctgctggaggaggacgaccactacatgatcaacgaggaccagcagggcggccaccagctgatcatcaccgccgtggtgcccgccgacatgggcgtgtacagatgcctggccgagaacagcatgggcgtgagcagcaccaaggccgagctgagagtggacctgaccagcaccgactacgacaccgccgccgacgccaccgagagcagcagctacttcagcgcccagggctacctgagcagcagagagcaggagggcaccgagagcaccaccgacgagggccagctgccccaggtggtggaggagctgagagacctgcaggtggcccccggcaccagactggccaagttccagctgaaggtgaagggctaccccgcccccagactgtactggttcaaggacggccagcccctgaccgccagcgcccacatcagaatgaccgacaagaagatcctgcacaccctggagatcatcagcgtgaccagagaggacagcggccagtacgccgcctacatcagcaacgccatgggcgccgcctacagcagcgccagactgctggtgagaggccccgacgagcccgaggagaagcccgccagcgacgtgcacgagcagctggtgccccccagaatgctggagagattcacccccaagaaggtgaagaagggcagcagcatcaccttcagcgtgaaggtggagggcagacccgtgcccaccgtgcactggctgagagaggaggccgagagaggcgtgctgtggatcggccccgacacccccggctacaccgtggccagcagcgcccagcagcacagcctggtgctgctggacgtgggcagacagcaccagggcacctacacctgcatcgccagcaacgccgccggccaggccctgtgcagcgccagcctgcacgtgagcggcctgcccaaggtggaggagcaggagaaggtgaaggaggccctgatcagcaccttcctgcagggcaccacccaggccatcagcgcccagggcctggagaccgccagcttcgccgacctgggcggccagagaaaggaggagcccctggccgccaaggaggccctgggccacctgagcctggccgaggtgggcaccgaggagttcctgcagaagctgaccagccagatcaccgagatggtgagcgccaagatcacccaggccaagctgcaggtgcccggcggcgacagcgacgaggacagcaagacccccagcgccagccccagacacggcagaagcagacccagcagcagcatccaggagagcagcagcgagagcgaggacggcgacgccagaggcgagatcttcgacatctacgtggtgaccgccgactacctgcccctgggcgccgagcaggacgccatcaccctgagagagggccagtacgtggaggtgctggacgccgcccaccccctgagatggctggtgagaaccaagcccaccaagagcagccccagcagacagggctgggtgagccccgcctacctggacagaagactgaagctgagccccgagtggggcgccgccgaggcccccgagttccccggcgaggccgtgagcgaggacgagtacaaggccagactgagcagcgtgatccaggagctgctgagcagcgagcaggccttcgtggaggagctgcagttcctgcagagccaccacctgcagcacctggagagatgcccccacgtgcccatcgccgtggccggccagaaggccgtgatcttcagaaacgtgagagacatcggcagattccacagcagcttcctgcaggagctgcagcagtgcgacaccgacgacgacgtggccatgtgcttcatcaagaaccaggccgccttcgagcagtacctggagttcctggtgggcagagtgcaggccgagagcgtggtggtgagcaccgccatccaggagttctacaagaagtacgccgaggaggccctgctggccggcgaccccagccagcccccccccccccccctgcagcactacctggagcagcccgtggagagagtgcagagataccaggccctgctgaaggagctgatcagaaacaaggccagaaacagacagaactgcgccctgctggagcaggcctacgccgtggtgagcgccctgccccagagagccgagaacaagctgcacgtgagcctgatggagaactaccccggcaccctgcaggccctgggcgagcccatcagacagggccacttcatcgtgtgggagggcgcccccggcgccagaatgccctggaagggccacaacagacacgtgttcctgttcagaaaccacctggtgatctgcaagcccagaagagacagcagaaccgacaccgtgagctacgtgttcagaaacatgatgaagctgagcagcatcgacctgaacgaccaggtggagggcgacgacagagccttcgaggtgtggcaggagagagaggacagcgtgagaaagtacctgctgcaggccagaaccgccatcatcaagagcagctgggtgaaggagatctgcggcatccagcagagactggccctgcccgtgtggagaccccccgacttcgaggaggagctggccgactgcaccgccgagctgggcgagaccgtgaagctggcctgcagagtgaccggcacccccaagcccgtgatcagctggtacaaggacggcaaggccgtgcaggtggacccccaccacatcctgatcgaggaccccgacggcagctgcgccctgatcctggacagcctgaccggcgtggacagcggccagtacatgtgcttcgccgccagcgccgccggcaactgcagcaccctgggcaagatcctggtgcaggtgccccccagattcgtgaacaaggtgagagccagccccttcgtggagggcgaggacgcccagttcacctgcaccatcgagggcgccccctacccccagatcagatggtacaaggacggcgccctgctgaccaccggcaacaagttccagaccctgagcgagcccagaagcggcctgctggtgctggtgatcagagccgccagcaaggaggacctgggcctgtacgagtgcgagctggtgaacagactgggcagcgccagagccagcgccgagctgagaatccagagccccatgctgcaggcccaggagcagtgccacagagagcagctggtggccgccgtggaggtgaccgagcaggagaccaaggtgcccaagaagaccgtgatcatcgaggagaccatcaccaccgtggtgaagagccccagaggccagagaagaagccccagcaagagccccagcagaagccccagcagatgcagcgccagccccctgagacccggcctgctggcccccgacctgctgtacctgcccggcgccggccagcccagaagacccgaggccgagcccggccagaagcccgtggtgcccaccctgtacgtgaccgaggccgaggcccacagccccgccctgcccggcctgagcggcccccagcccaagtgggtggaggtggaggagaccatcgaggtgagagtgaagaagatgggcccccagggcgtgagccccaccaccgaggtgcccagaagcagcagcggccacctgttcaccctgcccggcgccacccccggcggcgaccccaacagcaacaacagcaacaacaagctgctggcccaggaggcctgggcccagggcaccgccatggtgggcgtgagagagcccctggtgttcagagtggacgccagaggcagcgtggactgggccgccagcggcatgggcagcctggaggaggagggcaccatggaggaggccggcgaggaggagggcgaggacggcgacgccttcgtgaccgaggagagccaggacacccacagcctgggcgacagagaccccaagatcctgacccacaacggcagaatgctgaccctggccgacctggaggactacgtgcccggcgagggcgagaccttccactgcggcggccccggccccggcgcccccgacgaccccccctgcgaggtgagcgtgatccagagagagatcggcgagcccaccgtgggccagcccgtgctgctgagcgtgggccacgccctgggccccagaggccccctgggcctgttcagacccgagcccagaggcgccagcccccccggcccccaggtgagaagcctggagggcaccagcttcctgctgagagaggcccccgccagacccgtgggcagcgccccctggacccagagcttctgcaccagaatcagaagaagcgccgacagcggccagagcagcttcaccaccgagctgagcacccagaccgtgaacttcggcaccgtgggcgagaccgtgaccctgcacatctgccccgacagagacggcgacgaggccgcccagccctag

SEQ ID NO: 10593 - DNA, 1071 bp, Artificial Sequence
  Description of Artificial Sequence: Synthetic coding sequence
atggccaccgccgccctgctgagaggcgccacccccggcagaggcggccccgtgtggagatggagactgagagccgcccccagatgcagactggcccacagcagctgcagccccggcggcgaccccaccgccggcgccgcctgggcctgcttcagactggacggcagaaccctgctgagagtgagaggccccgacgccgcccccttcctgctgggcctgctgaccaacgagctgcccctgcccagccccgccgccgccggcgccccccccgccgccagagccggctacgcccacttcctgaacgtgcagggcagaaccctgtacgacgtgatcctgtacggcctgcaggagcacagcgaggtgagcggcttcctgctggagtgcgacagcagcgtgcagggcgccctgcagaagcacctggccctgtacagaatcagaagaaaggtgaccgtggagccccaccccgagctgagagtgtgggccgtgctgcccagcagccccgaggcctgcggcgccgccagcctgcaggagagagccggcgccgccgccatcctgatcagagaccccagaaccgccagaatgggctggagactgctgacccaggacgagggccccgccctggtgcccggcggcagactgggcgacctgtgggactaccaccagcacagatacctgcagggcgtgcccgagggcgtgagagacctgccccccggcgtggccctgcccctggagagcaacctggccttcatgaacggcgtgagcttcaccaagggctgctacatcggccaggagctgaccgccagaacccaccacatgggcgtgatcagaaagagactgttccccgtgagattcctggaccccctgcccaccagcggcatcacccccggcgccaccgtgctgaccgccagcggccagaccgtgggcaagttcagagccggccagggcaacgtgggcctggccctgctgtggagcgagaagatcaagggccccctgcacatcagagccagcgagggcgcccaggtggccctggccgccagcgtgcccgactggtggcccaccgtgagcaagtag

SEQ ID NO: 10594 - DNA, 1395 bp, Artificial Sequence
  Description of Artificial Sequence: Synthetic coding sequence
atgagagccgccagaagaggcctgcactgcgccggcgccgagagacccagaagaagaggcagactgtgggacagcagcggcgtgccccagagacagaagagacccggcccctggagaacccagacccaggagcagatgagcagagacgtgtgcatccacacctggccctgcacctactacctggagcccaagagaagatgggtgaccggccagctgagcctgaccagcctgagcctgagattcatgaccgacagcaccggcgagatcctggtgagcttccccctgagcagcatcgtggagatcaagaaggaggccagccacttcatcttcagcagcatcaccatcctggagaagggccacgccaagcactggttcagcagcctgagacccagcagaaacgtggtgttcagcatcatcgagcacttctggagagagctgctgctgagccagcccggcgccgtggccgacgccagcgtgcccagaaccagaggcgaggagctgaccggcctgatggccggcagccagaagagactggaggacaccgccagagtgctgcaccaccagggccagcagctggacagcgtgatgagaggcctggacaagatggagagcgacctggaggtggccgacagactgctgaccgagctggagagccccgcctggtggcccttcagcagcaagctgtggaagaccccccccgagaccaagcccagagaggacgtgagcatgaccagctgcgagcccttcggcaaggagggcatcctgatcaagatccccgccgtgatcagccacagaaccgagagccacgtgaagcccggcagactgaccgtgctggtgagcggcctggagatccacgacagcagcagcctgctgatgcacagattcgagagagaggacgtggacgacatcaaggtgcacagcccctacgagatcagcatcagacagagattcatcggcaagcccgacatggcctacagactgatcagcgccaagatgcccgaggtgatccccatcctggaggtgcagttcagcaagaagatggagctgctggaggacgccctggtgctgagaagcgccagaaccagcagccccgccgagaagagctgcagcgtgtggcacgccgccagcggcctgatgggcagaaccctgcacagagagccccccgccggcgaccaggagggcaccgccctgcacctgcagaccagcctgcccgccctgagcgaggccgacacccaggagctgacccagatcctgagaagaatgaagggcctggccctggaggccgagagcgagctggagagacaggacgaggccctggacggcgtggccgccgccgtggacagagccaccctgaccatcgacaagcacaacagaagaatgaagagactgacctag

SEQ ID NO: 10595 - DNA, 669 bp, Artificial Sequence
  Description of Artificial Sequence: Synthetic coding sequence
atgaccagctgcgagcccttcggcaaggagggcatcctgatcaagatccccgccgtgatcagccacagaaccgagagccacgtgaagcccggcagactgaccgtgctggtgagcggcctggagatccacgacagcagcagcctgctgatgcacagattcgagagagaggacgtggacgacatcaaggtgcacagcccctacgagatcagcatcagacagagattcatcggcaagcccgacatggcctacagactgatcagcgccaagatgcccgaggtgatccccatcctggaggtgcagttcagcaagaagatggagctgctggaggacgccctggtgctgagaagcgccagaaccagcagccccgccgagaagagctgcagcgtgtggcacgccgccagcggcctgatgggcagaaccctgcacagagagccccccgccggcgaccaggagggcaccgccctgcacctgcagaccagcctgcccgccctgagcgaggccgacacccaggagctgacccagatcctgagaagaatgaagggcctggccctggaggccgagagcgagctggagagacaggacgaggccctggacggcgtggccgccgccgtggacagagccaccctgaccatcgacaagcacaacagaagaatgaagagactgacctag

SEQ ID NO: 10596 - DNA, 201 bp, Artificial Sequence
  Description of Artificial Sequence: Synthetic coding sequence
atgccccagtaccagacctgggaggagttcagcagagccgccgagaagctgtacctggccgaccccatgaaggccagagtggtgctgaagtacagacacagcgacggcaacctgtgcgtgaaggtgaccgacgacctggtgcagtggcacctgaactactgcaccctgagacacggcatcgccggcggcctggagacctag

SEQ ID NO: 10597 - DNA, 249 bp, Artificial Sequence
  Description of Artificial Sequence: Synthetic coding sequence
atgccccagtaccagacctgggaggagttcagcagagccgccgagaagctgtacctggccgaccccatgaaggccagagtggtgctgaagtacagacacagcgacggcaacctgtgcgtgaaggtgaccgacgacctggtgagacagtgcctggccctgctgctgagactgcagtgcagcggcatgatcatcgcccactgcatcctggacctgctgggcagcagcggccccctggccagcgccagctag

SEQ ID NO: 10598 - DNA, 651 bp, Artificial Sequence
  Description of Artificial Sequence: Synthetic coding sequence
atgcaggccaacggcgccggcggcggcggcggcggcggcggcggcggcggcggcggcggcggcggcggcggcggccagggccagacccccgagctggcctgcctgagcgcccagaacggcgagagcagccccagcagcagcagcagcgccggcgacctggcccacgccaacggcctgctgcccagcgcccccagcgccgccagcaacaacagcaacagcctgaacgtgaacaacggcgtgcccggcggcgccgccgccgccagcagcgccaccgtggccgccgccagcgccaccaccgccgccagcagcagcctggccacccccgagctgggcagcagcctgaagaagaagaagagactgagccagagcgacgaggacgtgatcagactgatcggccagcacctgaacggcctgggcctgaaccagaccgtggacctgctgatgcaggagagcggctgcagactggagcaccccagcgccaccaagttcagaaaccacgtgatggagggcgactgggacaaggccgagaacgacctgaacgagctgaagcccctggtgcacagcccccacgccatcgtggcccagaccttcagcgagaccagcatcaacttcttccccctgaccgccgccttctgccacgtgagaggctag

SEQ ID NO: 10599 - DNA, 2340 bp, Artificial Sequence; identical to SEQ ID NO: 10369
  Description of Artificial Sequence: Synthetic coding sequence

SEQ ID NO: 10600 - DNA, 666 bp, Artificial Sequence
  Description of Artificial Sequence: Synthetic coding sequence
atggccgccgccagcggcagcgtgctgcagagatgcatcgtgagccccgccggcagacacagcgccagcctgatcttcctgcacggcagcggcgacagcggccagggcctgagaatgtggatcaagcaggtgctgaaccaggacctgaccttccagcacatcaagatcatctaccccaccgccccccccagattcaagatcaccaacgactgccccgagcacctggagagcatcgacgtgatgtgccaggtgctgaccgacctgatcgacgaggaggtgaagagcggcatcaagaagaacagaatcctgatcggcggcttcagcatgggcggctgcatggccatccacctggcctacagaaaccaccaggacgtggccggcgtgttcgccctgagcagcttcctgaacaaggccagcgccgtgtaccaggccctgcagaagagcaacggcgtgctgcccgagctgttccagtgccacggcaccgccgacgagctggtgctgcacagctgggccgaggagaccaacagcatgctgaagagcctgggcgtgaccaccaagttccacagcttccccaacgtgtaccacgagctgagcaagaccgagctggacatcctgaagctgtggatcctgaccaagctgcccggcgagatggagaagcagaagtag

SEQ ID NO: 10601 - DNA, 714 bp, Artificial Sequence
  Description of Artificial Sequence: Synthetic coding sequence
atggccgccgccagcggcagcgtgctgcagagatgcatcgtgagccccgccggcagacacagcgccagcctgatcttcctgcacggcagcggcgacagcggccagggcctgagaatgtggatcaagcaggtgctgaaccaggacctgaccttccagcacatcaagatcatctaccccaccgccccccccagaagctacacccccatgaagggcggcatcagcaacgtgtggttcgacagattcaagatcaccaacgactgccccgagcacctggagagcatcgacgtgatgtgccaggtgctgaccgacctgatcgacgaggaggtgaagagcggcatcaagaagaacagaatcctgatcggcggcttcagcatgggcggctgcatggccatccacctggcctacagaaaccaccaggacgtggccggcgtgttcgccctgagcagcttcctgaacaaggccagcgccgtgtaccaggccctgcagaagagcaacggcgtgctgcccgagctgttccagtgccacggcaccgccgacgagctggtgctgcacagctgggccgaggagaccaacagcatgctgaagagcctgggcgtgaccaccaagttccacagcttccccaacgtgtaccacgagctgagcaagaccgagctggacatcctgaagctgtggatcctgaccaagctgcccggcgagatggagaagcagaagtag

SEQ ID NO: 10602 - DNA, 471 bp, Artificial Sequence
  Description of Artificial Sequence: Synthetic coding sequence
atggagaccgccaaggagatgaccagagagagcctgcccatcaagtgcctggaggccgtgatcctgggcatctacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagggcctgtgcagccactag

SEQ ID NO: 10603 - DNA, 936 bp, Artificial Sequence
  Description of Artificial Sequence: Synthetic coding sequence
atgaccggcagcgccgccgacacccacagatgcccccaccccaagggcgccaagggcaccagaagcagaagcagccacgccagacccgtgagcctggccaccagcggcggcagcgaggaggaggacaaggacggcggcgtgctgttccacgtgaacaagagcggcttccccatcgacagccacacctgggagagaatgtggatgcacgtggccaaggtgcaccccaagggcggcgagatggtgggcgccatcagaaacgccgccttcctggccaagcccagcatcccccaggtgcccaactacagactgagcatgaccatccccgactggctgcaggccatccagaactacatgaagaccctgcactacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagatcctgaagcccgccagcgcccacagccccacccaggtgagaagcagaggcaagagcctgagccccagaagaagacaggccagcccccccagaagactgggcagaagagagaagagccccgccctgcccgagaagaaggtggccgacctgagcaccctgaacgaggtgggctaccagatcagaatctag

SEQ ID NO: 10604 - DNA, 873 bp, Artificial Sequence
  Description of Artificial Sequence: Synthetic coding sequence
atgtggatgcacgtggccaaggtgcaccccaagggcggcgagatggtgggcgccatcagaaacgccgccttcctggccaagcccagcatcccccaggtgcccaactacagactgagcatgaccatccccgactggctgcaggccatccagaactacatgaagaccctgcagtacaaccacaccggcacccagttcttcgagatcagaaagatgagacccctgagcggcctgatggagaccgccaaggagatgaccagagagagcctgcccatcaagtgcctggaggccgtgatcctgggcatctacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagatcctgaagcccgccagcgcccacagccccacccaggtgagaagcagaggcaagagcctgagccccagaagaagacaggccagcccccccagaagactgggcagaagagagaagagccccgccctgcccgagaagaaggtggccgacctgagcaccctgaacgaggtgggctaccagatcagaatctag

SEQ ID NO: 10605 - DNA, 756 bp, Artificial Sequence
  Description of Artificial Sequence: Synthetic coding sequence
atgaccatccccgactggctgcaggccatccagaactacatgaagaccctgcagtacaaccacaccggcacccagttcttcgagatcagaaagatgagacccctgagcggcctgatggagaccgccaaggagatgaccagagagagcctgcccatcaagtgcctggaggccgtgatcctgggcatctacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagatcctgaagcccgccagcgcccacagccccacccaggtgagaagcagaggcaagagcctgagccccagaagaagacaggccagcccccccagaagactgggcagaagagagaagagccccgccctgcccgagaagaaggtggccgacctgagcaccctgaacgaggtgggctaccagatcagaatctag

SEQ ID NO: 10606 - DNA, 873 bp, Artificial Sequence; identical to SEQ ID NO: 10604
  Description of Artificial Sequence: Synthetic coding sequence

SEQ ID NO: 10607 - DNA, 723 bp, Artificial Sequence
  Description of Artificial Sequence: Synthetic coding sequence
atggccggcagccccgagctggtggtgctggaccccccctgggacaaggagctggccgccggcaccgagagccaggccctggtgagcgccacccccagagaggacttcagagtgagatgcaccagcaagagagccgtgaccgagatgctgcagctgtgcggcagattcgtgcagaagctgggcgacgccctgcccgaggagatcagagagcccgccctgagagacgcccagtggaccttcgagagcgccgtgcaggagaacatcagcatcaacggccaggcctggcaggaggccagcgacaactgcttcatggacagcgacatcaaggtgctggaggaccagttcgacgagatcatcgtggacatcgccaccaagagaaagcagtaccccagaaagatcctggagtgcgtgatcaagaccatcaaggccaagcaggagatcctgagcctgcccgccctgatcgagcagggcgagggcttcagccaggtgctgagaatgcagcccgtgatccacctgcagagaatccaccaggaggtgttcagcagctgccacagaaagcccgacgccaagcccgagaacttcatcacccagatcgagaccacccccaccgagaccgccagcagaaagaccagcgacatggtgctgaagagaaagcagaccaaggactgcccccagagaaagtggtaccccctgagacccaagaagatcaacctggacacctag

SEQ ID NO: 10608 - DNA, 519 bp, Artificial Sequence
  Description of Artificial Sequence: Synthetic coding sequence
atggccggcagccccgagctggtggtgctggaccccccctgggacaaggagctggccgccggcaccgagagccaggccctggtgagcgccacccccagagaggacttcagagtgagatgcaccagcaagagagccgtgaccgagatgctgcagctgtgcggcagattcgtgcagaagctgggcgacgccctgcccgaggagatcagagagcccgccctgagagacgcccagtggaccttcgagagcgccgtgcaggagaacatcagcatcaacggccaggcctggcaggaggccagcgacaactgcttcatggacagcgacatcaaggtgctggaggaccagttcgacgagatcatcgtggacatcgccaccaagagaaagcagtaccccagaaagatcctggagtgcgtgatcaagaccatcaaggccaagcaggagatcctgaagcagtaccaccccgtggtgcaccccctggacctgaagtacgaccccgaccccgtgctggcctgcatcaactag

SEQ ID NO: 10609 - DNA, 846 bp, Artificial Sequence
  Description of Artificial Sequence: Synthetic coding sequence
atggccggcagccccgagctggtggtgctggaccccccctgggacaaggagctggccgccggcaccgagagccaggccctggtgagcgccacccccagagaggacttcagagtgagatgcaccagcaagagagccgtgaccgagatgctgcagctgtgcggcagattcgtgcagaagctgggcgacgccctgcccgaggagatcagagagcccgccctgagagacgcccagtggaccttcgagagcgccgtgcaggagaacatcagcatcaacggccaggcctggcaggaggccagcgacaactgcttcatggacagcgacatcaaggtgctggaggaccagttcgacgagatcatcgtggacatcgccaccaagagaaagcagtaccccagaaagatcctggagtgcgtgatcaagaccatcaaggccaagcaggagatcctgaagcagtaccaccccgtggtgcaccccctggacctgaagtacgaccccgaccccgccccccacatggagaacctgaagtgcagaggcgagaccgtggccaaggagatcagcgaggccatgaagagcctgcccgccctgatcgagcagggcgagggcttcagccaggtgctgagaatgcagcccgtgatccacctgcagagaatccaccaggaggtgttcagcagctgccacagaaagcccgacgccaagcccgagaacttcatcacccagatcgagaccacccccaccgagaccgccagcagaaagaccagcgacatggtgctgaagagaaagcagaccaaggactgcccccagagaaagtggtaccccctgagacccaagaagatcaacctggacacctag

SEQ ID NO: 10610 - DNA, 228 bp, Artificial Sequence
  Description of Artificial Sequence: Synthetic coding sequence
atggacagcgacatcaaggtgctggaggaccagttcgacgagatcatcgtggacatcgccaccaagagaaagcagtaccccagaaagatcctggagtgcgtgatcaagaccatcaaggccaagcaggagatcctgaagcagtaccaccccgtggtgcaccccctggacctgaagtacgaccccgaccccggcgccaagcccggcggcctggccctgggcgccgtgtag

SEQ ID NO: 10611 - DNA, 279 bp, Artificial Sequence
  Description of Artificial Sequence: Synthetic coding sequence
atggaggactaccaggccgccgaggagaccgccttcgtggtggacgaggtgagcaacatcgtgaaggaggccatcgagagcgccatcggcggcaacgcctaccagcacagcaaggtgaaccagtggaccaccaacgtggtggagcagaccctgagccagctgaccaagctgggcaagcccttcaagtacatcggcaacggcgtgctgttcctgctgtacctgagagacggcttcctgaccctgatcagaggcgccagcagcaccagaaacaacagctag

SEQ ID NO: 10612 - DNA, 204 bp, Artificial Sequence
  Description of Artificial Sequence: Synthetic coding sequence
atgcagaagaacggcgccggcctgcacaccgccagcagctgcttctgggacagcagcaccgacggcatgatcttcatccacgtgtgcgaggtgctgctgtgcgagatctacgactggaagttccccatcttcgagtgcaacgcctgcctgagccccttcaagaccttcaacaacagactggccaaggtgctgtgcgtggcctag

SEQ ID NO: 10613 - DNA, 342 bp, Artificial Sequence
  Description of Artificial Sequence: Synthetic coding sequence
atggaggactaccaggccgccgaggagaccgccttcgtggtggacgaggtgagcaacatcgtgaaggaggccatcgagagcgccatcggcggcaacgcctaccagcacagcaaggtgaaccagtggaccaccaacgtggtggagcagaccctgagccagctgaccaagctgggcaagcccttcaagtacatcgtgacctgcgtgatcatgcagaagaacggcgccggcctgcacaccgccagcagctgcttctgggacagcagcaccgacggcagctgcaccgtgagatgggagaacaagaccatgtactgcatcgtgagcgccttcggcctgagcatctag

SEQ ID NO: 10614 - DNA, 2037 bp, Artificial Sequence
  Description of Artificial Sequence: Synthetic coding sequence
atgtacgccgccgtggagcacggccccgtgctgtgcagcgacagcaacatcctgtgcctgagctggaagggcagagtgcccaagagcgagaaggagaagcccgtgtgcagaagaagatactacgaggagggctggctggccaccggcaacggcagaggcgtggtgggcgtgaccttcaccagcagccactgcagaagagacagaagcaccccccagagaatcaacttcaacctgagaggccacaacagcgaggtggtgctggtgagatggaacgagccctaccagaagctggccacctgcgacgccgacggcggcatcttcgtgtggatccagtacgagggcagatggagcgtggagctggtgaacgacagaggcgcccaggtgagcgacttcacctggagccacgacggcacccaggccctgatcagctacagagacggcttcgtgctggtgggcagcgtgagcggccagagacactggagcagcgagatcaacctggagagccagatcacctgcggcatctggacccccgacgaccagcaggtgctgttcggcaccgccgacggccaggtgatcgtgatggactgccacggcagaatgctggcccacgtgctgctgcacgagagcgacggcgtgctgggcatgagctggaactaccccatcttcctggtggaggacagcagcgagagcgacaccgacagcgacgactacgcccccccccaggacggccccgccgcctaccccatccccgtgcagaacatcaagcccctgctgaccgtgagcttcaccagcggcgacatcagcctgatgaacaactacgacgacctgagccccaccgtgatcagaagcggcctgaaggaggtggtggcccagtggtgcacccagggcgacctgctggccgtggccggcatggagagacagacccagctgggcgagctgcccaacggccccctgctgaagagcgccatggtgaagttctacaacgtgagaggcgagcacatcttcaccctggacaccctggtgcagagacccatcatcagcatctgctggggccacagagacagcagactgctgatggccagcggccccgccctgtacgtggtgagagtggagcacagagtgagcagcctgcagctgctgtgccagcaggccatcgccagcaccctgagagaggacaaggacgtgagcaagctgaccctgccccccagactgtgcagctacctgagcaccgccttcatccccaccatcaagccccccatccccgaccccaacaacatgagagacttcgtgagctaccccagcgccggcaacgagagactgcactgcaccatgaagagaaccgaggacgaccccgaggtgggcggcccctgctacaccctgtacctggagtacctgggcggcctggtgcccatcctgaagggcagaagaatcagcaagctgagacccgagttcgtgatcatggaccccagaaccgacagcaagcccgacgagatctacggcaacagcctgatcagcaccgtgatcgacagctgcaactgcagcgacagcagcgacatcgagctgagcgacgactgggccgccaagaagagccccaagatcagcagagccagcaagagccccaagctgcccagaatcagcatcgaggccagaaagagccccaagctgcccagagccgcccaggagctgagcagaagccccagactgcccctgagaaagcccagcgtgggcagccccagcctgaccagaagagagttccccttcgaggacatcacccagcacaactacctggcccaggtgaccagcaacatctggggcaccaagttcaagatcgtgggcctggccgccttcctgcccaccaacctgggcgccgtgatctacaagaccagcctgctgcacctgcagcccagacagatgaccatctacctgcccgaggtgagaaagatcagcatggactacatcaacctgcccgtgttcaaccccaacgtgttcagcgaggacgaggacgacctgcccggcgacgccgtgtggaccgactag

SEQ ID NO: 10615 - DNA, 4632 bp, Artificial Sequence
  Description of Artificial Sequence: Synthetic coding sequence
atgtacgccgccgtggagcacggccccgtgctgtgcagcgacagcaacatcctgtgcctgagctggaagggcagagtgcccaagagcgagaaggagaagcccgtgtgcagaagaagatactacgaggagggctggctggccaccggcaacggcagaggcgtggtgggcgtgaccttcaccagcagccactgcagaagagacagaagcaccccccagagaatcaacttcaacctgagaggccacaacagcgaggtggtgctggtgagatggaacgagccctaccagaagctggccacctgcgacgccgacggcggcatcttcgtgtggatccagtacgagggcagatggagcgtggagctggtgaacgacagaggcgcccaggtgagcgacttcacctggagccacgacggcacccaggccctgatcagctacagagacggcttcgtgctggtgggcagcgtgagcggccagagacactggagcagcgagatcaacctggagagccagatcacctgcggcatctggacccccgacgaccagcaggtgctgttcggcaccgccgacggccaggtgatcgtgatggactgccacggcagaatgctggcccacgtgctgctgcacgagagcgacggcgtgctgggcatgagctggaactaccccatcttcctggtggaggacagcagcgagagcgacaccgacagcgacgactacgcccccccccaggacggccccgccgcctaccccatccccgtgcagaacatcaagcccctgctgaccgtgagcttcaccagcggcgacatcagcctgatgaacaactacgacgacctgagccccaccgtgatcagaagcggcctgaaggaggtggtggcccagtggtgcacccagggcgacctgctggccgtggccggcatggagagacagacccagctgggcgagctgcccaacggccccctgctgaagagcgccatggtgaagttctacaacgtgagaggcgagcacatcttcaccctggacaccctggtgcagagacccatcatcagcatctgctggggccacagagacagcagactgctgatggccagcggccccgccctgtacgtggtgagagtggagcacagagtgagcagcctgcagctgctgtgccagcaggccatcgccagcaccctgagagaggacaaggacgtgagcaagctgaccctgccccccagactgtgcagctacctgagcaccgccttcatccccaccatcaagccccccatccccgaccccaacaacatgagagacttcgtgagctaccccagcgccggcaacgagagactgcactgcaccatgaagagaaccgaggacgaccccgaggtgggcggcccctgctacaccctgtacctggagtacctgggcggcctggtgcccatcctgaagggcagaagaatcagcaagctgagacccgagttcgtgatcatggaccccagaaccgacagcaagcccgacgagatctacggcaacagcctgatcagcaccgtgatcgacagctgcaactgcagcgacagcagcgacatcgagctgagcgacgactgggccgccaagaagagccccaagatcagcagagccagcaagagccccaagctgcccagaatcagcatcgaggccagaaagagccccaagctgcccagagccgcccaggagctgagcagaagccccagactgcccctgagaaagcccagcgtgggcagccccagcctgaccagaagagagttccccttcgaggacatcacccagcacaactacctggcccaggtgaccagcaacatctggggcaccaagttcaagatcgtgggcctggccgccttcctgcccaccaacctgggcgccgtgatctacaagaccagcctgctgcacctgcagcccagacagatgaccatctacctgcccgaggtgagaaagatcagcatggactacatcaacctgcccgtgttcaaccccaacgtgttcagcgaggacgaggacgacctgcccgtgaccggcgccagcggcgtgcccgagaacagccccccctgcaccgtgaacatccccatcgcccccatccacagcagcgcccaggccatgagccccacccagagcatcggcctggtgcagagcctgctggccaaccagaacgtgcagctggacgtgctgaccaaccagaccaccgccgtgggcaccgccgagcacgccggcgacagcgccacccagtaccccgtgagcaacagatacagcaaccccggccaggtgatcttcggcagcgtggagatgggcagaatcatccagaaccccccccccctgagcctgcccccccccccccagggccccatgcagctgagcaccgtgggccacggcgacagagaccacgagcacctgcagaagagcgccaaggccctgagacccaccccccagctggccgccgagggcgacgccgtggtgttcagcgccccccaggaggtgcaggtgaccaagatcaaccccccccccccctaccccggcaccatccccgccgcccccaccaccgccgccccccccccccccctgccccccccccagccccccgtggacgtgtgcctgaagaagggcgacttcagcctgtaccccaccagcgtgcactaccagacccccctgggctacgagagaatcaccaccttcgacagcagcggcaacgtggaggaggtgtgcagacccagaaccagaatgctgtgcagccagaacacctacaccctgcccggccccggcagcagcgccaccctgagactgaccgccaccgagaagaaggtgccccagccctgcagcagcgccaccctgaacagactgaccgtgcccagatacagcatccccaccggcgacccccccccctaccccgagatcgccagccagctggcccagggcagaggcgccgcccagagaagcgacaacagcctgatccacgccaccctgagaagaaacaacagagaggccaccctgaagatggcccagctggccgacagccccagagcccccctgcagcccctggccaagagcaagggcggccccggcggcgtggtgacccagctgcccgccagacccccccccgccctgtacacctgcagccagtgcagcggcaccggccccagcagccagcccggcgccagcctggcccacaccgccagcgccagccccctggccagccagagcagctacagcctgctgagcccccccgacagcgccagagacagaaccgactacgtgaacagcgccttcaccgaggacgaggccctgagccagcactgccagctggagaagcccctgagacacccccccctgcccgaggccgccgtgaccctgaagagaccccccccctaccagtgggaccccatgctgggcgaggacgtgtgggtgccccaggagagaaccgcccagaccagcggccccaaccccctgaagctgagcagcctgatgctgagccagggccagcacctggacgtgagcagactgcccttcatcagccccaagagccccgccagccccaccgccaccttccagaccggctacggcatgggcgtgccctaccccggcagctacaacaacccccccctgcccggcgtgcaggccccctgcagccccaaggacgccctgagccccacccagttcgcccagcaggagcccgccgtggtgctgcagcccctgtacccccccagcctgagctactgcaccctgccccccatgtaccccggcagcagcacctgcagcagcctgcagctgccccccgtggccctgcacccctggagcagctacagcgcctgcccccccatgcagaacccccagggcaccctgccccccaagccccacctggtggtggagaagcccctggtgagccccccccccgccgacctgcagagccacctgggcaccgaggtgatggtggagaccgccgacaacttccaggaggtgctgagcctgaccgagagccccgtgccccagagaaccgagaagttcggcaagaagaacagaaagagactggacagcagagccgaggagggcagcgtgcaggccatcaccgagggcaaggtgaagaaggaggccagaaccctgagcgacttcaacagcctgatcagcagcccccacctgggcagagagaagaagaaggtgaagagccagaaggaccagctgaagagcaagaagctgaacaagaccaacgagttccaggacagcagcgagagcgagcccgagctgttcatcagcggcgacgagctgatgaaccagagccagggcagcagaaagggctggaagagcaagagaagccccagagccgccggcgagctggaggaggccaagtgcagaagagccagcgagaaggaggacggcagactgggcagccagggcttcgtgtacgtgatggccaacaagcagcccctgtggaacgaggccacccaggtgtaccagctggacttcggcggcagagtgacccaggagagcgccaagaacttccagatcgagctggagggcagacaggtgatgcagttcggcagaatcgacggcagcgcctacatcctggacttccagtaccccttcagcgccgtgcaggccttcgccgtggccctggccaacgtgacccagagactgaagtag

SEQ ID NO: 10616 - DNA, 3234 bp, Artificial Sequence
  Description of Artificial Sequence: Synthetic coding sequence
atggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccagatcttcgacagcagcggcagccacggcttcagcggcacccagctgccccagaacagcagcaacagcagcgaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 10617 - DNA, 579 bp, Artificial Sequence
  Description of Artificial Sequence: Synthetic coding sequence
atgagccagtgcgcctgcctggaggaggtgcacctgcccaacatcaagcccggcgagggcctgggcatgtacatcaagagcacctacgacggcctgcacgtgatcaccggcaccaccgagaacgtgggctggcagctgaagaacctggtgaagaagctgagagagaaccccaccggcgtggtgctgctgctgaagaagagacccaccggcagcttcaacttcacccccgcccccctgaagaacctgagatggaagccccccctggtgcagaccagccccccccccgccaccacccagagccccgagagcaccatggacaccagcctgaagaaggagaagagcgccatcctggacctgtacatcccccccccccccgccgtgccctacagccccagagacgagaacggcagcttcgtgtacggcggcagcagcaagtgcaagcagcccctgcccggccccaagggcagcgagagccccaacagcttcctggaccaggagagcagaagaagaagattcaccatcgccgacagcgaccagctgcccggctacagcgtggagaccaacatcctgcccacctag

SEQ ID NO: 10618 - DNA, 1668 bp, Artificial Sequence
  Description of Artificial Sequence: Synthetic coding sequence
atggagcccgtgaccaagtggagccccaagcaggtggtggactggaccagaggcctggacgactgcctgcagcagtacgtgcacaagttcgagagagagaagatcaacggcgagcagctgctgcagatcagccaccaggacctggaggagctgggcgtgaccagaatcggccaccaggagctggtgctggaggccgtggacctgctgtgcgccctgaactacggcctggagaccgacaacatgaagaacctggtgctgaagctgagagccagcagccacaacctgcagaactacatcagcagcagaagaaagagccccgcctacgacggcaacaccagcagaaaggcccccaacgagttcctgaccagcgtggtggagctgatcggcgccgccaaggccctgctggcctggctggacagagcccccttcaccggcatcaccgacttcagcgtgaccaagaacaagatcatccagctgtgcctggacctgaccaccaccgtgcagaaggactgcttcgtggccgagatggaggacaaggtgctgaccgtggtgaaggtgctgaacggcatctgcgacaagaccatcagaagcaccaccgaccccgtgatgagccagtgcgcctgcctggaggaggtgcacctgcccaacatcaagcccggcgagggcctgggcatgtacatcaagagcacctacgacggcctgcacgtgatcaccggcaccaccgagaacagccccgccgacagaagccagaagatccacgccggcgacgaggtgatccaggtgaaccagcagaccgtggtgggctggcagctgaagaacctggtgaagaagctgagagagaaccccaccggcgtggtgctgctgctgaagaagagacccaccggcagcttcaacttcacccccgcccccctgaagaacctgagatggaagccccccctggtgcagaccagccccccccccgccaccacccagagccccgagagcaccatggacaccagcctgaagaaggagaagagcgccatcctggacctgtacatcccccccccccccgccgtgccctacagccccagagacgagaacggcagcttcgtgtacggcggcagcagcaagtgcaagcagcccctgcccggccccaagggcagcgagagccccaacagcttcctggaccaggagagcagaagaagaagattcaccatcgccgacagcgaccagctgcccggctacagcgtggagaccaacatcctgcccaccaagatgagagagaagacccccagctacggcaagcccagacccctgagcatgcccgccgacggcaactggatgggcatcgtggaccccttcgccagacccagaggccacggcagaaagggcgaggacgccctgtgcagatacttcagcaacgagagaatcccccccatcatcgaggagagcagcagccccccctacagattcagcagacccaccaccgagagacacctggtgagaggcgccgactacatcagaggcagcagatgctacatcaacagcgacctgcacagcagcgccaccatccccttccaggaggagggcaccaagaagaagagcggcagcagcgccaccaagagcagcagcaccgagcccagcctgctggtgagctggttcaccagactgaagctgctgacccactag

SEQ ID NO: 10619 - DNA, 708 bp, Artificial Sequence
  Description of Artificial Sequence: Synthetic coding sequence
atgagaagcagagtgctgtggggcgccgccagatggctgtggcccagaagagccgtgggccccgccagaagacccctgagcagcggcagcccccccctggaggagctgttcaccagaggcggccccctgagaaccttcctggagagacaggccggcagcgaggcccacctgaaggtgagaagacccgagctgctggccgtgatcaagctgctgaacgagaaggagagagagctgagagagaccgagcacctgctgcacgacgagaacgaggacctgagaaagctggccgagaacgagatcaccctgtgccagaaggagatcacccagctgaagcaccagatcatcctgctgctggtgcccagcgaggagaccgacgagaacgacctgatcctggaggtgaccgccggcgtgggcggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccgactggaagtag

SEQ ID NO: 10620 - DNA, 816 bp, Artificial Sequence
  Description of Artificial Sequence: Synthetic coding sequence
atgagaagcagagtgctgtggggcgccgccagatggctgtggcccagaagagccgtgggccccgccagaagacccctgagcagcggcagcccccccctggaggagctgttcaccagaggcggccccctgagaaccttcctggagagacaggccggcagcgaggcccacctgaaggtgagaagacccgagctgctggccgtgatcaagctgctgaacgagaaggagagagagctgagagagaccgagcacctgctgcacgacgagaacgaggacctgagaaagctggccgagaacgagatcaccctgtgccagaaggagatcacccagctgaagcaccagatcatcctgctgctggtgcccagcgaggagaccgacgagaacgacctgatcctggaggtgaccgccggcgtgggcggccaggaggccatgctgttcaccagcgagatcttcgacatgtaccagcagtacgccgccttcaagagatggcacttcgagaccctggagtacttccccagcgagctgggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccgactggaagtag

SEQ ID NO: 10621 - DNA, 1143 bp, Artificial Sequence
  Description of Artificial Sequence: Synthetic coding sequence
atgagaagcagagtgctgtggggcgccgccagatggctgtggcccagaagagccgtgggccccgccagaagacccctgagcagcggcagcccccccctggaggagctgttcaccagaggcggccccctgagaaccttcctggagagacaggccggcagcgaggcccacctgaaggtgagaagacccgagctgctggccgtgatcaagctgctgaacgagaaggagagagagctgagagagaccgagcacctgctgcacgacgagaacgaggacctgagaaagctggccgagaacgagatcaccctgtgccagaaggagatcacccagctgaagcaccagatcatcctgctgctggtgcccagcgaggagaccgacgagaacgacctgatcctggaggtgaccgccggcgtgggcggccaggaggccatgctgttcaccagcgagatcttcgacatgtaccagcagtacgccgccttcaagagatggcacttcgagaccctggagtacttccccagcgagctgggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccggcgtggtgagcgagtgccagcaggagagaagccagctgaagaacaaggagctggccatgaccaagctgagagccaagctgtacagcatgcacctggaggaggagatcaacaagagacagaacgccagaaagatccagatcggcagcaagggcagaagcgagaagatcagaacctacaacttcccccagaacagagtgaccgaccacagaatcaacaagaccctgcacgacctggagaccttcatgcagggcgactacctgctggacgagctggtgcagagcctgaaggagtacgccgactacgagagcctggtggagatcatcagccagaaggtgtag

SEQ ID NO: 10622 - DNA, 3561 bp, Artificial Sequence
  Description of Artificial Sequence: Synthetic coding sequence
atgtgcgaggtgatgcccaccatcaacgagggcgacagactgggccccccccacggcgccgacgccgacgccaacttcgagcagctgatggtgaacatgctggacgagagagagaagctgctggagagcctgagagagagccaggagaccctggccgccacccagagcagactgcaggacgccatccacgagagagaccagctgcagagacacctgaacagcgccctgccccaggagttcgccaccctgaccagagagctgagcatgtgcagagagcagctgctggagagagaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagccgccctggagagagtgaccaccctggaggagcagctggccggcgcccaccagcaggtgagcgccctgcagcagggcgccggcgtgagagacggcgccgccgaggaggagggcaccgtggagctgggccccaagagactgtggaaggaggacaccggcagagtggaggagctgcaggagctgctggagaagcagaacttcgagctgagccaggccagagagagactggtgaccctgaccaccaccgtgaccgagctggaggaggacctgggcaccgccagaagagacctgatcaagagcgaggagctgagcagcaagcaccagagagacctgagagaggccctggcccagaaggaggacatggaggagagaatcaccaccctggagaagagatacctggccgcccagagagaggccaccagcatccacgacctgaacgacaagctggagaacgagctggccaacaaggagagcctgcacagacagtgcgaggagaaggccagacacctgcaggagctgctggaggtggccgagcagaagctgcagcagaccatgagaaaggccgagaccctgcccgaggtggaggccgagctggcccagagaatcgccgccctgaccaaggccgaggagagacacggcaacatcgaggagcacctgagacagctggagggccagctggaggagaagaaccaggagctggccagagtgagacagagagagaagatgaacgaggaccacaacaagagactgagcgacaccgtggacagactgctgagcgagagcaacgagagactgcagctgcacctgaaggagagaatggccgccctggaggagaagggcagactgagcgaggagatcgagaagctgagacaggaggtggaccagctgaagggcagaggcggccccttcgtggacggcgtgcacagcagaagccacatgggcagcgccgccgacgtgagattcagcctgggcaccaccacccacgccccccccggcgtgcacagaagatacagcgccctgagagaggagagcgccaaggactgggagaccagccccctgcccggcatgctggcccccgccgccggccccgccttcgacagcgaccccgagatcagcgacgtggacgaggacgagcccggcggcctggtgggcagcgccgacgtggtgagccccagcggccacagcgacgcccagaccctggccatgatgctgcaggagcagctggacgccatcaacgaggagatcagaatgatccaggaggagaaggagagcaccgagctgagagccgaggagatcgagaccagagtgaccagcggcagcatggaggccctgaacctgaagcagctgagaaagagaggcagcatccccaccagcctgaccgccctgagcctggccagcgccagcccccccctgagcggcagaagcacccccaagctgaccagcagaagcgccgcccaggacctggacagaatgggcgtgatgaccctgcccagcgacctgagaaagcacagaagaaagctgctgagccccgtgagcagagaggagaacagagaggacaaggccaccatcaagtgcgagaccagcccccccagcagccccagaaccctgagactggagaagctgggccaccccgccctgagccaggaggagggcaagagcgccctggaggaccagggcagcaaccccagcagcagcaacagcagccaggacagcctgcacaagggcgccaagagaaagggcatcaagagcagcatcggcagactgttcggcaagaaggagaagggcagactgatccagctgagcagagacggcgccaccggccacgtgctgctgaccgacagcgagttcagcatgcaggagcccatggtgcccgccaagctgggcacccaggccgagaaggacagaagactgaagaagaagcaccagctgctggaggacgccagaagaaagggcatgcccttcgcccagtgggacggccccaccgtggtgagctggctggagctgtgggtgggcatgcccgcctggtacgtggccgcctgcagagccaacgtgaagagcggcgccatcatgagcgccctgagcgacaccgagatccagagagagatcggcatcagcaacgccctgcacagactgaagctgagactggccatccaggagatggtgagcctgaccagccccagcgccccccccaccagcagaaccagcagcggcaacgtgtgggtgacccacgaggagatggagaccctggagaccagcaccaagaccgacagcgaggagggcagctgggcccagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagaagagaagagaggagagccagcacgagatcaaggacgtgctggtgtggaccaacgaccaggtggtgcactgggtgcagagcatcggcctgagagactacgccggcaacctgcacgagagcggcgtgcacggcgccctgctggccctggacgagaacttcgaccacaacaccctggccctgatcctgcagatccccacccagaacacccaggccagacaggtgatggagagagagttcaacaacctgctggccctgggcaccgacagaaagctggacgacggcgacgacaaggtgttcagaagagcccccagctggagaaagagattcagacccagagagcaccacggcagaggcggcatgctgagcgccagcgccgagaccctgcccgccggcttcagagtgagcaccctgggcaccctgcagcccccccccgccccccccaagaagatcatgcccgaggcccacagccactacctgtacggccacatgctgagcgccttcagagactag

SEQ ID NO: 10623 - DNA, 1803 bp, Artificial Sequence
  Description of Artificial Sequence: Synthetic coding sequence
atgagcagagtggccaagtacagaagacaggtgagcgaggaccccgacatcgacagcctgctggagaccctgagccccgaggagatggaggagctggagaaggagctggacgtggtggaccccgacggcagcgtgcccgtgggcctgagacagagaaaccagaccgagaagcagagcaccggcgtgtacaacagagaggccatgctgaacttctgcgagaaggagaccaagaagctgatgcagagagagatgagcatggacgagagcaagcaggtggagaccaagaccgacgccaagaacggcgaggagagaggcagagacgccagcaagaaggccctgggccccagaagagacagcgacctgggcaaggagcccaagagaggcggcctgaagaagagcttcagcagagacagagacgaggccggcggcaagagcggcgagaagcccaaggaggagaagatcatcagaggcatcgacaagggcagagtgagagccgccgtggacaagaaggaggccggcaaggacggcagaggcgaggagagagccgtggccaccaagaaggaggaggagaagaagggcagcgacagaaacaccggcctgagcagagacaaggacaagaagagagaggagatgaaggaggtggccaagaaggaggacgacgagaaggtgaagggcgagagaagaaacaccgacaccagaaaggagggcgagaagatgaagagagccggcggcaacaccgacatgaagaaggaggacgagaaggtgaagagaggcaccggcaacaccgacaccaagaaggacgacgagaaggtgaagaagaacgagcccctgcacgagaaggaggccaaggacgacagcaagaccaagacccccgagaagcagacccccagcggccccaccaagcccagcgagggccccgccaaggtggaggaggaggccgcccccagcatcttcgacgagcccctggagagagtgaagaacaacgaccccgagatgaccgaggtgaacgtgaacaacagcgactgcatcaccaacgagatcctggtgagattcaccgaggccctggagttcaacaccgtggtgaagctgttcgccctggccaacaccagagccgacgaccacgtggccttcgccatcgccatcatgctgaaggccaacaagaccatcaccagcctgaacctggacagcaaccacatcaccggcaagggcatcctggccatcttcagagccctgctgcagaacaacaccctgaccgagctgagattccacaaccagagacacatctgcggcggcaagaccgagatggagatcgccaagctgctgaaggagaacaccaccctgctgaagctgggctaccacttcgagctggccggccccagaatgaccgtgaccaacctgctgagcagaaacatggacaagcagagacagaagagactgcaggagcagagacaggcccaggaggccaagggcgagaagaaggacctgctggaggtgcccaaggccggcgccgtggccaagggcagccccaagcccagcccccagcccagccccaagcccagccccaagaacagccccaagaagggcggcgcccccgccgcccccccccccccccccccccccctggccccccccctgatcatggagaacctgaagaacagcctgagccccgccacccagagaaagatgggcgacaaggtgctgcccgcccaggagaagaacagcagagaccagctgctggccgccatcagaagcagcaacctgaagcagctgaagaaggtggaggtgcccaagctgctgcagtag

SEQ ID NO: 10624 - DNA, 828 bp, Artificial Sequence
  Description of Artificial Sequence: Synthetic coding sequence
atgggcaccagactgcccctggtgctgagacagctgagaagacccccccagccccccggcccccccagaagactgagagtgccctgcagagccagcagcggcggcggcggcggcggcggcggcggcagagagggcctgctgggccagagaagaccccaggacggccaggccagaagcagctgcagccccggcggcagaacccccgccgccagagacagcatcgtgagagaggtgatccagaacagcaaggaggtgctgagcctgctgcaggagaagaaccccgccttcaagcccgtgctggccatcatccaggccggcgacgacaacctgatgcaggagatcaaccagaacctggccgaggaggccggcctgaacatcacccacatctgcctgccccccgacagcagcgaggccgagatcatcgacgagatcctgaagatcaacgaggacaccagagtgcacggcctggccctgcagatcagcgagaacctgttcagcaacaaggtgctgaacgccctgaagcccgagaaggacgtggacggcgtgaccgacatcaacctgggcaagctggtgagaggcgacgcccacgagtgcttcgtgagccccgtggccaaggccgtgatcgagctgctggagaagagcggcgtgaacctggacggcaagaagatcctggtggtgggcgcccacggcagcctggaggccgccctgcagtgcctgttccagagaaagggcagcatgaccatgagcatccagtggaagaccagacagctgcagagcaagaccgagagcagaagcgtgaccagactggagtgcagaagagtgatctag

SEQ ID NO: 10625 - DNA, 999 bp, Artificial Sequence
  Description of Artificial Sequence: Synthetic coding sequence
tgaggcagagagggcctgctgggccagagaagaccccaggacggccaggccagaagcagctgcagccccggcggcagaacccccgccgccagagacagcatcgtgagagaggtgatccagaacagcaaggaggtgctgagcctgctgcaggagaagaaccccgccttcaagcccgtgctggccatcatccaggccggcgacgacaacctgatgcaggagatcaaccagaacctggccgaggaggccggcctgaacatcacccacatctgcctgccccccgacagcagcgaggccgagatcatcgacgagatcctgaagatcaacgaggacaccagagtgcacggcctggccctgcagatcagcgagaacctgttcagcaacaaggtgctgaacgccctgaagcccgagaaggacgtggacggcgtgaccgacatcaacctgggcaagctggtgagaggcgacgcccacgagtgcttcgtgagccccgtggccaaggccgtgatcgagctgctggagaagagcgtgggcgtgaacctggacggcaagaagatcctggtggtgggcgcccacggcagcctggaggccgccctgcagtgcctgttccagagaaagggcagcatgaccatgagcatccagtggaagaccagacagctgcagagcaagctgcacgaggccgacatcgtggtgctgggcagccccaagcccgaggagatccccctgacctggatccagcccggcaccaccgtgctgaactgcagccacgacttcctgagcggcaaggtgggctgcggcagccccagaatccacttcggcggcctgatcgaggaggacgacgtgatcctgctggccgccgccctgagaatccagaacatggtgagcagcggcagaagatggctgagagagcagcagcacagaagatggagactgcactgcctgaagctgcagcccctgagccccgtgcccagcgacatcgagatcagcagaggccagaccccctag

SEQ ID NO: 10626 - DNA, 2937 bp, Artificial Sequence
  Description of Artificial Sequence: Synthetic coding sequence
atgggcaccagactgcccctggtgctgagacagctgagaagacccccccagccccccggcccccccagaagactgagagtgccctgcagagccagcagcggcggcggcggcggcggcggcggcggcagagagggcctgctgggccagagaagaccccaggacggccaggccagaagcagctgcagccccggcggcagaacccccgccgccagagacagcatcgtgagagaggtgatccagaacagcaaggaggtgctgagcctgctgcaggagaagaaccccgccttcaagcccgtgctggccatcatccaggccggcgacgacaacctgatgcaggagatcaaccagaacctggccgaggaggccggcctgaacatcacccacatctgcctgccccccgacagcagcgaggccgagatcatcgacgagatcctgaagatcaacgaggacaccagagtgcacggcctggccctgcagatcagcgagaacctgttcagcaacaaggtgctgaacgccctgaagcccgagaaggacgtggacggcgtgaccgacatcaacctgggcaagctggtgagaggcgacgcccacgagtgcttcgtgagccccgtggccaaggccgtgatcgagctgctggagaagagcggcgtgaacctggacggcaagaagatcctggtggtgggcgcccacggcagcctggaggccgccctgcagtgcctgttccagagaaagggcagcatgaccatgagcatccagtggaagaccagacagctgcagagcaagctgcacgaggccgacatcgtggtgctgggcagccccaagcccgaggagatccccctgacctggatccagcccggcaccaccgtgctgaactgcagccacgacttcctgagcggcaaggtgggctgcggcagccccagaatccacttcggcggcctgatcgaggaggacgacgtgatcctgctggccgccgccctgagaatccagaacatggtgagcagcggcagaagatggctgagagagcagcagcacagaagatggagactgcactgcctgaagctgcagcccctgagccccgtgcccagcgacatcgagatcagcagaggccagacccccaaggccgtggacgtgctggccaaggagatcggcctgctggccgacgagatcgagatctacggcaagagcaaggccaaggtgagactgagcgtgctggagagactgaaggaccaggccgacggcaagtacgtgctggtggccggcatcacccccacccccctgggcgagggcaagagcaccgtgaccatcggcctggtgcaggccctgaccgcccacctgaacgtgaacagcttcgcctgcctgagacagcccagccagggccccaccttcggcgtgaagggcggcgccgccggcggcggctacgcccaggtgatccccatggaggagttcaacctgcacctgaccggcgacatccacgccatcaccgccgccaacaacctgctggccgccgccatcgacaccagaatcctgcacgagaacacccagaccgacaaggccctgtacaacagactggtgcccctggtgaacggcgtgagagagttcagcgagatccagctggccagactgaagaagctgggcatcaacaagaccgaccccagcaccctgaccgaggaggaggtgagcaagttcgccagactggacatcgaccccagcaccatcacctggcagagagtgctggacaccaacgacagattcctgagaaagatcaccatcggccagggcaacaccgagaagggccactacagacaggcccagttcgacatcgccgtggccagcgagatcatggccgtgctggccctgaccgacagcctggccgacatgaaggccagactgggcagaatggtggtggccagcgacaagagcggccagcccgtgaccgccgacgacctgggcgtgaccggcgccctgaccgtgctgatgaaggacgccatcaagcccaacctgatgcagaccctggagggcacccccgtgttcgtgcacgccggccccttcgccaacatcgcccacggcaacagcagcgtgctggccgacaagatcgccctgaagctggtgggcgaggagggcttcgtggtgaccgaggccggcttcggcgccgacatcggcatggagaagttcttcaacatcaagtgcagagccagcggcctggtgcccaacgtggtggtgctggtggccaccgtgagagccctgaagatgcacggcggcggccccagcgtgaccgccggcgtgcccctgaagaaggagtacaccgaggagaacatccagctggtggccgacggctgctgcaacctgcagaagcagatccagatcacccagctgttcggcgtgcccgtggtggtggccctgaacgtgttcaagaccgacaccagagccgagatcgacctggtgtgcgagctggccaagagagccggcgccttcgacgccgtgccctgctaccactggagcgtgggcggcaagggcagcgtggacctggccagagccgtgagagaggccgccagcaagagaagcagattccagttcctgtacgacgtgcaggtgcccatcgtggacaagatcagaaccatcgcccaggccgtgtacggcgccaaggacatcgagctgagccccgaggcccaggccaagatcgacagatacacccagcagggcttcggcaacctgcccatctgcatggccaagacccacctgagcctgagccaccagcccgacaagaagggcgtgcccagagacttcatcctgcccatcagcgacgtgagagccagcatcggcgccggcttcatctaccccctggtgggcaccatgagcaccatgcccggcctgcccaccagaccctgcttctacgacatcgacctggacaccgagaccgagcaggtgaagggcctgttctag

SEQ ID NO: 10627 - DNA, 408 bp, Artificial Sequence
  Description of Artificial Sequence: Synthetic coding sequence
atgatccccaacggctacctgatgttcgaggacgagaacttcatcgagagcagcgtggccaagctgaacgccctgagaaagagcggccagttctgcgacgtgagactgcaggtgtgcggccacgagatgctggcccacagagccgtgctggcctgctgcagcccctacctgttcgagatcttcaacagcgacagcgacccccacggcatcagccacgtgaagttcgacgacctgaaccccgaggccgtggaggtgctgctgaactacgcctacaccgcccagctgaaggccgacaaggagctggtgaaggacgtgtacagcgccgccaagaagctgaagatggacagagtgaagcagcacctgctgtacttctgcctgcacagcaccagcaccagcagcctgctgtag

SEQ ID NO: 10628 - DNA, 1929 bp, Artificial Sequence
  Description of Artificial Sequence: Synthetic coding sequence
atgatccccaacggctacctgatgttcgaggacgagaacttcatcgagagcagcgtggccaagctgaacgccctgagaaagagcggccagttctgcgacgtgagactgcaggtgtgcggccacgagatgctggcccacagagccgtgctggcctgctgcagcccctacctgttcgagatcttcaacagcgacagcgacccccacggcatcagccacgtgaagttcgacgacctgaaccccgaggccgtggaggtgctgctgaactacgcctacaccgcccagctgaaggccgacaaggagctggtgaaggacgtgtacagcgccgccaagaagctgaagatggacagagtgaagcaggtgtgcggcgactacctgctgagcagaatggacgtgaccagctgcatcagctacagaaacttcgccagctgcatgggcgacagcagactgctgaacaaggtggacgcctacatccaggagcacctgctgcagatcagcgaggaggaggagttcctgaagctgcccagactgaagctggaggtgatgctggaggacaacgtgtgcctgcccagcaacggcaagctgtacaccaaggtgatcaactgggtgcagagaagcatctgggagaacggcgacagcctggaggagctgatggaggaggtgcagaccctgtactacagcgccgaccacaagctgctggacggcaacctgctggacggccaggccgaggtgttcggcagcgacgacgaccacatccagttcgtgcagaagaagccccccagagagaacggccacaagcagatcagcagcagcagcaccggctgcctgagcagccccaacgccaccgtgcagagccccaagcacgagtggaagatcgtggccagcgagaagaccagcaacaacacctacctgtgcctggccgtgctggacggcatcttctgcgtgatcttcctgcacggcagaaacagcccccagagcagccccaccagcacccccaagctgagcaagagcctgagcttcgagatgcagcaggacgagctgatcgagaagcccatgagccccatgcagtacgccagaagcggcctgggcaccgccgagatgaacggcaagctgatcgccgccggcggctacaacagagaggagtgcctgagaaccgtggagtgctacaacccccacaccgaccactggagcttcctggcccccatgagaacccccagagccagattccagatggccgtgctgatgggccagctgtacgtggtgggcggcagcaacggccacagcgacgacctgagctgcggcgagatgtacgacagcaacatcgacgactggatccccgtgcccgagctgagaaccaacagatgcaacgccggcgtgtgcgccctgaacggcaagctgtacatcgtgggcggcagcgacccctacggccagaagggcctgaagaactgcgacgtgttcgaccccgtgaccaagctgtggaccagctgcgcccccctgaacatcagaagacaccagagcgccgtgtgcgagctgggcggctacctgtacatcatcggcggcgccgagagctggaactgcctgaacaccgtggagagatacaaccccgagaacaacacctggaccctgatcgcccccatgaacgtggccagaagaggcgccggcgtggccgtgctgaacggcaagctgttcgtgtgcggcggcttcgacggcagccacgccatcagctgcgtggagatgtacgaccccaccagaaacgagtggaagatgatgggcaacatgaccagccccagaagcaacgccggcatcgccaccgtgggcaacaccatctacgccgtgggcggcttcgacggcaacgagttcctgaacaccgtggaggtgtacaacctggagagcaacgagtggagcccctacaccaagatcttccagttctag

SEQ ID NO: 10629 - DNA, 408 bp, Artificial Sequence
  Description of Artificial Sequence: Synthetic coding sequence
atgagcaagaacaccgtgagcagcgccagattcagaaaggtggacgtggacgagtacgacgagaacaagttcgtggacgaggaggacggcggcgacggccaggccggccccgacgagggcgaggtggacagctgcctgagacagggcaacatgaccgccgccctgcaggccgccctgaagaacccccccatcaacaccaagagccaggccgtgaaggacagagccggcagcatcgtgctgaaggtgctgatcagcttcaaggccaacgacatcgagaaggccgtgcagagcctggacaagaacggcgtggacctgctgatgaagtacatctacaagggcttcgagagccccagcgacaacagcagcgccatgctgctgcagtggcacgagaaggtgcccctggtgtag

SEQ ID NO: 10630 - DNA, 849 bp, Artificial Sequence
  Description of Artificial Sequence: Synthetic coding sequence
atggccagcagcttcctgcccgccggcgccatcaccggcgacagcggcggcgagctgagcagcggcgacgacagcggcgaggtggagttcccccacagccccgagatcgaggagaccagctgcctggccgagctgttcgagaaggccgccgcccacctgcagggcctgatccaggtggccagcagagagcagctgctgtacctgtacgccagatacaagcaggtgaaggtgggcaactgcaacacccccaagcccagcttcttcgacttcgagggcaagcagaagtgggaggcctggaaggccctgggcgacagcagccccagccaggccatgcaggagtacatcgccgtggtgaagaagctggaccccggctggaacccccagatccccgagaagaagggcaaggaggccaacaccggcttcggcggccccgtgatcagcagcctgtaccacgaggagaccatcagagaggaggacaagaacatcttcgactactgcagagagaacaacatcgaccacatcaccaaggccatcaagagcaagaacgtggacgtgaacgtgaaggacgaggagggcagagccctgctgcactgggcctgcgacagaggccacaaggagctggtgaccgtgctgctgcagcacagagccgacatcaactgccaggacaacgagggccagaccgccctgcactacgccagcgcctgcgagttcctggacatcgtggagctgctgctgcagagcggcgccgaccccaccctgagagaccaggacggctgcctgcccgaggaggtgaccggctgcaagaccgtgagcctggtgctgcagagacacaccaccggcaaggcctag

SEQ ID NO: 10631 - DNA, 9354 bp, Artificial Sequence
  Description of Artificial Sequence: Synthetic coding sequence
atgagaagcagcaagagcaaggaggtgcccctgcccaaccccagaaacagccagagcaaggacaccgtgcaggccgacatcaccaccagctgggacgccctgagccagaccaaggccgccctgagacacatcgagaacaagctggaggtggcccccaccagcaccgccgtgtgcgacagcgtgatggacaccaagaagagcagcaccagcgccaccagaaagatcagcagaaaggacggcagatacctggacgacagctgggtgaacgcccccatcagcaagagcaccaagagcagaaaggagaagagcagaagccccctgagagccaccaccctggagagcaacgtgaagaagaacaacagagtggagttcagagagcccctggtgagctacagagagatccacggcgcccccagcaacttcagcagcagccacctggagagcaagcacgtgtactgcgtggacgtgaacgaggagaagaccgagagcggcaactggatgatcggcagcagagaggagagaaacatcagaagctgcgacttcgagagcagccagagcagcgtgatcaacgacaccgtggtgagattcctgaacgacagacccgccatcgacgccctgcagaacagcgagtgcctgatcagaatgggcgccagcatgagaaccgaggaggagatgcccaacagaaccaagggcagcgagaacaacctgaagctgagcgtgaacaacatggcccacgacaccgaccccaaggccctgagactgaccgacagcagccccagcagcaccagcaccagcaacagccagagactggacatcctgaagagaagacagcacgacgtgaagctggagaagctgaaggagagaatcagaaagcagtgggagcacagcgaggagaccaacggcagaggccagaagctgggccacatcgaccaccccgtgatggtggtgaacgtggacaacagcgtgaccgccaaggtgagaaaggtggccaccgccccccccgcccccgcctacaagggcttcaaccccagcgagaccaagatcagaacccccgacggcaaggtgtggcaggaggccgagttccagaacatgagcagagagctgtacagagacctggccctgcacttcgccgacgacatcagcatcaaggagaagcccgccgagaagagcaaggagaagaaggtggtgaagcccgtgagaaaggtgcagaaggtggcccagctgagcagcaccgagtgcagaaccggcagcagccacctgatcagcaccagcagctggagagacggccagaagctggtgaagaagatcctgggccccgcccccagaatggagcccaaggagcagagaaccgccagcagcgacagaggcggcagagagagaaccgccaagagcggcggccacatcggcagagccgagagcgaccccagactggacgtgctgcacagacacctgcagagaaacagcgagagaagcagaagcaagagcagaagcgagaacaacatcaagaagctggccagcagcctgcccgacaacaagcaggaggagaacaccgccctgaacaaggacttcctgcccatcgagatcagaggcatcctggacgacctgcagctggacagcaccgcccacaccgccaagcaggacaccgtggagctgcagaaccagaagagcagcgcccccgtgcacgcccccagaagccacagccccgtgaagagaaagcccgacaagatcaccgccaacgaggacccccccgtgatcagcaagagaagacactacgacaccgacgaggtgagacagtacatcgtgagacagcaggaggagagaaagagaaagcagaacgaggagaagaaggcccagaaggaggccaccgagcagaagaacaagagactgcaggagctgtacagaaagcagaaggaggccttcaccaaggtgaagaacgtgccccccagcgagcccagcgccaccagaagactgcaggagacctacagcaagctgctgctggagaagaccctgctggaggagcccagccaccagcacgtgacccaggagacccaggccaagcccggctaccagcccagcggcgagagcgacaaggagaacaaggtgcaggagagaccccccagcgccagcagcagcagcgacatgagcctgagcgagcccccccagcccctggccagaaaggacctgatggagagcacctggatgcagcccgagagactgagcccccaggtgcaccacagccagccccagcccttcgccggcaccgccggcagcctgctgagccacctgctgagcctggagcacgtgggcatcctgcacaaggacttcgagagcatcctgcccaccagaaagaaccacaacatggccagcagacccctgaccttcaccccccagccctacgtgaccagccccgccgcctacaccgacgccctgctgaagcccagcgccagccagtacaagagcaagctggacagaatcgaggccctgaaggccaccgccgccagcctgagcagcagaatcgagagcgaggccaagaagctggccggcgccagcatcaactacggcagcgcctggaacaccgagtacgacgtgcagcaggccccccaggaggacggcccctggaccaaggccgtgaccccccccgtgaaggacgacaacgaggacgtgttcagcgccagaatccagaagatgctgggcagctgcgtgagccacgccaccttcgacgacgacctgcccggcgtgggcaacctgagcgagttcaagaagctgcccgagatgatcagaccccagagcgccatcagcagcttcagagtgagaagccccggccccaagcccgagggcctgctggcccagctgtgcaagagacagaccgacagcagcagcagcgacatgcaggcctgcagccaggacaaggccaagatcagcctgggcagcagcatcgacagcgtgagcgagggccccctgctgagcgagggcagcctgagcgaggaggagggcgaccaggacggccagcccctgctgaaggtggccgagatcctgaaggagaaggagttctgccccggcgagagaaacagctacgagcccatcaaggagttccagaaggaggccgagaagttcctgcccctgttcggccacatcggcggcacccagagcaagggcccctgggaggagctggccaagggcagcccccacagcgtgatcaacatcttcaccaagagctaccagctgtacggcaagggcttcgaggacaagctggacagaggcaccagcaccagcagacccctgaacgccaccgccacccccctgagcggcgtgagctacgaggacgacttcgtgagcagccccggcaccggcaccagcaccgagaagaagagcaccctggagccccacagcaccctgagcccccaggaggaccacagcaacagaaagagcgcctacgaccccagcagcgtggacgtgaccagccagcacagcagcggcgcccagagcgccgccagcagcagaagcagcaccagcagcaagggcaagaagggcaagaaggagaagaccgagtggctggacagcttcaccggcaacgtgcagaacagcctgctggacgaggagaaggccgagagaggcagccaccagggcaagaagagcggcaccagcagcaagctgagcgtgaaggacttcgagcagaccctggacaccgacagcaccctggaggacctgagcggccacagcgtgagcgtgagcagcgacaagggcagaagccagaagacccccaccagccccctgagccccagcagccagaagagcctgcagttcgacgtggccggcaccagcagcgagagaagcaagagcagcgtgatgccccccaccatcaccggcttcaagcccaacgcccccctgaccgacctgaaccccgccgccagcagaaccaccaccgagaacatggcccccatccccggcagcaagagattcagccccgccggcctgcaccacagaatggccgccgagctgagctacctgaacgccatcgaggagagcgtgagacagctgagcgacgtggagagagtgagaggcatcagcctggcccagcaggagagcgtgagcctggcccagatcatcaaggcccagcagcagagacacgagagagacctggccctgctgaagctgaaggccgagcaggaggccctggagagccagagacagctggaggagaccagaaacaaggccgcccaggtgcacgccgagagcctgcagcaggtggtgcagagccagagagaggtgaccgaggtgctgcaggaggccacctgcaagatcgccgcccagcagagcgagaccgccagactgaccaccgacgccgccagacagatctgcgagatggccgagctgaccagaacccacatcagcgacgccgtggtggccagcggcgcccccctggccatcctgtacgaccaccagagacagcacctgcccgacttcgtgaagcagctgagaaccagaaccgagaccgacagaaagagccccagcgtgagcctgagccagagcaaggagggcaccctggacagcaagcaccagaagtacagcgccagctacgacagctacagcgagagcagcggctacaagaaccacgacagaagaagcagcagcggcagcagcagacaggagagccccagcgtgcccagctgcaaggagaacgagaagaagctgaacggcgagaagatcgagagcagcatcgacgagcaggtgcagaccgccgccgacgacagcctgagaagcgacagcgtgcccagcctgcccgacgagaaggacagcaccagcatcgccaccgagtacagcctgaagttcgacgagagcatgaccgaggacgagatcgaggagcagagcttcagaagcctgctgcccagcgagagccacagaagattcaacatggagaagagaagaggccaccacgacgacagcgacgaggaggccagccccgagaagaccaccctgagcaccgccaaggagctgaacatgcccttcagcggcggccaggacagcttcagcaagttcaccatggagatggtgagacagtacatgaaggaggaggagatgagagccgcccaccagagcagcctgctgagactgagagagaaggccctgaaggagaagaccaaggccgagctggcctggctggagcaccagaagaagcacctgagagacaagggcgaggacgacaagatgccccccctgagaaagaagcagagaggcctgctgctgagactgcagcaggagaaggccgagatcaagagactgcaggaggccaacaaggccgccagaaaggagagacagctgatcctgaagcagcaggaggagatcgagaagatcagacagaccaccatcaagctgcaggagaagctgaagagcgccggcgagagcaagctggacagccacagcgacgacgacaccaaggacaacaaggccaccagccccggccccaccgacctggagaccagaagccccagccccatcagcatcagcagcagcgagaccagcagcatcatgcagaagctgaagaagatgagaagcagaatggacgagaagttcctgaccaagagagagcagaagctgatgcagagaagacagcacgccgaggagctgctggagtggaagagaagactggacgccgaggaggccgagatcagacagatggagaagcaggccctggccgcctgggacaaggagctgatcaagcccaagacccccaagaaggagctggaggaccagagaaccgagcagaaggagatcgccagcgaggaggagagccccgtgcccctgtacagccacctgaacagcgagagcagcatccccgaggagctgggcagccccgccgtggagtacgtgcccagcgagagcatcggccaggagcagcccggcagccccgaccacagcatcctgaccgaggagatgatctgcagccaggagctggagagcagcaccagccccagcaagcacagcctgcccaagagctgcaccagcgtgagcaagcaggagagcagcaagggcagccacagaaccggcggccagtgccacctgcccatcaagagccaccagcactgctacagctggagcgacgagagcctgagcatgacccagagcgagaccaccagcgaccagagcgacatcgagggcagaatcagagccctgaaggacgagctgagaaagagaaagagcgtggtgaaccagctgaagaaggagcagaagaagagacagaaggagagactgaaggcccaggaggccagcctgatcaagcagctggagagctacgacgagttcatcaagaagaccgaggccgagctgagccaggacctggagaccagccccaccgccaagccccagatcaagaccctgagcagcgccagcgagaagcccaagatcaagcccctgacccccctgcacagaagcgagaccgccaagaactggaagagcctgaccgagagcgagagaagcagaggcagcctggagagcatcgccgagcacgtggacgccagcctgagcggcagcgagagaagcgtgagcgagagaagcctgagcgcctacgccaagagagtgaacgagtgggacagcagaaccgaggacttccagacccccagccccgtgctgagaagcagcagaaagatcagagaggagagcggcgacagcctggagaacgtgcccgccctgcacctgctgaaggagctgaacgccaccagcagaatcctggacatgagcgacggcaaggtgggcgagagcagcaagaagagcgagatcaaggagatcgagtacaccaagctgaagaagagcaagatcgaggacgccttcagcaaggagggcaagagcgacgtgctgctgaagctggtgctggagcagggcgacagcagcgagatcctgagcaagaaggacctgcccctggacagcgagaacgtgcagaaggacctggtgggcctggccatcgagaacctgcacaagagcgaggagatgctgaaggagagacagagcgaccaggacatgaaccacagccccaacatccagagcggcaaggacatccacgagcagaagaacaccaaggagaaggacctgagctggagcgagcacctgttcgcccccaaggagatcccctacagcgaggacttcgaggtgagcagcttcaagaaggagatcagcgccgagctgtacaaggacgacttcgaggtgagcagcctgctgagcctgagaaaggacagccagagctgcagagacaagccccagcccatgagaagcagcaccagcggcgccaccagcttcggcagcaacgaggagatcagcgagtgcctgagcgagaagagcctgagcatccacagcaacgtgcacagcgacagactgctggagctgaagagccccaccgagctgatgaagagcaaggagagaagcgacgtggagcacgagcagcaggtgaccgagagccccagcctggccagcgtgcccaccgccgacgagctgttcgacttccacatcggcgacagagtgctgatcggcaacgtgcagcccggcatcctgagattcaagggcgagaccagcttcgccaagggcttctgggccggcgtggagctggacaagcccgagggcaacaacaacggcacctacgacggcatcgcctacttcgagtgcaaggagaagcacggcatcttcgcccccccccagaagatcagccacatccccgagaacttcgacgactacgtggacatcaacgaggacgaggactgctacagcgacgagagataccagtgctacaaccaggagcagaacgacaccgagggccccaaggacagagagaaggacgtgagcgagtacttctacgagaagagcctgcccagcgtgaacgacatcgaggccagcgtgaacagaagcagaagcctgaagatcgagaccgacaacgtgcaggacatcagcggcgtgctggaggcccacgtgcaccagcagagcagcgtggacagccagatcagcagcaaggagaacaaggacctgatcagcgacgccaccgagaaggtgagcatcgccgccgaggacgacaccctggacaacaccttcagcgaggagctggagaagcagcagcagttcaccgaggaggaggacaacctgtacgccgaggccagcgagaagctgtgcacccccctgctggacctgctgaccagagagaagaaccagctggaggcccagctgaagagcagcctgaacgaggagaagaagagcaagcagcagctggagaagatcagcctgctgaccgacagcctgctgaaggtgttcgtgaaggacaccgtgaaccagctgcagcagatcaagaagaccagagacgagaagatccagctgagcaaccaggagctgctgggcgacgaccagaagaaggtgaccccccaggacctgagccagaacgtggaggagcagagccccagcatcagcggctgcttcctgagcagcgagctggaggacgagaaggaggagatcagcagccccgacatgtgccccagacccgagagccccgtgttcggcgccagcggccaggaggagctggccaagagactggccgagctggagctgagcagagagttcctgagcgccctgggcgacgaccaggactggttcgacgaggacttcggcctgagcagcagccacaagatccagaagaacaaggccgaggagaccatcgtgcccctgatggccgagcccaagagagtgacccagcagccctgcgagaccctgctggccgtgccccacaccgccgaggaggtggagatcctggtgcacaacgccgccgaggagctgtggaagtggaaggagctgggccacgacctgcacagcatcagcatccccaccaagctgctgggctgcgccagcaagggcctggacatcgagagcaccagcaagagagtgtacaagcaggccgtgttcgacctgaccaaggagatcttcgaggagatcttcgccgaggaccccaacctgaaccagcccgtgtggatgaagccctgcagaatcaacagcagctacttcagaagagtgaagaaccccaacaacctggacgagatcaagagcttcatcgccagcgaggtgctgaagctgttcagcctgaagaaggagcccaaccacaagaccgactggcagaagatgatgaagttcggcagaaagaagagagacagagtggaccacatcctggtgcaggagctgcacgaggaggaggcccagtgggtgaactacgacgaggacgagctgtgcgtgaagatgcagctggccgacggcatcttcgagaccctgatcaaggacaccatcgacgtgctgaaccagatcagcgagaagcagggcagaatgctgctggtgtag

SEQ ID NO: 10632 - DNA, 2946 bp, Artificial Sequence; identical to SEQ ID NO: 9659
  Description of Artificial Sequence: Synthetic coding sequence

SEQ ID NO: 10633 - DNA, 648 bp, Artificial Sequence
  Description of Artificial Sequence: Synthetic coding sequence
atgagcgccaagagagccgagctgaagaagacccacctggtgaaggagagacactgctggaccagcaagaactacaaggccgtgtgcctggagctgaagcccgagcccaccaagaccttcgactacaaggccgtgaagcaggagggcagattcaccaaggccggcgtgacccaggacctgaagaacgagctgagagaggtgagagaggagctgaaggagaagatggaggagatcaagcagatcaaggacctgatggacaaggacttcgacaagctgcacgagttcgtggagatcatgaaggagatgcagaaggacatggacgagaagatggacatcctgatcaacacccagaagaactacaagctgcccctgagaagagcccccaaggagcagcaggagctgagactgatgggcaagacccacagagagccccagctgagacccaagaagatggacggcgccagcggcgtgaacggcgccccctgcgccctgcacaagaagaccatggccccccagaagaccaagcagggcagcctggaccccctgcaccactgcggcacctgctgcgagaagtgcctgctgtgcgccctgaagaacaactacaacagaggcatctacgccgccgtgggcctgctggacctgtggtag

SEQ ID NO: 10634 - DNA, 606 bp, Artificial Sequence
  Description of Artificial Sequence: Synthetic coding sequence
atgagcgccaagagagccgagctgaagaagacccacctgagcaagaactacaaggccgtgtgcctggagctgaagcccgagcccaccaagaccttcgactacaaggccgtgaagcaggagggcagattcaccaaggccggcgtgacccaggacctgaagaacgagctgagagaggtgagagaggagctgaaggagaagatggaggagatcaagcagatcaaggacctgatggacaaggacttcgacaagctgcacgagttcgtggagatcatgaaggagatgcagaaggacatggacgagaagatggacatcctgatcaacacccagaagaactacaagctgcccctgagaagagcccccaaggagcagcaggagctgagactgatgggcaagacccacagagagccccagctgagacccaagaagatggacggcgccagcggcgtgaacggcgccccctgcgccctgcacaagaagaccatggccccccagaagaccaagcagggcagcctggaccccctgcaccactgcggcacctgctgcgtgagcgagaccctgcccgagcccagcaccggcgccagacccctggcccccgccccctggtag

SEQ ID NO: 10635 - DNA, 300 bp, Artificial Sequence
  Description of Artificial Sequence: Synthetic coding sequence
atgagcgccaagagagccgagctgaagaagacccacctgagcaagaactacaaggccgtgtgcctggagctgaagcccgagcccaccaaggtgagaagccccttcgaggccatgcaggccgccagacccgagatccacggcgaggtgaccagaagccagggcagcttcgccgaccccagcggccaggacctgagccagaccttcgactacaaggccgtgaagcaggagggcagattcaccaaggccggcagaacccccagactgctggaggagctgagcctgctgctgctgcccctgtag

SEQ ID NO: 10636 - DNA, 639 bp, Artificial Sequence
  Description of Artificial Sequence: Synthetic coding sequence
atgagcgccaagagagccgagctgaagaagacccacctgagcaagaactacaaggccgtgtgcctggagctgaagcccgagcccaccaagaccttcgactacaaggccgtgaagcaggagggcagattcaccaaggccggcgtgacccaggacctgaagaacgagctgagagaggtgagagaggagctgaaggagaagatggaggagatcaagcagatcaaggacctgatggacaaggacttcgacaagctgcacgagttcgtggagatcatgaaggagatgcagaaggacatggacgagaagatggacatcctgatcaacacccagaagaactacaagctgcccctgagaagagcccccaaggagcagcaggagctgagactgatgggcaagacccacagagagccccagctgagacccaagaagatggacggcgccagcggcgtgaacggcgccccctgcgccctgcacaagaagaccatggccccccagaagaccaagcagggcagcctggaccccctgcaccactgcggcacctgctgcgagaagtgcctgctgtgcgccctgaagaacaactacaacagagcccagctgcagaacctgcccgccgtgcccatccaccacctgcaggccccctag

SEQ ID NO: 10637 - DNA, 402 bp, Artificial Sequence
  Description of Artificial Sequence: Synthetic coding sequence
tgatacgagctgagagaggagcacctggacaagatcttcaagcacagagagctgcagcagaagctggtggacgccaagctggagcaggcccaggagatgatgaaggaggccgaggagagacacaagagagagaaggagtacctgctgaaccaggccgccgagtggaagctgcaggccaaggtgctgaaggagcaggagaccgtgctgcaggcccaggtgagacccggcggcagaggcatgggcgtgctgagcagcctgagccccgacaagaaggccggcgccaagggcggccagcagaagagcagctacgtggccggcgacggcggcatgggcatcggcaacgaggagcagctgcacatctacagctacttccaggtgaagatcaaggcccagtactactag

SEQ ID NO: 10638 - DNA, 687 bp, Artificial Sequence
  Description of Artificial Sequence: Synthetic coding sequence
atggccagcgaggagctgcagaaggacctggaggaggtgaaggtgctgctggagaaggccaccagaaagagagtgagagacgccctgaccgccgagaagagcaagatcgagaccgagatcaagaacaagatgcagcagaagagccagaagaaggccgagctgctggacaacgagaagcccgccgccgtggtggcccccatcaccaccggctacaccgtgaagatcagcaactacggctgggaccagagcgacaagttcgtgaagatctacatcaccctgaccggcgtgcaccaggtgcccaccgagaacgtgcaggtgcacttcaccgagagaagcttcgacctgctggtgaagaacctgaacggcaagagctacagcatgatcgtgaacaacctgctgaagcccatcagcgtggagggcagcagcaagaaggtgaagaccgacaccgtgctgatcctgtgcagaaagaaggtggagaacaccagatgggactacctgacccaggtggagaaggagtgcaaggagaaggagaagcccagctacgacaccgagaccgaccccagcgagggcctgatgaacgtgctgaagaagatctacgaggacggcgacgacgacatgaagagaaccatcaacaaggcctgggtggagagcagagagaagcaggccaagggcgacaccgagttctag

SEQ ID NO: 10639 - DNA, 558 bp, Artificial Sequence
  Description of Artificial Sequence: Synthetic coding sequence
atgcagcagaagagccagaagaaggccgagctgctggacaacgagaagcccgccgccgtggtggcccccatcaccaccggctacaccgtgaagatcagcaactacggctgggaccagagcgacaagttcgtgaagatctacatcaccctgaccggcgtgcaccaggtgcccaccgagaacgtgcaggtgcacttcaccgagagaagcttcgacctgctggtgaagaacctgaacggcaagagctacagcatgatcgtgaacaacctgctgaagcccatcagcgtggagggcagcagcaagaaggtgaagaccgacaccgtgctgatcctgtgcagaaagaaggtggagaacaccagatgggactacctgacccaggtggagaaggagtgcaaggagaaggagaagcccagctacgacaccgagaccgaccccagcgagggcctgatgaacgtgctgaagaagatctacgaggacggcgacgacgacatgaagagaaccatcaacaaggcctgggtggagagcagagagaagcaggccaagggcgacaccgagttctag

SEQ ID NO: 10640 - DNA, 1134 bp, Artificial Sequence
  Description of Artificial Sequence: Synthetic coding sequence
atggagcagctgcccgacctgcacagccacttcagcgacctgaacctggaggcccacatgtacgccagccagtggttcctgaccctgttcaccgccaagttccccctgtgcatggtgttccacatcatcgacctgctgctgtgcgagggcctgaacatcatcttccacgtggccctggccctgctgaagaccagcaaggaggacctgctgcaggccgacttcgagggcgccctgaagttcttcagagtgcagctgcccaagagatacagagccgaggagaacgccagaagactgatggagcaggcctgcaacatcaaggtgcccaccaagaagctgaagaagtacgagaaggagtaccagaccatgagagagagccagctgcagcaggaggaccccatggacagatacaagagagagaacagaagactgcaggaggccagcatgagactggagcaggagaacgacgacctggcccacgagctggtgaccagcaagatcgccctgagaaacgacctggaccaggccgaggacaaggccgacgtgctgaacaaggagctgctgctgaccaagcagagactggtggagaccgaggaggagaagagaaagcaggaggaggagaccgcccagctgaaggaggtgttcagaaagcagctggagaaggccgagtacgagatcaagaagaccaccgccatcatcgccgagtacaagcagatctgcagccagctgagcaccagactggagaagcagcaggccgccagcaaggaggagctggaggtggtgaagggcaagatgatggcctgcaagcactgcagcgacatcttcagcaaggagggcgccctgaagctggccgccaccggcagagaggaccagggcatcgagaccgacgacgagaaggacagcctgaagaagcagctgagagagatggagctggagctggcccagaccaagctgcagctggtggaggccaagtgcaagatccaggagctggagcaccagagaggcgccctgatgaacgagatccaggccgccaagaacagctggttcagcaagaccctgaacagcatcaagaccgccaccggcacccagcccctgcagcccgcccccgtgacccagccccccaaggagagcacctag

SEQ ID NO: 10641 - DNA, 762 bp, Artificial Sequence
  Description of Artificial Sequence: Synthetic coding sequence
atgatcgagaacagcagctggagcatgaccttcgaggagagagagaacagaagactgcaggaggccagcatgagactggagcaggagaacgacgacctggcccacgagctggtgaccagcaagatcgccctgagaaacgacctggaccaggccgaggacaaggccgacgtgctgaacaaggagctgctgctgaccaagcagagactggtggagaccgaggaggagaagagaaagcaggaggaggagaccgcccagctgaaggaggtgttcagaaagcagctggagaaggccgagtacgagatcaagaagaccaccgccatcatcgccgagtacaagcagatctgcagccagctgagcaccagactggagaagcagcaggccgccagcaaggaggagctggaggtggtgaagggcaagatgatggcctgcaagcactgcagcgacatcttcagcaaggagggcgccctgaagctggccgccaccggcagagaggaccagggcatcgagaccgacgacgagaaggacagcctgaagaagcagctgagagagatggagctggagctggcccagaccaagctgcagctggtggaggccaagtgcaagatccaggagctggagcaccagagaggcgccctgatgaacgagatccaggccgccaagaacagctggttcagcaagaccctgaacagcatcaagaccgccaccggcacccagcccctgcagcccgcccccgtgacccagccccccaaggagagcacctag

SEQ ID NO: 10642 - DNA, 759 bp, Artificial Sequence
  Description of Artificial Sequence: Synthetic coding sequence
atgggcaagagctacgacggcagagcctacgtgatcaccggcatgtggaaccccaacgcccccgtgttcctggccctgaacgaggagacccccaaggacaagcaggtgtacatgaccgtggccgtggacatggtggtgaccgaggtggtggagcccgtgagattcctgctggagaccgtggtgagagtgtaccccgccaacgagagattctggtacttcagcagaaagaccttcaccgagaccttcttcatgagactgaagcagagcgagggcaagggccacaccaacgccggcgacgccatctacgaggtggtgagcctgcagagagagagcgacaaggaggagcccgtgacccccaccagcggcggcggccccatgagcccccaggacgacgaggccgaggaggagagcgacaacgagctgagcagcggcaccggcgacgtgagcaaggactgccccgagaagatcctgtacagctggggcgagctgctgggcaagtggcacagcaacctgggcgccagacccaagggcctgagcaccctggtgaagagcggcgtgcccgaggccctgagagccgaggtgtggcagctgctggccggctgccacgacaaccaggccatgctggacagatacagaatcctgatcaccaaggtgtgctggagcctgctggaggtgcacagcagaccctgcctgcccggctaccaccagtggaagctgcagaacagcaagtactgcagaatggccaacgtggccgcctag

SEQ ID NO: 10643 - DNA, 2484 bp, Artificial Sequence
  Description of Artificial Sequence: Synthetic coding sequence
atggaggtgagagccagcctgcagaaggtgagcggcagcagcgacagcgtggccaccatgaacagcgaggagttcgtgctggtgccccagtacgccgacgacaacagcaccaagcacgaggagaagccccagctgaagatcgtgagcaacggcgacgagcagctggagaaggccatggaggagatcctgagagacagcgagaagagacccagcagcctgctggtggactgccagagcagcagcgagatcagcgaccacagcttcggcgacatccccgccagccagaccaacaagcccagcctgcagctgatcctggaccccagcaacaccgagatcagcacccccagacccagcagccccggcggcctgcccgaggaggacagcgtgctgttcaacaagctgacctacctgggctgcatgaaggtgagcagccccagaaacgaggtggaggccctgagagccatggccaccatgaagagcagcagccagtaccccttccccgtgaccctgtacgtgcccaacgtgcccgagggcagcgtgagaatcatcgaccagagcagcaacgtggagatcgccagcttccccatctacaaggtgctgttctgcgccagaggccacgacggcaccaccgagagcaactgcttcgccttcaccgagagcagccacggcagcgaggagttccagatccacgtgttcagctgcgagatcaaggaggccgtgagcagaatcctgtacagcttctgcaccgccttcaagagaagcagcagacaggtgagcgacgtgaaggacagcgtgatccccacccccgacagcgacgtgttcaccttcagcgtgagcctggaggtgaaggaggacgacggcaagggcaacttcagactgctggtgatccccatccccttcgagtacttcagccccgtgcccaaggacagagacaagttctacttcaagctgaagcagggcatcgagaagaaggtggtgatcaccgtgcagcagctgagcaacaaggagctggccatcgagagatgcttcggcatgctgctgagccccggcagaaacgtgaagaacagcgacatgcacctgctggacatggagagcatgggcaagagctacgacggcagagcctacgtgatcaccggcatgtggaaccccaacgcccccgtgttcctggccctgaacgaggagacccccaaggacaagcaggtgtacatgaccgtggccgtggacatggtggtgaccgaggtggtggagcccgtgagattcctgctggagaccgtggtgagagtgtaccccgccaacgagagattctggtacttcagcagaaagaccttcaccgagaccttcttcatgagactgaagcagagcgagggcaagggccacaccaacgccggcgacgccatctacgaggtggtgagcctgcagagagagagcgacaaggaggagcccgtgacccccaccagcggcggcggccccatgagcccccaggacgacgaggccgaggaggagagcgacaacgagctgagcagcggcaccggcgacgtgagcaaggactgccccgagaagatcctgtacagctggggcgagctgctgggcaagtggcacagcaacctgggcgccagacccaagggcctgagcaccctggtgaagagcggcgtgcccgaggccctgagagccgaggtgtggcagctgctggccggctgccacgacaaccaggccatgctggacagatacagaatcctgatcaccaaggacagcgcccaggagagcgtgatcaccagagacatccacagaaccttccccgcccacgactacttcaaggacaccggcggcgacggccaggagagcctgtacaagatctgcaaggcctacagcgtgtacgacgaggacatcggctactgccagggccagagcttcctggccgccgtgctgctgctgcacatgcccgaggagcaggccttctgcgtgctggtgaagatcatgtacgactacggcctgagagacctgtacagaaacaacttcgaggacctgcactgcaagttctaccagctggagagactgatgcaggagcagctgcccgacctgcacagccacttcagcgacctgaacctggaggcccacatgtacgccagccagtggttcctgaccctgttcaccgccaagttccccctgtgcatggtgttccacatcatcgacctgctgctgtgcgagggcctgaacatcatcttccacgtggccctggccctgctgaagaccagcaaggaggacctgctgcaggccgacttcgagggcgccctgaagttcttcagagtgcagctgcccaagagatacagagccgaggagaacgccagaagactgatggagcaggcctgcaacatcaaggtgcccaccaagaagctgaagaagtacgagaaggagtaccagaccatgagagagagccagctgcagcaggaggaccccatggacagatacaagttcttcttcctgtag

SEQ ID NO: 10644 - DNA, 2580 bp, Artificial Sequence
  Description of Artificial Sequence: Synthetic coding sequence
atgggcaacagagagatggaggagctgatccccctggtgaacagactgcaggacgccttcagcgccctgggccagagctgcctgctggagctgccccagatcgccgtggtgggcggccagagcgccggcaagagcagcgtgctggagaacttcgtgggcagagacttcctgcccagaggcagcggcatcgtgaccagaagacccctggtgctgcagctggtgaccagcaaggccgagtacgccgagttcctgcactgcaagggcaagaagttcaccgacttcgacgaggtgagactggagatcgaggccgagaccgacagagtgaccggcatgaacaagggcatcagcagcatccccatcaacctgagagtgtacagcccccacgtgctgaacctgaccctgatcgacctgcccggcatcaccaaggtgcccgtgggcgaccagccccccgacatcgagtaccagatcagagagatgatcatgcagttcatcaccagagagaactgcctgatcctggccgtgacccccgccaacaccgacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacgtgggcgtggtgaacagaagccagaaggacatcgacggcaagaaggacatcaaggccgccatgctggccgagagaaagttcttcctgagccaccccgcctacagacacatcgccgacagaatgggcaccccccacctgcagaaggtgctgaaccagcagctgaccaaccacatcagagacaccctgcccaacttcagaaacaagctgcagggccagctgctgagcatcgagcacgaggtggaggcctacaagaacttcaagcccgaggaccccaccagaaagaccaaggccctgctgcagatggtgcagcagttcgccgtggacttcgagaagagaatcgagggcagcggcgaccaggtggacaccctggagctgagcggcggcgccaagatcaacagaatcttccacgagagattccccttcgagatcgtgaagatggagttcaacgagaaggagctgagaagagagatcagctacgccatcaagaacatccacggcatcagaaccggcctgttcacccccgacatggccttcgaggccatcgtgaagaagcagatcgtgaagctgaagggccccagcctgaagagcgtggacctggtgatccaggagctgatcaacaccgtgaagaagtgcaccaagaagctggccaacttccccagactgtgcgaggagaccgagagaatcgtggccaaccacatcagagagagagagggcaagaccaaggaccaggtgctgctgctgatcgacatccaggtgagctacatcaacaccaaccacgaggacttcatcggcttcgccaacgcccagcagagaagcagccaggtgcacaagaagaccaccgtgggcaaccaggtgatcagaaagggctggctgaccatcagcaacatcggcatcatgaagggcggcagcaagggctactggttcgtgctgaccgccgagagcctgagctggtacaaggacgacgaggagaaggagaagaagtacatgctgcccctggacaacctgaaggtgagagacgtggagaagagcttcatgagcagcaagcacatcttcgccctgttcaacaccgagcagagaaacgtgtacaaggactacagattcctggagctggcctgcgacagccaggaggacgtggacagctggaaggccagcctgctgagagccggcgtgtaccccgacaagagcgtggccgagaacgacgagaacggccaggccgagaacttcagcatggacccccagctggagagacaggtggagaccatcagaaacctggtggacagctacatgagcatcatcaacaagtgcatcagagacctgatccccaagaccatcatgcacctgatgatcaacaacgtgaaggacttcatcaacagcgagctgctggcccagctgtacagcagcgaggaccagaacaccctgatggaggagagcgccgagcaggcccagagaagagacgagatgctgagaatgtaccaggccctgaaggaggccctgggcatcatcggcgacatcagcaccgccaccgtgagcacccccgcccccccccccgtggacgacagctggatccagcacagcagaagaagccccccccccagccccaccacccagagaagacccaccctgagcgcccccctggccagacccaccagcggcagaggccccgcccccgccatccccagccccggcccccacagcggcgccccccccgtgcccttcagacccggccccctgccccccttccccagcagcagcgacagcttcggcgcccccccccaggtgcccagcagacccaccagagccccccccagcgtgcccagcagaagacccccccccagccccaccagacccaccatcatcagacccctggagagcagcctgctggactag

SEQ ID NO: 10645 - DNA, 1761 bp, Artificial Sequence
  Description of Artificial Sequence: Synthetic coding sequence
agcgagagcctgagcagcgccgtgttcgtggagggcctgaagagacagggcggctgcgccagactggaggaggcctgcctgagcgaggccggcgaggacctgaccggcgtgagattcagcctgcccggcaagaacttcccctgcggcagcagcagcagcagcagcagaagcagaaacagcagcagcagcaacagcagcagcagcagcagcaccaccaccaccaccaccagcagcagcggcgcccaggacagaatgcccgtgctggagagatacttccaccccgccgagctgggcagaagatggaccggccccgagggcgtgctgcccagcagccccggcagcagacccggctgccagcagggccccctgccctgggacctgcccgagatgatcagaatggtgaagctggtgtggaagagcaagagcgagctgcaggccaccaagcagagaggcatcctggacaacgaggacgccctgagaagcttccccggcgacatcagactgagaggccagaccggcgtgagagccgagagaagaggcagctaccccttcatcgacttcagactgctgaacagcaccacctacagcggcgagatcggcaccaagaagaaggtgaagagactgctgagcttccagagatacttccacgccagcagactgctgagaggcatcatcccccaggcccccctgcacctgctggacgaggactacctgggccaggccagacacatgctgagcaaggtgggcatgtgggacttcgacatcttcctgttcgacagactgaccaacggcaacagcctggtgaccctgctgtgccacctgttcaacacccacggcctgatccaccacttcaagctggacatggtgaccctgcacagattcctggtgatggtgcaggaggactaccacagccagaacccctaccacaacgccgtgcacgccgccgacgtgacccaggccatgcactgctacctgaaggagcccaagctggccagcttcctgacccccctggacatcatgctgggcctgctggccgccgccgcccacgacgtggaccaccccggcgtgaaccagcccttcctgatcaagaccaaccaccacctggccaacctgtaccagaacatgagcgtgctggagaaccaccactggagaagcaccatcggcatgctgagagagagcagactgctggcccacctgcccaaggagatgacccaggacatcgagcagcagctgggcagcctgatcctggccaccgacatcaacagacagaacgagttcctgaccagactgaaggcccacctgcacaacaaggacctgagactggaggacgcccaggacagacacttcatgctgcagatcgccctgaagtgcgccgacatctgcaacccctgcagaatctgggagatgagcaagcagtggagcgagagagtgtgcgaggagttctacagacagggcgagctggagcagaagttcgagctggagatcagccccctgtgcaaccagcagaaggacagcatccccagcatccagatcggcttcatgagctacatcgtggagcccctgttcagagagtgggcccacttcaccggcaacagcaccctgagcgagaacatgctgggccacctggcccacaacaaggcccagtggaagagcctgctgcccagacagcacagaagcagaggcagcagcggcagcggccccgaccacgaccacgccggccagggcaccgagagcgaggagcaggagggcgacagcccctag

SEQ ID NO: 10646 - DNA, 525 bp, Artificial Sequence
  Description of Artificial Sequence: Synthetic coding sequence
atgaccaccaagaacctggagaccaaggtgaccgtgaccagcagccccatcagaggcgccggcgacggcatggagaccgaggagccccccaagagcgtggaggtgaccagcggcgtgcagagcagaaagcaccacagcctgcagagcccctggaagaaggccgtgcccagcgagagccccggcgtgctgcagctgggcaagatgctgaccgagaaggccatggaggtgaaggccgtgagaatcctggtgcccaaggccgccatcacccacgacatccccaacaagaacaccaaggtgaagagcctgggccaccacaagggcgagttcctgggccagagcgagggcgtgatcgagcccaacaaggagctgagcgaggtgaagaacgtgctggagaagctgaagaacagcgagagaagactgctgcaggacaaggagggcctgagcaaccagctgagagtgcagaccgaggtgagaagagccctgatcgacaagatgagcaccaccctgtacgtgtggaccttctag

SEQ ID NO: 10647 - DNA, 1203 bp, Artificial Sequence; identical to SEQ ID NO: 10043
  Description of Artificial Sequence: Synthetic coding sequence

SEQ ID NO: 10648 - DNA, 276 bp, Artificial Sequence
  Description of Artificial Sequence: Synthetic coding sequence
atggacgccgacagcgacgtggccctggacatcctgatcaccaacgtggtgtgcgtgttcagaaccagatgccacctgaacctgagaaagatcgccctggagggcgccaacgtgatctacaagagagacgtgggcaaggtgctgatgaagctgagaaagcccagaatcaccgccaccatctggagcagcggcaagatcatctgcaccggcgccaccagcgaggaggaggccaagttcggcgccagaagactggccagaagcctgcagaagctgtag

SEQ ID NO: 10649 - DNA, 492 bp, Artificial Sequence
  Description of Artificial Sequence: Synthetic coding sequence
atggacgccgacagcgacgtggccctggacatcctgatcaccaacgtggtgtgcgtgttcagaaccagatgccacctgaacctgagaaagatcgccctggagggcgccaacgtgatctacaagagagacgtgggcaaggtgctgatgaagctgagaaagcccagaatcaccgccaccatctggagcagcggcaagatcatctgcaccggcgccaccagcgaggaggaggccaagttcggcgccagaagactggccagaagcctgcagaagctgggcttccaggtgatcttcaccgacttcaaggtggtgaacgtgctggccgtgtgcaacatgcccttcgagatcagactgcccgagttcaccaagaacaacagaccccacgccagctacgagcccgagctgcaccccgccgtgtgctacagaatcaagagcctgagagccaccctgcagatcttcagcaccggcagcatcaccgtgaccggcatcctgtag

SEQ ID NO: 10650 - DNA, 1023 bp, Artificial Sequence
  Description of Artificial Sequence: Synthetic coding sequence
atgctggaggcccccggccccagcgacggctgcgagctgagcaaccccagcgccagcagagtgagctgcgccggccagatgctggaggtgcagcccggcctgtacttcggcggcgccgccgccgtggccgagcccgaccacctgagagaggccggcatcaccgccgtgctgaccgtggacagcgaggagcccagcttcaaggccggccccggcgtggaggacctgtggagactgttcgtgcccgccctggacaagcccgagaccgacctgctgagccacctggacagatgcgtggccttcatcggccaggccagagccgagggcagagccgtgctggtgcactgccacgccggcgtgagcagaagcgtggccatcatcaccgccttcctgatgaagaccgaccagctgcccttcgagaaggcctacgagaagctgcagatcctgaagcccgaggccaagatgaacgagggcttcgagtggcagctgaagctgtaccaggccatgggctacgaggtggacaccagcagcgccatctacaagcagtacagactgcagaaggtgaccgagaagtaccccgagctgcagaacctgccccaggagctgttcgccgtggaccccaccaccgtgagccagggcctgaaggacgaggtgctgtacaagtgcagaaagtgcagaagaagcctgttcagaagcagcagcatcctggaccacagagagggcagcggccccatcgccttcgcccacaagagaatgacccccagcagcatgctgaccaccggcagacaggcccagtgcaccagctacttcatcgagcccgtgcagtggatggagagcgccctgctgggcgtgatggacggccagctgctgtgccccaagtgcagcgccaagctgggcagcttcaactggtacggcgagcagtgcagctgcggcagatggatcacccccgccttccagatccacaagaacagagtggacgagatgaagatcctgcccgtgctgggcagccagaccggcaagatctag

SEQ ID NO: 10651 - DNA, 807 bp, Artificial Sequence
  Description of Artificial Sequence: Synthetic coding sequence
atgtggcccctgaccgccctgctgctgctggccaccctggagaagcccatcctgagcctgcaccccccctggaccaccatcttcaagggcgagagagtgaccctgaagtgcgacggctaccaccccctgctgctggagctgcagcccatcagcaccctgtggtacctgggccacctgctgctgcccagccacaagaagagcatcgaggtgcagacccccggcgtgtacagatgccagaccagaggcgcccccgtgagcgaccccatccacctgagcgtgagcaacgactggctgatcctgcaggtgccctacgcccccgtgttcgagggcgagcccctggtgctgagatgcagaggctggtacgacaaggtggtgtacaagctgcactactaccacgacggccaggccgtgagatacttccacagcagcgccaactacaccgtgctgcaggccagagccagcgacagcggcagataccagtgcagcggcaccatgagaatccccgtggagagcgcccccatgttcagcgccaaggtggccgtgaccgtgcaggaggccagacacgccgccgccgtgagagtgctgcaggtgcagcccagaggcgcccccctgagactgggcagaagagtgcacagccccggcgccagaggcagaggcgccagaatcgtgctggtgagaggcggctacagacacccccagtgccccgagacccagagcgtggccgccgcccccggcgccggcttcagccccggccccggcctgcaccacagacccagcagcatgggcagaagcctgggcagctggtag

SEQ ID NO: 10652 - DNA, 936 bp, Artificial Sequence
  Description of Artificial Sequence: Synthetic coding sequence
atgtggcccctgaccgccctgctgctgctggccaccctggagaagcccatcctgagcctgcaccccccctggaccaccatcttcaagggcgagagagtgaccctgaagtgcgacggctaccaccccctgctgctggagctgcagcccatcagcaccctgtggtacctgggccacctgctgctgcccagccacaagaagagcatcgaggtgcagacccccggcgtgtacagatgccagaccagaggcgcccccgtgagcgaccccatccacctgagcgtgagcaacgactggctgatcctgcaggtgccctacgcccccgtgttcgagggcgagcccctggtgctgagatgcagaggctggtacgacaaggtggtgtacaagctgcactactaccacgacggccaggccgtgagatacttccacagcagcgccaactacaccgtgctgcaggccagagccagcgacagcggcagataccagtgcagcggcaccatgagaatccccgtggagagcgcccccatgttcagcgccaaggtggccgtgaccgtgcaggccgccagatgcgccgccagcaccggcgcccccagcacccagagcagaagccccagaagcagaagcagcaacagaaccggcgccagaagactgcccccccccgccgtgagcggcaacgccgtgagaggctgcagcagcagaggcagagtgctgccctggaccagaccccccccccccccccagctgcacggcccccagccctggctgctggtgatcggcagattccccagcgagagccccagatgccccgacagaagcagatggagcccccccagcggcaccccccccccccccggctgcagcagcagaagagccgcccccagactgagaggccacccccccgccctgagaagaagaccctggaacaacagactggagccctag

SEQ ID NO: 10653 - DNA, 957 bp, Artificial Sequence
  Description of Artificial Sequence: Synthetic coding sequence
atgtggcccctgaccgccctgctgctgctggtgcccagcagcggccaggccgccaccctggagaagcccatcctgagcctgcaccccccctggaccaccatcttcaagggcgagagagtgaccctgaagtgcgacggctaccaccccctgctgctggagctgcagcccatcagcaccctgtggtacctgggccacctgctgctgcccagccacaagaagagcatcgaggtgcagacccccggcgtgtacagatgccagaccagaggcgcccccgtgagcgaccccatccacctgagcgtgagcaacgactggctgatcctgcaggtgccctacgcccccgtgttcgagggcgagcccctggtgctgagatgcagaggctggtacgacaaggtggtgtacaagctgcactactaccacgacggccaggccgtgagatacttccacagcagcgccaactacaccgtgctgcaggccagagccagcgacagcggcagataccagtgcagcggcaccatgagaatccccgtggagagcgcccccatgttcagcgccaaggtggccgtgaccgtgcaggccgccagatgcgccgccagcaccggcgcccccagcacccagagcagaagccccagaagcagaagcagcaacagaaccggcgccagaagactgcccccccccgccgtgagcggcaacgccgtgagaggctgcagcagcagaggcagagtgctgccctggaccagaccccccccccccccccagctgcacggcccccagccctggctgctggtgatcggcagattccccagcgagagccccagatgccccgacagaagcagatggagcccccccagcggcaccccccccccccccggctgcagcagcagaagagccgcccccagactgagaggccacccccccgccctgagaagaagaccctggaacaacagactggagccctag

SEQ ID NO: 10654 - DNA, 1281 bp, Artificial Sequence
  Description of Artificial Sequence: Synthetic coding sequence
atgtggcccctgaccgccctgctgctgctggtgcccagcagcggccaggccgccaccctggagaagcccatcctgagcctgcaccccccctggaccaccatcttcaagggcgagagagtgaccctgaagtgcgacggctaccaccccctgctgctggagctgcagcccatcagcaccctgtggtacctgggccacctgctgctgcccagccacaagaagagcatcgaggtgcagacccccggcgtgtacagatgccagaccagaggcgcccccgtgagcgaccccatccacctgagcgtgagcaacgactggctgatcctgcaggtgccctacgcccccgtgttcgagggcgagcccctggtgctgagatgcagaggctggtacgacaaggtggtgtacaagctgcactactaccacgacggccaggccgtgagatacttccacagcagcgccaactacaccgtgctgcaggccagagccagcgacagcggcagataccagtgcagcggcaccatgagaatccccgtggagagcgcccccatgttcagcgccaaggtggccgtgaccgtgcaggagctgttcagagcccccgtgctgagagtgatgggccccagagaggccagaggcgccgccctgggcggcgtggtgctgagatgcgacaccagactgcacccccagaagagagacacccccctgcagttcgccttctacaagtacagcagagccgtgagaagattcgactggggcgccgagtacaccgtgcccgagcccgaggtggaggagctggagagctactggtgcgaggccgccaccgccaccagaagcgtgagaaagagaagcccctggctgcagctgcccggccccggcagccccctggaccccgccagcaccaccgcccccgccccctgggccgccgccctggcccccggcaacagacccctgagcttcagaaagccccccgtgagcagaagcgtgcccctggtgaccagcgtgagaaacaccaccagcaccggcctgcagttccccgccagcggcgcccccaccgccggcccccccgcctgcgccccccccacccccctggagcagagcgccggcgccctgaagcccgacgtggacctgctgctgagagagatgcagctgctgaagggcctgctgagcagagtggtgctggagctgaaggagccccaggccctgagagagctgagaggcacccccgagacccccaccagccacttcgccgtgagccccggcacccccgagaccacccccgtggagagctag

SEQ ID NO: 10655 - DNA, 369 bp, Artificial Sequence
  Description of Artificial Sequence: Synthetic coding sequence
atggccggcggctgcagagcccccagcagcgcccccaccgtgagcctgcccgagctgagaagcctgctggccagcggcagagccagactgttcgacgtgagaagcagagaggaggccgccgccggcaccatccccggcgccctgaacatccccgtgagcgagctggagagcgccctgcagatggagcccgccgccttccaggccctgtacagcgccgagaagcccaagctggaggacgagcacctggtgttcttctgccagatgggcaagagaggcctgcaggccacccagctggccagaagcctgggctacaccggcgccagaaactacgccggcgcctacagagagtggctggagaaggagagctag

SEQ ID NO: 10656 - DNA, 225 bp, Artificial Sequence
  Description of Artificial Sequence: Synthetic coding sequence
atggccggcgtgagcgagctggagagcgccctgcagatggagcccgccgccttccaggccctgtacagcgccgagaagcccaagctggaggacgagcacctggtgttcttctgccagatgggcaagagaggcctgcaggccacccagctggccagaagcctgggctacaccggcgccagaaactacgccggcgcctacagagagtggctggagaaggagagctag

SEQ ID NO: 10657 - DNA, 1794 bp, Artificial Sequence; identical to SEQ ID NO: 10010
  Description of Artificial Sequence: Synthetic coding sequence

SEQ ID NO: 10658 - DNA, 1794 bp, Artificial Sequence; identical to SEQ ID NO: 10010
  Description of Artificial Sequence: Synthetic coding sequence

SEQ ID NO: 10659 - DNA, 453 bp, Artificial Sequence
  Description of Artificial Sequence: Synthetic coding sequence
atgggcgtgcagccccccaacttcagctgggtgctgcccggcagactggccggcctggccctgcccagactgcccgcccactaccagttcctgctggacctgggcgtgagacacctggtgagcctgaccgagagaggccccccccacagcgacagctgccccggcctgaccctgcacagactgagaatccccgacttctgcccccccgcccccgaccagatcgacagattcgtgcagatcgtggacgaggccaacgccagaggcgaggccgtgggcgtgcactgcgccctgggcttcggcagaaccggcaccatgctggcctgctacctggtgaaggagagaggcctggccgccggcgacgccatcgccgagatcagaagactgagacccggcagcatcgagacctacgagcaggagaaggccgtgttccagttctaccagagaaccaagtag

SEQ ID NO: 10660 - DNA, 453 bp, Artificial Sequence; identical to SEQ ID NO: 10659
  Description of Artificial Sequence: Synthetic coding sequence

SEQ ID NO: 10661 - DNA, 453 bp, Artificial Sequence; identical to SEQ ID NO: 10659
  Description of Artificial Sequence: Synthetic coding sequence

SEQ ID NO: 10662 - DNA, 4866 bp, Artificial Sequence
  Description of Artificial Sequence: Synthetic coding sequence
atggagggctgcatgggcgaggagagcttccagatgtgggagctgaacagaagactggaggcctacctggccagagtgaaggccctggaggagcagaacgagctgctgagcgccgagctgggcggcctgagagcccagagcgccgacaccagctggagagcccacgccgacgacgagctggccgccctgagagccctggtggaccagagatggagagagaagcacgccgccgaggtggccagagacaacctggccgaggagctggagggcgtggccggcagatgccagcagctgagactggccagagagagaaccaccgaggaggtggccagaaacagaagagccgtggaggccgagaagtgcgccagagcctggctgagcagccaggtggccgagctggagagagagctggaggccctgagagtggcccacgaggaggagagagtgggcctgaacgcccaggccgcctgcgcccccagatgccccgccccccccagaggcccccccgcccccgcccccgaggtggaggagctggccagaagactgggcgaggcctggagaggcgccgtgagaggctaccaggagagagtggcccacatggagaccagcctgggccaggccagagagagactgggcagagccgtgcagggcgccagagagggcagactggagctgcagcagctgcaggccgagagaggcggcctgctggagagaagagccgccctggagcagagactggagggcagatggcaggagagactgagagccaccgagaagttccagctggccgtggaggccctggagcaggagaagcagggcctgcagagccagatcgcccaggtgctggagggcagacagcagctggcccacctgaagatgagcctgagcctggaggtggccacctacagaaccctgctggaggccgagaacagcagactgcagacccccggcggcggcagcaagaccagcctgagcttccaggaccccaagctggagctgcagttccccagaacccccgagggcagaagactgggcagcctgctgcccgtgctgagccccaccagcctgcccagccccctgcccgccaccctggagacccccgtgcccgccttcctgaagaaccaggagttcctgcaggccagaacccccaccctggccagcacccccatcccccccaccccccaggcccccagccccgccgtggacgccgagatcagagcccaggacgcccccctgagcctgctgcagacccagggcggcagaaagcaggcccccgagcccctgagagccgaggccagagtggccatccccgccagcgtgctgcccggccccgaggagcccggcggccagagacaggaggccagcaccggccagagccccgaggaccacgccagcctggccccccccctgagccccgaccacagcagcctggaggccaaggacggcgagagcggcggcagcagagtgttcagcatctgcagaggcgagggcgagggccagatctggggcctggtggagaaggagaccgccatcgagggcaaggtggtgagcagcctgcagcaggagatctgggaggaggaggacctgaacagaaaggagatccaggacagccaggtgcccctggagaaggagaccctgaagagcctgggcgaggagatccaggagagcctgaagaccctggagaaccagagccacgagaccctggagagagagaaccaggagtgccccagaagcctggaggaggacctggagaccctgaagagcctggagaaggagaacaaggagctgctgaaggacgtggaggtggtgagacccctggagaaggaggccgtgggccagctgaagcccaccggcaaggaggacacccagaccctgcagagcctgcagaaggagaaccaggagctgatgaagagcctggagggcaacctggagaccttcctgttccccggcaccgagaaccaggagctggtgagcagcctgcaggagaacctggagagcctgaccgccctggagaaggagaaccaggagcccctgagaagccccgaggtgggcgacgaggaggccctgagacccctgaccaaggagaaccaggagcccctgagaagcctggaggacgagaacaaggaggccttcagaagcctggagaaggagaaccaggagcccctgaagaccctggaggaggaggaccagagcatcgtgagacccctggagaccgagaaccacaagagcctgagaagcctggaggagcaggaccaggagaccctgagaaccctggagaaggagacccagcagagaagaagaagcctgggcgagcaggaccagatgaccctgagaccccccgagaaggtggacctggagcccctgaagagcctggaccaggagatcgccagacccctggagaacgagaaccaggagttcctgaagagcctgaaggaggagagcgtggaggccgtgaagagcctggagaccgagatcctggagagcctgaagagcgccggccaggagaacctggagaccctgaagagccccgagacccaggcccccctgtggacccccgaggagatcaaccagggcgccatgaaccccctggagaaggagatccaggagcccctggagagcgtggaggtgaaccaggagaccttcagactgctggaggaggagaaccaggagagcctgagaagcctgggcgcctggaacctggagaacctgagaagccccgaggaggtggacaaggagagccagagaaacctggaggaggaggagaacctgggcaagggcgagtaccaggagagcctgagaagcctggaggaggagggccaggagctgccccagagcgccgacgtgcagagatgggaggacaccgtggagaaggaccaggagctggcccaggagagcccccccggcatggccggcgtggagaacgaggacgaggccgagctgaacctgagagagcaggacggcttcaccggcaaggaggaggtggtggagcagggcgagctgaacgccaccgaggaggtgtggatccccggcgagggccaccccgagagccccgagcccaaggagcagagaggcctggtggagggcgccagcgtgaagggcggcgccgagggcctgcaggaccccgagggccagagccagcaggtgggcgcccccggcctgcaggccccccagggcctgcccgaggccatcgagcccctggtggaggacgacgtggcccccggcggcgaccaggccagccccgaggtgatgctgggcagcgagcccgccatgggcgagagcgccgccggcgccgagcccggccccggccagggcgtgggcggcctgggcgaccccggccacctgaccagagaggaggtgatggagccccccctggaggaggagagcctggaggccaagagagtgcagggcctggagggccccagaaaggacctggaggaggccggcggcctgggcaccgagttcagcgagctgcccggcaagagcagagacccctgggagccccccagagagggcagagaggagagcgaggccgaggcccccagaggcgccgaggaggccttccccgccgagaccctgggccacaccggcagcgacgcccccagcccctggcccctgggcagcgaggaggccgaggaggacgtgccccccgtgctggtgagccccagccccacctacacccccatcctggaggacgcccccggcccccagccccaggccgagggcagccaggaggccagctggggcgtgcagggcagagccgaggccctgggcaaggtggagagcgagcaggaggagctgggcagcggcgagatccccgagggcccccaggaggagggcgaggagagcagagaggagagcgaggaggacgagctgggcgagaccctgcccgacagcacccccctgggcttctacctgagaagccccaccagccccagatgggaccccaccggcgagcagagaccccccccccagggcgagaccggcaaggagggctgggaccccgccgtgctggccagcgagggcctggaggccccccccagcgagaaggaggagggcgaggagggcgaggaggagtgcggcagagacagcgacctgagcgaggagttcgaggacctgggcaccgaggcccccttcctgcccggcgtgcccggcgaggtggccgagcccctgggccaggtgccccagctgctgctggaccccgccgcctgggacagagacggcgagagcgacggcttcgccgacgaggaggagagcggcgaggagggcgaggaggaccaggaggagggcagagagcccggcgccggcagatggggccccggcagcagcgtgggcagcctgcaggccctgagcagcagccagagaggcgagttcctggagagcgacagcgtgagcgtgagcgtgccctgggacgacagcctgagaggcgccgtggccggcgcccccaagaccgccctggagaccgagagccaggacagcgccgagcccagcggcagcgaggaggagagcgaccccgtgagcctggagagagaggacaaggtgcccggccccctggagatccccagcggcatggaggacgccggccccggcgccgacatcatcggcgtgaacggccagggccccaacctggagggcaagagccagcacgtgaacggcggcgtgatgaacggcctggagcagagcgaggaggtgggccagggcatgcccctggtgagcgagggcgacagaggcagccccttccaggaggaggagggcagcgccctgaagaccagctgggccggcgcccccgtgcacctgggccagggccagttcctgaagttcacccagagagagggcgacagagagagctggagcagcggcgaggactag

SEQ ID NO: 10663 - DNA, 378 bp, Artificial Sequence
  Description of Artificial Sequence: Synthetic coding sequence
atggagagacacaccagccaccccaacagaaaggtgcccgccaaggaggaggccaacgccgtgcccctgtgcagagccaagcccagccccagctacatcaacctgcaggccagcagcccccccgccaccttcctgaacatccagaccaccaagctgcccagcgtggaccacaagcccaaggagtgcctgggcctgctggagtgcatgtacgccaacctgcagctgcagacccagctggcccagcagcagatggccgtgctggagcacctgcaggccagcgtgacccagctggcccccggcagaggcagcaacaacagcagcctgcccgccctgagccccaaccccctgctgaaccacctgccccagttcagcaagtag

SEQ ID NO: 10664 - DNA, 378 bp, Artificial Sequence; identical to SEQ ID NO: 10663
  Description of Artificial Sequence: Synthetic coding sequence

SEQ ID NO: 10665 - DNA, 378 bp, Artificial Sequence; identical to SEQ ID NO: 10663
  Description of Artificial Sequence: Synthetic coding sequence

SEQ ID NO: 10666 - DNA, 378 bp, Artificial Sequence; identical to SEQ ID NO: 10663
  Description of Artificial Sequence: Synthetic coding sequence

SEQ ID NO: 10667 - DNA, 378 bp, Artificial Sequence; identical to SEQ ID NO: 10663
  Description of Artificial Sequence: Synthetic coding sequence

SEQ ID NO: 10668 - DNA, 624 bp, Artificial Sequence
  Description of Artificial Sequence: Synthetic coding sequence
atggccgaggccagcagcgccaacctgggcagcggctgcgaggagaagagacacgagggcagcagcagcgagagcgtgccccccggcaccaccatcagcagagtgaagctgctggacaccatggtggacaccttcctgcagaagctggtggccgccggcagcagccccctgctgcactgggacggcagcgccggccccagactgcccagcggcggccagagcgtgaagcaggccttcagctgggccgcctgcagactgccccagggcagaaaggaggagatcagcgacatcaaggaggagggcaacctggaggccgtgctgaacgccctggacaagatcgtggaggagggcaaggtgagaaaggagcccgcctggagacccagcggcatccccgagaaggacctgcacagcgtgatggccccctacttcctgcagcagagagacaccctgagaagacacgtgcagaagcaggaggccgagaaccagcagctggccgacgccgtgctggccggcagaagacaggtggaggagctgcagctgcaggtgcaggcccagcagcaggcctggcaggccctgcacagagagcagagagagctggtggccgtgctgagagagcccgagtag

SEQ ID NO: 10669 - DNA, 618 bp, Artificial Sequence
  Description of Artificial Sequence: Synthetic coding sequence
atggccgaggccagcagcgccaacctgggcagcggctgcgaggagaagagacacgagggcagcagcagcgagagcgtgccccccggcaccaccatcagcagagtgaagctgctggacaccatggtggacaccttcctgcagaagctggtggccgccggcagctaccagagattcaccgactgctacaagtgcttctaccagctgcagcccgccatgacccagcagatctacgacaagttcatcgcccagctgcagaccagcatcagagaggagatcagcgacatcaaggaggagggcaacctggaggccgtgctgaacgccctggacaagatcgtggaggagggcaaggtgagaaaggagcccgcctggagacccagcggcatccccgagaaggacctgcacagcgtgatggccccctacttcctgcagcagagagacaccctgagaagacacgtgcagaagcaggaggccgagaaccagcagctggccgacgccgtgctggccggcagaagacaggtggaggagctgcagctgcaggtgcaggcccagcagcaggcctggcaggccctgcacagagagcagagagagctggtggccgtgctgagagagcccgagtag

SEQ ID NO: 10670 - DNA, 543 bp, Artificial Sequence
  Description of Artificial Sequence: Synthetic coding sequence
atggccgaggccagcagcgccaacctgggcagcggctgcgaggagaagagacacgagggcagcagcagcgagagcgtgccccccggcaccaccatcagcagagtgaagctgctggacaccatggtggacaccttcctgcagaagctggtggccgccggcagctaccagagattcaccgactgctacaagtgcttctaccagctgcagcccgccatgacccagcagatctacgacaagttcatcgcccagctgcagaccagcatcagagaggagatcagcgacatcaaggaggagggcaacctggaggccgtgctgaacgccctggacaagatcgtggaggagggcaaggtgagaaaggagcccgcctgcaacggcaccccctgcggcgccatgtgcagaaacagaagacccagaaccagcagctggcagatgcccagctggcagggcggcggcagatggagaagctgcagctacagaagcagacccagcagcagacccggcagactgtacaccgagaacagaggcagctggctgctgtgctag

SEQ ID NO: 10671 - DNA, 2253 bp, Artificial Sequence; identical to SEQ ID NO: 10318
  Description of Artificial Sequence: Synthetic coding sequence

SEQ ID NO: 10672 - DNA, 2667 bp, Artificial Sequence
  Description of Artificial Sequence: Synthetic coding sequence
atggccggcgtgggcagaagcggcggcccctggggcagaaccagaggcggcagaagcggcagactgggcgtgagcctgggcgccctgagcagcctgcccctggaggagctgcccagacccctgtgctgcagaagatgcagaagacacttcggcttcgccctgagaggcgagaccatccccgtgagcgtggccggcagcgccagcagccagttcgcccccctggccctgcacctgagcctgctgctgagcagaatcagcgccagcagactgaccagatggcccccccccgacaagagagagggcagcgccgtggaccccggcaagagaagaagcctggccgccacccccagcagcagcctgccctgcaccctgatcgccctgggcctgagacacgagaaggaggccaacgagctgatggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacctgctggccctgggcctgaagcacttcgagggcaccgagttcctgaaccccctgatcagcaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 10673 - DNA, 2607 bp, Artificial Sequence
  Description of Artificial Sequence: Synthetic coding sequence
atggccggcgtgggcagaagcggcggcccctggggcagaaccagaggcggcagaagcggcagactgggcgtgagcctgggcgccctgagcagcctgcccctggaggagctgcccagacccctgtgctgcagaagatgcagaagacacttcggcttcgccctgagaggcgagaccatccccgtgagcgtggccggcagcgccagcagccagttcgcccccctggccctgcacctgagcctgctgctgagcagaatcagcgccagcagactgaccagatggcccccccccgacaagagagagggcagcgccgtggaccccggcaagagaagaagcctggccgccacccccagcagcagcctgccctgcaccctgatcgccctgggcctgagacacgagaaggaggccaacgagctgatggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 10674 - DNA, 1575 bp, Artificial Sequence
  Description of Artificial Sequence: Synthetic coding sequence
atggccggcggcgccagagaggtgctgaccctgcagctgggccacttcgccggcttcgtgggcgcccactggtggaaccagcaggacgccgccctgggcagagccaccgacagcaaggagccccccggcgagctgtgccccgacgtgctgtacagaaccggcagaaccctgcacggccaggagacctacacccccagactgatcctgatggacctgaagggcagcctgagcagcctgaaggaggagggcggcctgtacagagacaagcagctggacgccgccatcgcctggcagggcaagctgaccacccacaagggcagcagccccctgcccaccgccaccacccccaagcccctgatccccaccgaggccagcatcagagtgtggagcgacttcctgagagtgcacctgcaccccagaagcatctgcatgatccagaagtacaaccacgacggcgaggccggcagactggaggccttcggccagggcgagagcgtgctgaaggagcccaagtaccaggaggagctggaggacagactgcacttctacgtggaggagtgcgactacctgcagggcttccagatcctgtgcgacctgcacgacggcttcagcggcgtgggcgccaaggccgccgagctgctgcaggacgagtacagcggcagaggcatcatcacctggggcctgctgcccggcccctaccacagaggcgaggcccagagaaacatctacagactgctgaacaccgccttcggcctggtgcacctgaccgcccacagcagcctggtgtgccccctgagcctgggcggcagcctgggcctgagacccgagccccccgtgagcttcccctacctgcactacgacgccaccctgcccttccactgcagcgccatcctggccaccgccctggacaccgtgaccgtgccctacagactgtgcagcagccccgtgagcatggtgcacctggccgacatgctgagcttctgcggcaagaaggtggtgaccgccggcgccatcatccccttccccctggcccccggccagagcctgcccgacagcctgatgcagttcggcggcgccaccccctggacccccctgagcgcctgcggcgagcccagcggcaccagatgcttcgcccagagcgtggtgctgagaggcatcgacagagcctgccacaccagccagctgacccccggcacccccccccccagcgccctgcacgcctgcaccaccggcgaggagatcctggcccagtacctgcagcagcagcagcccggcgtgatgagcagcagccacctgctgctgaccccctgcagagtggcccccccctacccccacctgttcagcagctgcagcccccccgccgtggagagcatccccgtgttcggcgccctgtgcagcagcagcagcctgcaccagaccctggaggccctggccagagacctgaccaagctggacctgagaagatgggccagcttcatggacgccggcgtggagcacgacgacgtggccgagctgctgcaggagctgcagagcctggcccagtgctaccagggcggcgacagcctggtggactag

SEQ ID NO: 10675 - DNA, 1479 bp, Artificial Sequence
  Description of Artificial Sequence: Synthetic coding sequence
atgccccccacctgcagccccggcctgagaagacaggactgggcccccggcagatgcgccggcctgcacctgccccccagagcccccagcagccccgccctgcaggccctggccggccaggccggcgtgagaagcagctggagcttcgccggcgtgcccggcgcccagagactgtggatggccgaggcccagagcggcaccggccagctgcaggagcagaagaagggcctgctgatcgccgtgagcgtgagcgtggacaagatcatcagccacttcggcgccgccagaaacctggtgcagaaggcccagctgggcgacagcagactgagccccgacgtgggccacctggtgctgaccaccctgtgccccgccctgcacgccctggtggccgacggcctgaagcccttcagaaaggacctgatcaccggccagagaagaagcagcccctggagcgtggtggaggccagcgtgaagcccggcagcagcaccagaagcctgggcaccctgtacagccaggtgagcagactggcccccctgagcagcagcagaagcagattccacgccttcatcctgggcctgctgaacaccaagcagctggagctgtggttcagcagcctgcaggaggacgccggcctgctgagcctgctgtacctgcccaccggcttcttcagcctggccagaggcggctgccccagcctgagcaccgagctgctgctgctgctgcagcccctgagcgtgctgaccttccacctggacctgctgttcgagcaccaccaccacctgcccctgggccccccccaggcccccgccccccccggccccccccccgccctgcagcagaccatgcaggccatgctgcacttcggcggcagactggcccagagcctgagaggcaccagcaaggaggccgccagcgaccccagcgacagccccaacctgcccacccccggcagctggtgggagcagctgacccaggccagcagagtgtacgccagcggcggcaccgagggcttccccctgagcagatgggcccccggcagacacggcaccgccgccgaggagggcgcccaggagagacccctgcccaccgacgagatggcccccggcagaggcctgtggctgggcagactgttcggcgtgcccggcggccccgccgagaacgagaacggcgccctgaagagcagaagacccagcagctggctgccccccaccgtgagcgtgctggccctggtgaagagaggcgccccccccgagatgcccagcccccaggagctggaggccagcgcccccagaatggtgcagacccacagagccgtgagagccctgtgcgaccacaccgccgccagacccgaccagctgagcttcagaagaggcgaggtgctgagagtgatcaccaccgtggacgaggactggctgagatgcggcagagacggcatggagggcctggtgcccgtgggctacaccagcctggtgctgtag

SEQ ID NO: 10676 - DNA, 1302 bp, Artificial Sequence; identical to SEQ ID NO: 9646
  Description of Artificial Sequence: Synthetic coding sequence

SEQ ID NO: 10677 - DNA, 2709 bp, Artificial Sequence
  Description of Artificial Sequence: Synthetic coding sequence
atgctgagcccccagagagccctgctgtgcaacctgaaccacatccacctgcagcacgtgagcctgggcctgcacctgagcagaagacccgagctgcaggagggccccctgagcaccccccccccccccggcgacaccggcggcaaggagagcagaggcccctgcagcggcaccctggtggacgccaacagcaacagccccgccgtgccctgcagatgctgccaggagcacggccccggcctggagaacagacaggaccccagccaggaggaggagggcgccgccagccccagcgaccccggctgcagcagcagcctgagcagctgcagcgacctgagccccgacgagagccccgtgagcgtgtacctgagagacctgcccggcgacgaggacgcccacccccagcccagcatcatccccctggagcagggcagccccctggccagcgccggccccggcacctgcagccccgacagcttctgctgcagccccgacagctgcagcggcgccagcagcagccccgaccccggcctggacagcaactgcaacgccctgaccacctgccaggacgtgcccagccccggcctggaggaggaggacgagagagccgagcaggacctgcccaccagcgagctgctggaggccgacgacggcaagatcgacgccggcaagaccgagcccagctggaagatcaaccccatctggaagatcgacaccgagaagaccaaggccgagtggaagaccaccgagaacaacaacaccggctggaagaacaacggcaacgtgaacagcagctggaagagcgagcccgagaagttcgacagcggctggaagaccaacaccagaatcaccgacagcggcagcaagaccgacgccggcaagatcgacggcggctggagaagcgacgtgagcgaggagcccgtgccccacagaaccatcaccagcttccacgagctggcccagaagagaaagagaggccccggcctgcccctggtgccccaggccaagaaggacagaagcgactggctgatcgtgttcagccccgacaccgagctgccccccagcggcagccccggcggcagcagcgccccccccagagaggtgaccaccttcaaggagctgagaagcagaagcagagcccccgccccccccgtgccccccagagacccccccgtgggctgggccctggtgccccccagacccccccccccccccgtgccccccagaagaaagaagaacagacccggcctgcagcccatcgccgagggccagagcgaggagggcagagccgtgagccccgccgccggcgaggaggcccccgccgccaaggagcccggcgcccaggccggcctggaggtgagaagcagctggagcttcgccggcgtgcccggcgcccagagactgtggatggccgaggcccagagcggcaccggccagctgcaggagcagaagaagggcctgctgatcgccgtgagcgtgagcgtggacaagatcatcagccacttcggcgccgccagaaacctggtgcagaaggcccagctgggcgacagcagactgagccccgacgtgggccacctggtgctgaccaccctgtgccccgccctgcacgccctggtggccgacggcctgaagcccttcagaaaggacctgatcaccggccagagaagaagcagcccctggagcgtggtggaggccagcgtgaagcccggcagcagcaccagaagcctgggcaccctgtacagccaggtgagcagactggcccccctgagcagcagcagaagcagattccacgccttcatcctgggcctgctgaacaccaagcagctggagctgtggttcagcagcctgcaggaggacgccggcctgctgagcctgctgtacctgcccaccggcttcttcagcctggccagaggcggctgccccagcctgagcaccgagctgctgctgctgctgcagcccctgagcgtgctgaccttccacctggacctgctgttcgagcaccaccaccacctgcccctgggccccccccaggcccccgccccccccggccccccccccgccctgcagcagaccatgcaggccatgctgcacttcggcggcagactggcccagagcctgagaggcaccagcaaggaggccgccagcgaccccagcgacagccccaacctgcccacccccggcagctggtgggagcagctgacccaggccagcagagtgtacgccagcggcggcaccgagggcttccccctgagcagatgggcccccggcagacacggcaccgccgccgaggagggcgcccaggagagacccctgcccaccgacgagatggcccccggcagaggcctgtggctgggcagactgttcggcgtgcccggcggccccgccgagaacgagaacggcgccctgaagagcagaagacccagcagctggctgccccccaccgtgagcgtgctggccctggtgaagagaggcgccccccccgagatgcccagcccccaggagctggaggccagcgcccccagaatggtgcagacccacagagccgtgagagccctgtgcgaccacaccgccgccagacccgaccagctgagcttcagaagaggcgaggtgctgagagtgatcaccaccgtggacgaggactggctgagatgcggcagagacggcatggagggcctggtgcccgtgggctacaccagcctggtgctgtag

SEQ ID NO: 10678 - DNA, 2391 bp, Artificial Sequence
  Description of Artificial Sequence: Synthetic coding sequence
atgctgagcccccagagagccctgctgtgcaacctgaaccacatccacctgcagcacgtgagcctgggcctgcacctgagcagaagacccgagctgcaggagggccccctgagcaccccccccccccccggcgacaccggcggcaaggagagcagaggcccctgcagcggcaccctggtggacgccaacagcaacagccccgccgtgccctgcagatgctgccaggagcacggccccggcctggagaacagacaggaccccagccaggaggaggagggcgccgccagccccagcgaccccggctgcagcagcagcctgagcagctgcagcgacctgagccccgacgagagccccgtgagcgtgtacctgagagacctgcccggcgacgaggacgcccacccccagcccagcatcatccccctggagcagggcagccccctggccagcgccggccccggcacctgcagccccgacagcttctgctgcagccccgacagctgcagcggcgccagcagcagccccgaccccggcctggacagcaactgcaacgccctgaccacctgccaggacgtgcccagccccggcctggaggaggaggacgagagagccgagcaggacctgcccaccagcgagctgctggaggccgacgacggcaagatcgacgccggcaagaccgagcccagctggaagatcaaccccatctggaagatcgacaccgagaagaccaaggccgagtggaagaccaccgagaacaacaacaccggctggaagaacaacggcaacgtgaacagcagctggaagagcgagcccgagaagttcgacagcggctggaagaccaacaccagaatcaccgacagcggcagcaagaccgacgccggcaagatcgacggcggctggagaagcgacgtgagcgaggagcccgtgccccacagaaccatcaccagcttccacgagctggcccagaagagaaagagaggccccggcctgcccctggtgccccaggccaagaaggacagaagcgactggctgatcgtgttcagccccgacaccgagctgccccccagcggcagccccggcggcagcagcgccccccccagagaggtgaccaccttcaaggagctgagaagcagaagcagagcccccgccccccccgtgccccccagagacccccccgtgggctgggccctggtgccccccagacccccccccccccccgtgccccccagaagaaagaagaacagacccggcctgcagcccatcgccgagggccagagcgaggagggcagagccgtgagccccgccgccggcgaggaggcccccgccgccaaggagcccggcgcccaggccggcctggaggtgagaagcagctggagcttcgccggcgtgcccggcgcccagagactgtggatggccgaggcccagagcggcaccggccagctgcaggagcagaagaagggcctgctgatcgccgtgagcgtgagcgtggacaagatcatcagccacttcggcgccgccagaaacctggtgcagaaggcccagctgggcgacagcagactgagccccgacgtgggccacctggtgctgaccaccctgtgccccgccctgcacgccctggtggccgacggcctgaagcccttcagaaaggacctgatcaccggccagagaagaagcagcccctggagcgtggtggaggccagcgtgaagcccggcagcagcaccagaagcctgggcaccctgtacagccaggtgagcagactggcccccctgagcagcagcagaagcagattccacgccttcatcctgggcctgctgaacaccaagcagctggagctgtggttcagcagcctgcaggaggacgccggcagctggtgggagcagctgacccaggccagcagagtgtacgccagcggcggcaccgagggcttccccctgagcagatgggcccccggcagacacggcaccgccgccgaggagggcgcccaggagagacccctgcccaccgacgagatggcccccggcagaggcctgtggctgggcagactgttcggcgtgcccggcggccccgccgagaacgagaacggcgccctgaagagcagaagacccagcagctggctgccccccaccgtgagcgtgctggccctggtgaagagaggcgccccccccgagatgcccagcccccaggagctggaggccagcgcccccagaatggtgcagacccacagagccgtgagagccctgtgcgaccacaccgccgccagacccgaccagctgagcttcagaagaggcgaggtgctgagagtgatcaccaccgtggacgaggactggctgagatgcggcagagacggcatggagggcctggtgcccgtgggctacaccagcctggtgctgtag

SEQ ID NO: 10679 - DNA, 513 bp, Artificial Sequence
  Description of Artificial Sequence: Synthetic coding sequence
atggccagcgtgagcagcgccaccttcagcggccacggcgccagaagcctgctgcagttcctgagactggtgggccagctgaagagagtgcccagaaccggctgggtgtacagaaacgtgcagagacccgagagcgtgagcgaccacatgtacagaatggccgtgatggccatggtgatcaaggacgacagactgaacaaggacagagaggccatgaagcagatcacccagctgctgcccgaggacctgagaaaggagctgtacgagctgtgggaggagtacgagacccagagcagcgccgaggccaagttcgtgaagcagctggaccagtgcgagatgatcctgcaggccagcgagtacgaggacctggagcacaagcccggcagactgcaggacttctacgacagcaccgccggcaagttcaaccaccccgagatcgtgcagctggtgagcgagctggaggccgagagaagcaccaacatcgccgccgccgccagcgagccccacagctag

SEQ ID NO: 10680 - DNA, 396 bp, Artificial Sequence
  Description of Artificial Sequence: Synthetic coding sequence
atggaggcccaggcccagggcctgctggagaccgagcccctgcagggcaccgacgaggacgccgtggccagcgccgacttcagcagcatgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagaagaaagtag

SEQ ID NO: 10681 - DNA, 435 bp, Artificial Sequence
  Description of Artificial Sequence: Synthetic coding sequence
atggaggcccaggcccagggcctgctggagaccgagcccctgcagggcaccgacgaggacgccgtggccagcgccgacttcagcagcatgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagctacagcatcagacacagcatcagcatgcccgccatgagaagaaagtag

SEQ ID NO: 10682 - DNA, 948 bp, Artificial Sequence
  Description of Artificial Sequence: Synthetic coding sequence
atggccagctgccccgacagcgacaacagctgggtgctggccggcagcgagagcctgcccgtggagaccctgggccccgccagcagaatggaccccgagagcgagagagccctgcaggccccccacagccccagcaagaccgacggcaaggagctggccggcaccatggacggcgagggcaccctgttccagaccgagagcccccagagcggcagcatcctgaccgaggagaccgaggtgaagggcaccctggagggcgacgtgtgcggcgtggagccccccggccccggcgacaccgtggtgcagggcgacctgcaggagaccaccgtggtgaccggcctgggccccgacacccaggacctggagggccagagccccccccagagcctgcccagcacccccaaggccgcctggatcagagaggagggcagatgcagcagcagcgacgacgacaccgacgtggacatggagggcctgagaagaagaagaggcagagaggccggccccccccagcccatggtgcccctggccgtggagaaccaggccggcggcggcctgagcgagagcgagaccggccccatggaggaggtggagagacaggtgctgcccgaccccgaggtgctggaggccgtgggcgacagacaggacggcctgagagagcagctgcaggcccccgtgccccccgacagcgtgcccagcctgcagaacatgggcctgctgctggacaagctggccaaggagaaccaggacatcagactgctgcaggcccagctgcaggtgggcaccggcagaagaggctgggccagagtgacccacctgggccaggccagcgtgctggccagcagccccaagagaaacgtgagctacctgcccacccaccccgacccccccctgagccactacagccagggcgtgttccccgtgctgggcagccaccccctgtgctag

SEQ ID NO: 10683 - DNA, 2196 bp, Artificial Sequence
  Description of Artificial Sequence: Synthetic coding sequence
atggccagctgccccgacagcgacaacagctgggtgctggccggcagcgagagcctgcccgtggagaccctgggccccgccagcagaatggaccccgagagcgagagagccctgcaggccccccacagccccagcaagaccgacggcaaggagctggccggcaccatggacggcgagggcaccctgttccagaccgagagcccccagagcggcagcatcctgaccgaggagaccgaggtgaagggcaccctggagggcgacgtgtgcggcgtggagccccccggccccggcgacaccgtggtgcagggcgacctgcaggagaccaccgtggtgaccggcctgggccccgacacccaggacctggagggccagagccccccccagagcctgcccagcacccccaaggccgcctggatcagagaggagggcagatgcagcagcagcgacgacgacaccgacgtggacatggagggcctgagaagaagaagaggcagagaggccggccccccccagcccatggtgcccctggccgtggagaaccaggccggcggcgagggcgccggcggcgagctgggcatcagcctgaacatgtgcctgctgggcgccctggtgctgctgggcctgggcgtgctgctgttcagcggcggcctgagcgagagcgagaccggccccatggaggaggtggagagacaggtgctgcccgaccccgaggtgctggaggccgtgggcgacagacaggacggcctgagagagcagctgcaggcccccgtgccccccgacagcgtgcccagcctgcagaacatgggcctgctgctggacaagctggccaaggagaaccaggacatcagactgctgcaggcccagctgcaggcccagaaggaggagctgcagagcctgatgcaccagcccaagggcctggaggaggagaacgcccagctgagaggcgccctgcagcagggcgaggccttccagagagccctggagagcgagctgcagcagctgagagccagactgcagggcctggaggccgactgcgtgagaggccccgacggcgtgtgcctgagcggcggcagaggcccccagggcgacaaggccatcagagagcagggccccagagagcaggagcccgagctgagcttcctgaagcagaaggagcagctggaggccgaggcccaggccctgagacaggagctggagagacagagaagactgctgggcagcgtgcagcaggacctggagagaagcctgcaggacgccagcagaggcgaccccgcccacgccggcctggccgagctgggccacagactggcccagaagctgcagggcctggagaactggggccaggaccccggcgtgagcgccaacgccagcaaggcctggcaccagaagagccacttccagaacagcagagagtggagcggcaaggagaagtggtgggacggccagagagacagaaaggccgagcactggaagcacaagaaggaggagagcggcagagagagaaagaagaactggggcggccaggaggacagagagcccgccggcagatggaaggagggcagacccagagtggaggagagcggcagcaagaaggagggcaagagacagggccccaaggagccccccagaaagagcggcagcttccacagcagcggcgagaagcagaagcagcccagatggagagagggcaccaaggacagccacgaccccctgcccagctgggccgagctgctgagacccaagtacagagccccccagggctgcagcggcgtggacgagtgcgccagacaggagggcctgaccttcttcggcaccgagctggcccccgtgagacagcaggagctggccagcctgctgagaacctacctggccagactgccctgggccggccagctgaccaaggagctgcccctgagccccgccttcttcggcgaggacggcatcttcagacacgacagactgagattcagagacttcgtggacgccctggaggacagcctggaggaggtggccgtgcagcagaccggcgacgacgacgaggtggacgacttcgaggacttcatcttcagccacttcttcggcgacaaggccctgaagaagagaagcggcaagaaggacaagcacagccagagccccagagccgccggccccagagagggccacagccacagccaccaccaccaccacagaggctag

SEQ ID NO: 10684 - DNA, 2109 bp, Artificial Sequence
  Description of Artificial Sequence: Synthetic coding sequence
atggaccccgagagcgagagagccctgcaggccccccacagccccagcaagaccgacggcaaggagctggccggcaccatggacggcgagggcaccctgttccagaccgagagcccccagagcggcagcatcctgaccgaggagaccgaggtgaagggcaccctggagggcgacgtgtgcggcgtggagccccccggccccggcgacaccgtggtgcagggcgacctgcaggagaccaccgtggtgaccggcctgggccccgacacccaggacctggagggccagagccccccccagagcctgcccagcacccccaaggccgcctggatcagagaggagggcagatgcagcagcagcgacgacgacaccgacgtggacatggagggcctgagaagaagaagaggcagagaggccggccccccccagcccatggtgcccctggccgtggagaaccaggccggcggcgagggcgccggcggcgagctgggcatcagcctgaacatgtgcctgctgggcgccctggtgctgctgggcctgggcgtgctgctgttcagcggcggcctgagcgagagcgagaccggccccatggaggaggtggagagacaggtgctgcccgaccccgaggtgctggaggccgtgggcgacagacaggacggcctgagagagcagctgcaggcccccgtgccccccgacagcgtgcccagcctgcagaacatgggcctgctgctggacaagctggccaaggagaaccaggacatcagactgctgcaggcccagctgcaggcccagaaggaggagctgcagagcctgatgcaccagcccaagggcctggaggaggagaacgcccagctgagaggcgccctgcagcagggcgaggccttccagagagccctggagagcgagctgcagcagctgagagccagactgcagggcctggaggccgactgcgtgagaggccccgacggcgtgtgcctgagcggcggcagaggcccccagggcgacaaggccatcagagagcagggccccagagagcaggagcccgagctgagcttcctgaagcagaaggagcagctggaggccgaggcccaggccctgagacaggagctggagagacagagaagactgctgggcagcgtgcagcaggacctggagagaagcctgcaggacgccagcagaggcgaccccgcccacgccggcctggccgagctgggccacagactggcccagaagctgcagggcctggagaactggggccaggaccccggcgtgagcgccaacgccagcaaggcctggcaccagaagagccacttccagaacagcagagagtggagcggcaaggagaagtggtgggacggccagagagacagaaaggccgagcactggaagcacaagaaggaggagagcggcagagagagaaagaagaactggggcggccaggaggacagagagcccgccggcagatggaaggagggcagacccagagtggaggagagcggcagcaagaaggagggcaagagacagggccccaaggagccccccagaaagagcggcagcttccacagcagcggcgagaagcagaagcagcccagatggagagagggcaccaaggacagccacgaccccctgcccagctgggccgagctgctgagacccaagtacagagccccccagggctgcagcggcgtggacgagtgcgccagacaggagggcctgaccttcttcggcaccgagctggcccccgtgagacagcaggagctggccagcctgctgagaacctacctggccagactgccctgggccggccagctgaccaaggagctgcccctgagccccgccttcttcggcgaggacggcatcttcagacacgacagactgagattcagagacttcgtggacgccctggaggacagcctggaggaggtggccgtgcagcagaccggcgacgacgacgaggtggacgacttcgaggacttcatcttcagccacttcttcggcgacaaggccctgaagaagagaagcggcaagaaggacaagcacagccagagccccagagccgccggccccagagagggccacagccacagccaccaccaccaccacagaggctag

SEQ ID NO: 10685 - DNA, 2427 bp, Artificial Sequence
  Description of Artificial Sequence: Synthetic coding sequence
atgatctggagaaacaactggaagagcaccaccggcagactgaacgtgaagctgcagagcgacaagctgcagcacggctgcggccccgactacagcagcgcctggctgcccgccaacgagagcctgtggcaggccaccaccgtgcccagcaaccacagaaacaaccacatcagaagacacagcatcgccagcgacagcggcgacaccggcatcggcaccagctgcagcgacagcgtggaggaccacagcaccagcagcggcaccctgagcttcaagcccagccagagcctgatcaccctgcccaccgcccacgtgatgcccagcaacagcagcgccagcatcagcaagctgagagagagcctgacccccgacggcagcaagtggagcaccagcctgatgcagaccctgggcaaccacagcagaggcgagcaggacagcagcctggacatgaaggacttcagacccctgagaaagtggagcagcctgagcaagctgaccgcccccgacaactgcggccagggcggcaccgtgtgcagagaggagagcagaaacggcctggagaagatcggcaaggccaaggccctgaccagccagctgagaaccatcggccccagctgcctgcacgacagcatggagatgctgagactggaggacaaggagatcaacaagaagagaagcagcaccctggactgcaagtacaagttcgagagctgcagcaaggaggacttcagagccagcagcagcaccctgagaagacagcccgtggacatgacctacagcgccctgcccgagagcaagcccatcatgaccagcagcgaggccttcgagccccccaagtacctgatgctgggccagcaggccgtgggcggcgtgcccatccagcccagcgtgagaacccagatgtggctgaccgagcagctgagaaccaaccccctggagggcagaaacaccgaggacagctacagcctggccccctggcagcagcagcagatcgaggacttcagacagggcagcgagacccccatgcaggtgctgaccggcagcagcagacagagctacagccccggctaccaggacttcagcaagtgggagagcatgctgaagatcaaggagggcctgctgagacagaaggagatcgtgatcgacagacagaagcagcagatcacccacctgcacgagagaatcagagacaacgagctgagagcccagcacgccatgctgggccactacgtgaactgcgaggacagctacgtggccagcctgcagccccagtacgagaacaccagcctgcagacccccttcagcgaggagagcgtgagccacagccagcagggcgagttcgagcagaagctggccagcaccgagaaggaggtgctgcagctgaacgagttcctgaagcagagactgagcctgttcagcgaggagaagaagaagctggaggagaagctgaagaccagagacagatacatcagcagcctgaagaagaagtgccagaaggagagcgagcagaacaaggagaagcagagaagaatcgagaccctggagaagtacctggccgacctgcccaccctggacgacgtgcagagccagagcctgcagctgcagatcctggaggagaagaacaagaacctgcaggaggccctgatcgacaccgagaagaagctggaggagatcaagaagcagtgccaggacaaggagacccagctgatctgccagaagaagaaggagaaggagctggtgaccaccgtgcagagcctgcagcagaaggtggagagatgcctggaggacggcatcagactgcccatgctggacgccaagcagctgcagaacgagaacgacaacctgagacagcagaacgagaccgccagcaagatcatcgacagccagcaggacgagatcgacagaatgatcctggagatccagagcatgcagggcaagctgagcaaggagaagctgaccacccagaagatgatggaggagctggagaagaaggagagaaacgtgcagagactgaccaaggccctgctggagaaccagagacagaccgacgagacctgcagcctgctggaccagggccaggagcccgaccagagcagacagcagaccgtgctgagcaagagacccctgttcgacctgaccgtgatcgaccagctgttcaaggagatgagctgctgcctgttcgacctgaaggccctgtgcagcatcctgaaccagagagcccagggcaaggagcccaacctgagcctgctgctgggcatcagaagcatgaactgcagcgccgaggagaccgagaacgaccacagcaccgagaccctgaccaagaagctgagcgacgtgtgccagctgagaagagacatcgacgagctgagaaccaccatcagcgacagatacgcccaggacatgggcgacaactgcatcacccagtag

SEQ ID NO: 10686 - DNA, 2418 bp, Artificial Sequence
  Description of Artificial Sequence: Synthetic coding sequence
atgtggggcagattcctggcccccgaggccagcggcagagacagccccggcggcgccagaagcttccccgccggccccgactacagcagcgcctggctgcccgccaacgagagcctgtggcaggccaccaccgtgcccagcaaccacagaaacaaccacatcagaagacacagcatcgccagcgacagcggcgacaccggcatcggcaccagctgcagcgacagcgtggaggaccacagcaccagcagcggcaccctgagcttcaagcccagccagagcctgatcaccctgcccaccgcccacgtgatgcccagcaacagcagcgccagcatcagcaagctgagagagagcctgacccccgacggcagcaagtggagcaccagcctgatgcagaccctgggcaaccacagcagaggcgagcaggacagcagcctggacatgaaggacttcagacccctgagaaagtggagcagcctgagcaagctgaccgcccccgacaactgcggccagggcggcaccgtgtgcagagaggagagcagaaacggcctggagaagatcggcaaggccaaggccctgaccagccagctgagaaccatcggccccagctgcctgcacgacagcatggagatgctgagactggaggacaaggagatcaacaagaagagaagcagcaccctggactgcaagtacaagttcgagagctgcagcaaggaggacttcagagccagcagcagcaccctgagaagacagcccgtggacatgacctacagcgccctgcccgagagcaagcccatcatgaccagcagcgaggccttcgagccccccaagtacctgatgctgggccagcaggccgtgggcggcgtgcccatccagcccagcgtgagaacccagatgtggctgaccgagcagctgagaaccaaccccctggagggcagaaacaccgaggacagctacagcctggccccctggcagcagcagcagatcgaggacttcagacagggcagcgagacccccatgcaggtgctgaccggcagcagcagacagagctacagccccggctaccaggacttcagcaagtgggagagcatgctgaagatcaaggagggcctgctgagacagaaggagatcgtgatcgacagacagaagcagcagatcacccacctgcacgagagaatcagagacaacgagctgagagcccagcacgccatgctgggccactacgtgaactgcgaggacagctacgtggccagcctgcagccccagtacgagaacaccagcctgcagacccccttcagcgaggagagcgtgagccacagccagcagggcgagttcgagcagaagctggccagcaccgagaaggaggtgctgcagctgaacgagttcctgaagcagagactgagcctgttcagcgaggagaagaagaagctggaggagaagctgaagaccagagacagatacatcagcagcctgaagaagaagtgccagaaggagagcgagcagaacaaggagaagcagagaagaatcgagaccctggagaagtacctggccgacctgcccaccctggacgacgtgcagagccagagcctgcagctgcagatcctggaggagaagaacaagaacctgcaggaggccctgatcgacaccgagaagaagctggaggagatcaagaagcagtgccaggacaaggagacccagctgatctgccagaagaagaaggagaaggagctggtgaccaccgtgcagagcctgcagcagaaggtggagagatgcctggaggacggcatcagactgcccatgctggacgccaagcagctgcagaacgagaacgacaacctgagacagcagaacgagaccgccagcaagatcatcgacagccagcaggacgagatcgacagaatgatcctggagatccagagcatgcagggcaagctgagcaaggagaagctgaccacccagaagatgatggaggagctggagaagaaggagagaaacgtgcagagactgaccaaggccctgctggagaaccagagacagaccgacgagacctgcagcctgctggaccagggccaggagcccgaccagagcagacagcagaccgtgctgagcaagagacccctgttcgacctgaccgtgatcgaccagctgttcaaggagatgagctgctgcctgttcgacctgaaggccctgtgcagcatcctgaaccagagagcccagggcaaggagcccaacctgagcctgctgctgggcatcagaagcatgaactgcagcgccgaggagaccgagaacgaccacagcaccgagaccctgaccaagaagctgagcgacgtgtgccagctgagaagagacatcgacgagctgagaaccaccatcagcgacagatacgcccaggacatgggcgacaactgcatcacccagtag

SEQ ID NO: 10687 - DNA, 1488 bp, Artificial Sequence
  Description of Artificial Sequence: Synthetic coding sequence
atggtggaggagcacgagctgagaaaggagagaatccaggaggactacaacgacaagtactgggaccagagatacaccatcgtgcagcagcagatccccagcttcctgcagaagatggccgacaagatcctgagcaccggcaagtacctgaacgtggtgagagagtgcggccacgacgtgacctgccccgtggccaaggagatcatctacaccctgaaggagagagcctacgtggagcagatcgagaaggccttcaactacgccagcaaggtgctgctggacttcctgatggaggagaaggagctggtggcccacctgagaagcatcaagagatacttcctgatggaccagggcgacttcttcgtgcacttcatggacctggccgaggaggagctgagaaagcccgtggaggacatcaccccccccagactggaggccctgctggagctggccctgagaatgagcaccgccaacaccgaccccttcaaggacgacctgaagatcgacctgatgccccacgacctgatcacccagctgctgagagtgctggccatcgagaccaagcaggagaaggccatggcccacgccgaccccaccgagctggccctgagcggcctggaggccttcagcttcgactacatcgtgaagtggcccctgagcctgatcatcaacagaaaggccctgaccagataccagatgctgttcagacacatgttctactgcaagcacgtggagagacagctgtgcagcgtgtggatcagcaacaagaccgccaagcagcacagcctgcacagcgcccagtggttcgccggcgccttcaccctgagacagagaatgctgaacttcgtgcagaacatccagtactacatgatgttcgaggtgatggagcccacctggcacatcctggagaagaacctgaagagcgccagcaacatcgacgacgtgctgggccaccacaccggcttcctggacacctgcctgaaggactgcatgctgaccaaccccgagctgctgaaggtgttcagcaagctgatgagcgtgtgcgtgatgttcaccaactgcatgcagaagttcacccagagcatgaagctggacggcgagctgggcggccagaccctggagcacagcaccgtgctgggcctgcccgccggcgccgaggagagagccagaaaggagctggccagaaagcacctggccgagcacgccgacaccgtgcagctggtgagcggcttcgaggccaccatcaacaagttcgacaagaacttcagcgcccacctgctggacctgctggccagactgagcatctacagcaccagcgactgcgagcacggcatggccagcgtgatcagcagactggacttcaacggcttctacaccgagagactggagagactgagcgccgagagaagccagaaggccaccccccaggtgcccgtgctgagaggcccccccgcccccgcccccagagtggccgtgaccgcccagtag

SEQ ID NO: 10688 - DNA, 2709 bp, Artificial Sequence; identical to SEQ ID NO: 9341
  Description of Artificial Sequence: Synthetic coding sequence

SEQ ID NO: 10689 - DNA, 1620 bp, Artificial Sequence; identical to SEQ ID NO: 10413
  Description of Artificial Sequence: Synthetic coding sequence

SEQ ID NO: 10690 - DNA, 453 bp, Artificial Sequence
  Description of Artificial Sequence: Synthetic coding sequence
atgagaggcgacagaggcagaggcagaggcggcagattcggcagcagaggcggccccggcggcggcttcagacccttcgtgccccacatccccttcgacttctacctgtgcgagatggccttccccagagtgaagcccgcccccgacgagaccagcttcagcgaggccctgctgaagagaaaccaggacctggcccccaacagcgccgagcaggccagcatcctgagcctggtgaccaagatcaacaacgtgatcgacaacctgatcgtggcccccggcaccttcgaggtgcagatcgaggaggtgagacaggtgggcagctacaagaagggcaccatgaccaccggccacaacgtggccgacctggtggtgatcctgaagatcctgcccacctgcgagtgcgcctgcttctggagctgggagcagaacatcgccctgggcctgggcgtgtag

SEQ ID NO: 10691 - DNA, 348 bp, Artificial Sequence
  Description of Artificial Sequence: Synthetic coding sequence
atggccttccccagagtgaagcccgcccccgacgagaccagcttcagcgaggccctgctgaagagaaaccaggacctggcccccaacagcgccgagcaggccagcatcctgagcctggtgaccaagatcaacaacgtgatcgacaacctgatcgtggcccccggcaccttcgaggtgcagatcgaggaggtgagacaggtgggcagctacaagaagggcaccatgaccaccggccacaacgtggccgacctggtggtgatcctgaagatcctgcccaccctggaggccgtggccgccctgggcaacaaggtggtggagagcctgagagcccaggaccccagcgagtag

SEQ ID NO: 10692 - DNA, 312 bp, Artificial Sequence
  Description of Artificial Sequence: Synthetic coding sequence
atgagcgactgctacaccgagctggagaaggccgtgatcgtgctggtggagaacttctacaagtacgtgagcaagtacagcctggtgaagaacaagatcagcaagagcagcttcagagagatgctgcagaaggagctgaaccacatgctgagcgacaccggcaacagaaaggccgccgacaagctgatccagaacctggacgccaaccacgacggcagaatcagcttcgacgagtactggaccctgatcggcggcatcaccggccccatcgccaagctgatccacgagcaggagcagcagagcagcagctag

SEQ ID NO: 10693 - DNA, 312 bp, Artificial Sequence; identical to SEQ ID NO: 10692
  Description of Artificial Sequence: Synthetic coding sequence

SEQ ID NO: 10694 - DNA, 312 bp, Artificial Sequence; identical to SEQ ID NO: 10692
  Description of Artificial Sequence: Synthetic coding sequence

SEQ ID NO: 10695 - DNA, 312 bp, Artificial Sequence; identical to SEQ ID NO: 10692
  Description of Artificial Sequence: Synthetic coding sequence

SEQ ID NO: 10696 - DNA, 306 bp, Artificial Sequence; identical to SEQ ID NO: 10041
  Description of Artificial Sequence: Synthetic coding sequence

SEQ ID NO: 10697 - DNA, 306 bp, Artificial Sequence; identical to SEQ ID NO: 10041
  Description of Artificial Sequence: Synthetic coding sequence

SEQ ID NO: 10698 - DNA, 222 bp, Artificial Sequence
  Description of Artificial Sequence: Synthetic coding sequence
atgagctaccagcagcagcagtgcaagcagccctgccagcccccccccgtgtgccccacccccaagtgccccgagccctgccccccccccaagtgccccgagccctacctgccccccccctgcccccccgagcactgccccccccccccctgccaggacaagtgcccccccgtgcagccctaccccccctgccagcagaagtacccccccaagagcaagtag

SEQ ID NO: 10699 - DNA, 219 bp, Artificial Sequence
  Description of Artificial Sequence: Synthetic coding sequence
atgagctaccagcagcagcagtgcaagcagccctgccagcccccccccgtgtgccccacccccaagtgccccgagccctgccccccccccaagtgccccgagccctgccccccccccaagtgcccccagccctgccccccccagcagtgccagcagaagtgcccccccgtgacccccagccccccctgccagcccaagtgcccccccaagagcaagtag

SEQ ID NO: 10700 - DNA, 219 bp, Artificial Sequence; identical to SEQ ID NO: 10699
  Description of Artificial Sequence: Synthetic coding sequence

SEQ ID NO: 10701 - DNA, 219 bp, Artificial Sequence; identical to SEQ ID NO: 10522
  Description of Artificial Sequence: Synthetic coding sequence

SEQ ID NO: 10702 - DNA, 219 bp, Artificial Sequence; identical to SEQ ID NO: 10522
  Description of Artificial Sequence: Synthetic coding sequence

SEQ ID NO: 10703 - DNA, 219 bp, Artificial Sequence; identical to SEQ ID NO: 10522
  Description of Artificial Sequence: Synthetic coding sequence

SEQ ID NO: 10704 - DNA, 8553 bp, Artificial Sequence
  Description of Artificial Sequence: Synthetic coding sequence
atgcccaagctgctgcagggcgtgatcaccgtgatcgacgtgttctaccagtacgccacccagcacggcgagtacgacaccctgaacaaggccgagctgaaggagctgctggagaacgagttccaccagatcctgaagaaccccaacgaccccgacaccgtggacatcatcctgcagagcctggacagagaccacaacaagaaggtggacttcaccgagtacctgctgatgatcttcaagctggtgcaggccagaaacaagatcatcggcaaggactactgccaggtgagcggcagcaagctgagagacgacacccaccagcaccaggaggagcaggaggagaccgagaaggaggagaacaagagacaggagagcagcttcagccacagcagctggagcgccggcgagaacgacagctacagcagaaacgtgagaggcagcctgaagcccggcaccgagagcatcagcagaagactgagcttccagagagacttcagcggccagcacaacagctacagcggccagagcagcagctacggcgagcagaacagcgacagccaccagagcagcggcagaggccagtgcggcagcggcagcggccagagccccaactacggccagcacggcagcggcagcggccagagcagcagcaacgacacccacggcagcggcagcggccagagcagcggcttcagccagcacaagagcagcagcggccagagcagcggctacagccagcacggcagcggcagcggccacagcagcggctacggccagcacggcagcagaagcggccagagcagcagaggcgagagacacagaagcagcagcggcagcagcagcagctacggccagcacggcagcggcagcagacagagcctgggccacggcagacagggcagcggcagcagacagagccccagccacgtgagacacggcagcggcagcggccacagcagcagccacggccagcacggcagcggcagcagctacagctacagcagaggccactacgagagcggcagcggccagaccagcggcttcggccagcacgagagcggcagcggccagagcagcggctacagcaagcacggcagcggcagcggccacagcagcagccagggccagcacggcagcaccagcggccaggccagcagcagcggccagcacggcagcagcagcagacagagcagcagctacggccagcacgagagcgccagcagacacagcagcggcagaggccagcacagcagcggcagcggccagagccccggccacggccagagaggcagcggcagcggccagagccccagcagcggccagcacggcaccggcttcggcagaagcagcagcagcggcccctacgtgagcggcagcggctacagcagcggcttcggccaccacgagagcagcagcgagcacagcagcggctacacccagcacggcagcggcagcggccacagcagcggccacggccagcacggcagcagaagcggccagagcagcagaggcgagagacagggcagcagcgccggcagcagcagcagctacggccagcacggcagcggcagcagacagagcctgggccacagcagacacggcagcggcagcggccagagccccagccccagcagaggcagacacgagagcggcagcagacagagcagcagctacggcccccacggctacggcagcggcagaagcagcagcagaggcccctacgagagcggcagcggccacagcagcggcctgggccaccaggagagcagaagcggccagagcagcggctacggccagcacggcagcagcagcggccacagcagcacccacggccagcacggcagcaccagcggccagagcagcagctgcggccagcacggcgccaccagcggccagagcagcagccacggccagcacggcagcggcagcagccagagcagcagatacggccagcagggcagcggcagcggccagagccccagcagaggcagacacggcagcgacttcggccacagcagcagctacggccagcacggcagcggcagcggctggagcagcagcaacggcccccacggcagcgtgagcggccagagcagcggcttcggccacaagagcggcagcggccagagcagcggctacagccagcacggcagcggcagcagccacagcagcggctacagaaagcacggcagcagaagcggccagagcagcagaagcgagcagcacggcagcagcagcggcctgagcagcagctacggccagcacggcagcggcagccaccagagcagcggccacggcagacagggcagcggcagcggccacagccccagcagagtgagacacggcagcagcagcggccacagcagcagccacggccagcacggcagcggcaccagctgcagcagcagctgcggccactacgagagcggcagcggccaggccagcggcttcggccagcacgagagcggcagcggccagggctacagccagcacggcagcgccagcggccacttcagcagccagggcagacacggcagcaccagcggccagagcagcagcagcggccagcacgacagcagcagcggccagagcagcagctacggccagcacgagagcgccagccaccacgccagcggcagaggcagacacggcagcggcagcggccagagccccggccacggccagagaggcagcggcagcggccagagccccagctacggcagacacggcagcggcagcggcagaagcagcagcagcggcagacacggcagcggcagcggccagagcagcggcttcggccacaagagcagcagcggccagagcagcggctacacccagcacggcagcggcagcggccacagcagcagctacgagcagcacggcagcagaagcggccagagcagcagaagcgagcagcacggcagcagcagcggcagcagcagcagctacggccagcacggcagcggcagcagacagagcctgggccacggccagcacggcagcggcagcggccagagccccagccccagcagaggcagacacggcagcggcagcggccagagcagcagctacggcccctacagaagcggcagcggctggagcagcagcagaggcccctacgagagcggcagcggccacagcagcggcctgggccacagagagagcagaagcggccagagcagcggctacggccagcacggcagcagcagcggccacagcagcacccacggccagcacggcagcaccagcggccagagcagcagctgcggccagcacggcgccagcagcggccagagcagcagccacggccagcacggcagcggcagcagccagagcagcggctacggcagacagggcagcggcagcggccagagccccggccacggccagagaggcagcggcagcagacagagccccagctacggcagacacggcagcggcagcggcagaagcagcagcagcggccagcacggcagcggcctgggcgagagcagcggcttcggccaccacgagagcagcagcggccagagcagcagctacagccagcacggcagcggcagcggccacagcagcggctacggccagcacggcagcagaagcggccagagcagcagaggcgagagacacggcagcagcagcggcagcagcagccactacggccagcacggcagcggcagcagacagagcagcggccacggcagacagggcagcggcagcggccacagccccagcagaggcagacacggcagcggcctgggccacagcagcagccacggccagcacggcagcggcagcggcagaagcagcagcagaggcccctacgagagcagaagcggccacagcagcgtgttcggccagcacgagagcggcagcggccacagcagcgcctacagccagcacggcagcggcagcggccacttctgcagccagggccagcacggcagcaccagcggccagagcagcaccttcgaccaggagggcagcagcaccggccagagcagcagctacggccacagaggcagcggcagcagccagagcagcggctacggcagacacggcgccggcagcggccagagccccagcagaggcagacacggcagcggcagcggccacagcagcagctacggccagcacggcagcggcagcggctggagcagcagcagcggcagacacggcagcggcagcggccagagcagcggcttcggccaccacgagagcagcagctggcagagcagcggctgcacccagcacggcagcggcagcggccacagcagcagctacgagcagcacggcagcagaagcggccagagcagcagaggcgagagacacggcagcagcagcggcagcagcagcagctacggccagcacggcagcggcagcagacagagcctgggccacggccagcacggcagcggcagcggccagagccccagccccagcagaggcagacacggcagcggcagcggccagagcagcagctacagcccctacggcagcggcagcggctggagcagcagcagaggcccctacgagagcggcagcagccacagcagcggcctgggccacagagagagcagaagcggccagagcagcggctacggccagcacggcagcagcagcggccacagcagcacccacggccagcacggcagcaccagcggccagagcagcagctgcggccagcacggcgccagcagcggccagagcagcagccacggccagcacggcagcggcagcagccagagcagcggctacggcagacagggcagcggcagcggccagagccccggccacggccagagaggcagcggcagcagacagagccccagctacggcagacacggcagcggcagcggcagaagcagcagcagcggccagcacggcagcggcctgggcgagagcagcggcttcggccaccacgagagcagcagcggccagagcagcagctacagccagcacggcagcggcagcggccacagcagcggctacggccagcacggcagcagaagcggccagagcagcagaggcgagagacacggcagcagcagcagaagcagcagcagatacggccagcacggcagcggcagcagacagagcagcggccacggcagacagggcagcggcagcggccagagccccagcagaggcagacacggcagcggcctgggccacagcagcagccacggccagcacggcagcggcagcggcagaagcagcagcagaggcccctacgagagcagaagcggccacagcagcgtgttcggccagcacgagagcggcagcggccacagcagcgcctacagccagcacggcagcggcagcggccacttctgcagccagggccagcacggcagcaccagcggccagagcagcaccttcgaccaggagggcagcagcaccggccagagcagcagccacggccagcacggcagcggcagcagccagagcagcagctacggccagcagggcagcggcagcggccagagccccagcagaggcagacacggcagcggcagcggccacagcagcagctacggccagcacggcagcggcagcggctggagcagcagcagcggcagacacggcagcggcagcggccagagcagcggcttcggccaccacgagagcagcagctggcagagcagcggctacacccagcacggcagcggcagcggccacagcagcagctacgagcagcacggcagcagaagcggccagagcagcagaggcgagcagcacggcagcagcagcggcagcagcagcagctacggccagcacggcagcggcagcagacagagcctgggccacggccagcacggcagcggcagcggccagagccccagccccagcagaggcagacacggcagcggcagcggccagagcagcagctacggcccctacggcagcggcagcggctggagcagcagcagaggcccctacgagagcggcagcggccacagcagcggcctgggccacagagagagcagaagcggccagagcagcggctacggccagcacggcagcagcagcggccacagcagcacccacggccagcacggcagcgccagcggccagagcagcagctgcggccagcacggcgccagcagcggccagagcagcagccacggccagcacggcagcggcagcagccagagcagcggctacggcagacagggcagcggcagcggccagagccccggccacggccagagaggcagcggcagcagacagagccccagctacggcagacacggcagcggcagcggcagaagcagcagcagcggccagcacggccccggcctgggcgagagcagcggcttcggccaccacgagagcagcagcggccagagcagcagctacagccagcacggcagcggcagcggccacagcagcggctacggccagcacggcagcagaagcggccagagcagcagaggcgagagacacggcagcagcagcggcagcagcagcagatacggccagcacggcagcggcagcagacagagcagcggccacggcagacagggcagcggcagcggccacagccccagcagaggcagacacggcagcggcagcggccacagcagcagccacggccagcacggcagcggcagcggcagaagcagcagcagaggcccctacgagagcagaagcggccacagcagcgtgttcggccagcacgagagcggcagcggccacagcagcgcctacagccagcacggcagcggcagcggccacttctgcagccagggccagcacggcagcaccagcggccagagcagcaccttcgaccaggagggcagcagcaccggccagagcagcagccacggccagcacggcagcggcagcagccagagcagcagctacggccagcagggcagcggcagcggccagagccccagcagaggcagacacggcagcggcagcggccacagcagcagctacggccagcacggcagcggcagcggctggagcagcagcagcggcagacacggcagcggcagcggccagagcagcggcttcggccaccacgagagcagcagctggcagagcagcggctacacccagcacggcagcggcagcggccacagcagcagctacgagcagcacggcagcagaagcggccagagcagcagaggcgagagacacggcagcagcagcggcagcagcagcagctacggccagcacggcagcggcagcagacagagcctgggccacggccagcacggcagcggcagcggccagagccccagccccagcagaggcagacacggcagcggcagcggccagagcagcagctacagcccctacggcagcggcagcggctggagcagcagcagaggcccctacgagagcggcagcggccacagcagcggcctgggccacagagagagcagaagcggccagagcagcggctacggccagcacggcagcagcagcggccacagcagcacccacggccagcacggcagcaccagcggccagagcagcagctgcggccagcacggcgccagcagcggccagagcagcagccacggccagcacggcagcggcagcagccagagcagcggctacggcagacagggcagcggcagcggccagagccccggccacggccagagaggcagcggcagcagacagagccccagctacggcagacacggcagcggcagcggcagaagcagcagcagcggccagcacggcagcggcctgggcgagagcagcggcttcggccaccacgagagcagcagcggccagagcagcagctacagccagcacggcagcggcagcggccacagcagcggctacggccagcacggcagcagaagcggccagagcagcagaggcgagagacacggcagcagcagcggcagcagcagccactacggccagcacggcagcggcagcagacagagcagcggccacggcagacagggcagcggcagcggccagagccccagcagaggcagacacggcagcggcctgggccacagcagcagccacggccagcacggcagcggcagcggcagaagcagcagcagaggcccctacgagagcagactgggccacagcagcgtgttcggccagcacgagagcggcagcggccacagcagcgcctacagccagcacggcagcggcagcggccacttctgcagccagggccagcacggcagcaccagcggccagagcagcaccttcgaccaggagggcagcagcaccggccagagcagcagctacggccacagaggcagcggcagcagccagagcagcggctacggcagacacggcgccggcagcggccagagcctgagccacggcagacacggcagcggcagcggccagagcagcagctacggccagcacggcagcggcagcggccagagcagcggctacagccagcacggcagcggcagcggccaggacggctacagctactgcaagggcggcagcaaccacgacggcggcagcagcggcagctacttcctgagcttccccagcagcaccagcccctacgagtacgtgcaggagcagagatgctacttctaccagtag

SEQ ID NO: 10705 - DNA, 876 bp, Artificial Sequence
  Description of Artificial Sequence: Synthetic coding sequence
atgagcagcggcgccgacggcggcggcggcgccgccgtggccgccagaagcgacaagggcagccccggcgaggacggcttcgtgcccagcgccctgggcaccagagagcactgggacgccgtgtacgagagagagctgcagaccttcagagagtacggcgacaccggcgagatctggttcggcgaggagagcatgaacagactgatcagatggatgcagaagcacaagatccccctggacgccagcgtgctggacatcggcaccggcaacggcgtgttcctggtggagctggccaagttcggcttcagcaacatcaccggcatcgactacagccccagcgccatccagctgagcggcagcatcatcgagaaggagggcctgagcaacatcaagctgaaggtggaggacttcctgaacctgagcacccagctgagcggcttccacatctgcatcgacaagggcaccttcgacgccatcagcctgaaccccgacaacgccatcgagaagagaaagcagtacgtgaagagcctgagcagagtgctgaaggtgaagggcttcttcctgatcaccagctgcaactggaccaaggaggagctgctgaacgagttcagcgagggctggagcaccgtggccggcttctggctgaccgccgccctgaccagctgggcccaggccatcttcagcaccagcgccagcagagtgggcggcaccaccggcacccaccaccacgcctggatcatcttcgtgttcctggccgagaccagattctgccacgtggtgcaggccggcctggagctgctgggcagcagcgacagccccacctggccccccaaggtgctgggcctgtaccacgccagacccagcctggccttctag

SEQ ID NO: 10706 - DNA, 633 bp, Artificial Sequence
  Description of Artificial Sequence: Synthetic coding sequence
atggccccctggggcaagagactggccggcgtgagaggcgtgctgctggacatcagcggcgtgctgtacgacagcggcgccggcggcggcaccgccatcgccggcagcgtggaggccgtggccagactgaagagaagcagactgaaggtgagattctgcaccaacgagagccagaagagcagagccgagctggtgggccagctgcagagactgggcttcgacatcagcgagcaggaggtgaccgcccccgcccccgccgcctgccagatcctgaaggagcagggcctgagaccctacctgctgatccacgacggcgtgagaagcgagttcgaccagatcgacaccagcaaccccaactgcgtggtgatcgccgacgccggcgagagcttcagctaccagaacatgaacaacgccttccaggtgctgatggagctggagaagcccgtgctgatcagcctgggcaagggcagatactacaaggagaccagcggcctgatgctggacgtgggcccctacatgaaggccctggagtacgcctgcggcatcaaggccgaggtggtgggcaagcccagccccgagttcttcaagagcgccctgcaggccatcggcgtggaggcccaccaggcccagtag

SEQ ID NO: 10707 - DNA, 813 bp, Artificial Sequence
  Description of Artificial Sequence: Synthetic coding sequence
atggccccctggggcaagagactggccggcgtgagaggcgtgctgctggacatcagcggcgtgctgtacgacagcggcgccggcggcggcaccgccatcgccggcagcgtggaggccgtggccagactgaagagaagcagactgaaggtgagattctgcaccaacgagagccagaagagcagagccgagctggtgggccagctgcagagactgggcttcgacatcagcgagcaggaggtgaccgcccccgcccccgccgcctgccagatcctgaaggagcagggcctgagaccctacctgctgatccacgacggcgtgagaagcgagttcgaccagatcgacaccagcaaccccaactgcgtggtgatcgccgacgccggcgagagcttcagctaccagaacatgaacaacgccttccaggtgctgatggagctggagaagcccgtgctgatcagcctgggcaagggcagatactacaaggagaccagcggcctgatgctggacgtgggcccctacatgaaggccctggagtacgcctgcggcatcaaggccgaggtggtgggcaagcccagccccgagttcttcaagagcgccctgcaggccatcggcgtggaggcccaccaggccgtgatgatcggcgacgacatcgtgggcgacgtgggcggcgcccagagatgcggcatgagagccctgcaggtgagaaccggcaagttcagacccagcgacgagcaccaccccgaggtgaaggccgacggctacgtggacaacctggccgaggccgtggacctgctgctgcagcacgccgacaagtag

SEQ ID NO: 10708 - DNA, 3948 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgtgagcgtgagccagcagcccgtgagcgcccccgtgcccatcgccgcccacgccagcgtggccggccacctgagcaccagcaccaccgtgagcagcagcggcgcccagaacagcgacagcaccaagaagaccctggtgaccctgatcgccaacaacaacgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggcccccagcttccccagcccccccgccgtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 10709 - DNA, 2406 bp, Artificial Sequence
  Description of Artificial Sequence: Synthetic coding sequence
atgggcgacaccgtggtggagcccgcccccctgaagcccaccagcgagcccaccagcggcccccccggcaacaacggcggcagcctgctgagcgtgatcaccgagggcgtgggcgagctgagcgtgatcgaccccgaggtggcccagaaggcctgccaggaggtgctggagaaggtgaagctgctgcacggcggcgtggccgtgagcagcagaggcacccccctggagctggtgaacggcgacggcgtggacagcgagatcagatgcctggacgacccccccgcccagatcagagaggaggaggacgagatgggcgccgccgtggccagcggcaccgccaagggcgccagaagaagaagacagaacaacagcgccaagcagagctggctgctgagactgttcgagagcaagctgttcgacatcagcatggccatcagctacctgtacaacagcaaggagcccggcgtgcaggcctacatcggcaacagactgttctgcttcagaaacgaggacgtggacttctacctgccccagctgctgaacatgtacatccacatggacgaggacgtgggcgacgccatcaagccctacatcgtgcacagatgcagacagagcatcaacttcagcctgcagtgcgccctgctgctgggcgcctacagcagcgacatgcacatcagcacccagagacacagcagaggcaccaagctgagaaagctgatcctgagcgacgagctgaagcccgcccacagaaagagagagctgcccagcctgagccccgcccccgacaccggcctgagccccagcaagagaacccaccagagaagcaagagcgacgccaccgccagcatcagcctgagcagcaacctgaagagaaccgccagcaaccccaaggtggagaacgaggacgagcccgtgagactggcccccgagagagagttcatcaagagcctgatggccatcggcaagagactggccaccctgcccaccaaggagcagaagacccagagactgatcagcgagctgagcctgctgaaccacaagctgcccgccagagtgtggctgcccaccgccggcttcgaccaccacgtggtgagagtgccccacacccaggccgtggtgctgaacagcaaggacaaggccccctacctgatctacgtggaggtgctggagtgcgagaacttcgacaccaccagcgtgcccgccagaatccccgagaacagaatcagaagcaccagaagcgtggagaacctgcccgagtgcggcatcacccacgagcagagagccggcagcttcagcaccgtgcccaactacgacaacgacgacgaggcctggagcgtggacgacatcggcgagctgcaggtggagctgcccgaggtgcacaccaacagctgcgacaacatcagccagttcagcgtggacagcatcaccagccaggagagcaaggagcccgtgttcatcgccgccggcgacatcagaagaagactgagcgagcagctggcccacacccccaccgccttcaagagagaccccgaggaccccagcgccgtggccctgaaggagccctggcaggagaaggtgagaagaatcagagagggcagcccctacggccacctgcccaactggagactgctgagcgtgatcgtgaagtgcggcgacgacctgagacaggagctgctggccttccaggtgctgaagcagctgcagagcatctgggagcaggagagagtgcccctgtggatcaagccctacaagatcctggtgatcagcgccgacagcggcatgatcgagcccgtggtgaacgccgtgagcatccaccaggtgaagaagcagagccagctgagcctgctggactacttcctgcaggagcacggcagctacaccaccgaggccttcctgagcgcccagagaaacttcgtgcagagctgcgccggctactgcctggtgtgctacctgctgcaggtgaaggacagacacaacggcaacatcctgctggacgccgagggccacatcatccacatcgacttcggcttcatcctgagcagcagccccagaaacctgggcttcgagaccagcgccttcaagctgaccaccgagttcgtggacgtgatgggcggcctggacggcgacatgttcaactactacaagatgctgatgctgcagggcctgatcgccgccagaaagcacatggacaaggtggtgcagatcgtggagatcatgcagcagggcagccagctgccctgcttccacggcagcagcaccatcagaaacctgaaggagagattccacatgagcatgaccgaggagcagctgcagctgctggtggagcagatggtggacggcagcatgagaagcatcaccaccaagctgtacgacggcttccagtacctgaccaacggcatcatgtag

SEQ ID NO: 10710 - DNA, 2451 bp, Artificial Sequence
  Description of Artificial Sequence: Synthetic coding sequence
atgggcgacaccgtggtggagcccgcccccctgaagcccaccagcgagcccaccagcggcccccccggcaacaacggcggcagcctgctgagcgtgatcaccgagggcgtgggcgagctgagcgtgatcgaccccgaggtggcccagaaggcctgccaggaggtgctggagaaggtgaagctgctgcacggcggcgtggccgtgagcagcagaggcacccccctggagctggtgaacggcgacggcgtggacagcgagatcagatgcctggacgacccccccgcccagatcagagaggaggaggacgagatgggcgccgccgtggccagcggcaccgccaagggcgccagaagaagaagacagaacaacagcgccaagcagagctggctgctgagactgttcgagagcaagctgttcgacatcagcatggccatcagctacctgtacaacagcaaggagcccggcgtgcaggcctacatcggcaacagactgttctgcttcagaaacgaggacgtggacttctacctgccccagctgctgaacatgtacatccacatggacgaggacgtgggcgacgccatcaagccctacatcgtgcacagatgcagacagagcatcaacttcagcctgcagtgcgccctgctgctgggcgcctacagcagcgacatgcacatcagcacccagagacacagcagaggcaccaagctgagaaagctgatcctgagcgacgagctgaagcccgcccacagaaagagagagctgcccagcctgagccccgcccccgacaccggcctgagccccagcaagagaacccaccagagaagcaagagcgacgccaccgccagcatcagcctgagcagcaacctgaagagaaccgccagcaaccccaaggtggagaacgaggacgaggagctgagcagcagcaccgagagcatcgacaacagcttcagcagccccgtgagactggcccccgagagagagttcatcaagagcctgatggccatcggcaagagactggccaccctgcccaccaaggagcagaagacccagagactgatcagcgagctgagcctgctgaaccacaagctgcccgccagagtgtggctgcccaccgccggcttcgaccaccacgtggtgagagtgccccacacccaggccgtggtgctgaacagcaaggacaaggccccctacctgatctacgtggaggtgctggagtgcgagaacttcgacaccaccagcgtgcccgccagaatccccgagaacagaatcagaagcaccagaagcgtggagaacctgcccgagtgcggcatcacccacgagcagagagccggcagcttcagcaccgtgcccaactacgacaacgacgacgaggcctggagcgtggacgacatcggcgagctgcaggtggagctgcccgaggtgcacaccaacagctgcgacaacatcagccagttcagcgtggacagcatcaccagccaggagagcaaggagcccgtgttcatcgccgccggcgacatcagaagaagactgagcgagcagctggcccacacccccaccgccttcaagagagaccccgaggaccccagcgccgtggccctgaaggagccctggcaggagaaggtgagaagaatcagagagggcagcccctacggccacctgcccaactggagactgctgagcgtgatcgtgaagtgcggcgacgacctgagacaggagctgctggccttccaggtgctgaagcagctgcagagcatctgggagcaggagagagtgcccctgtggatcaagccctacaagatcctggtgatcagcgccgacagcggcatgatcgagcccgtggtgaacgccgtgagcatccaccaggtgaagaagcagagccagctgagcctgctggactacttcctgcaggagcacggcagctacaccaccgaggccttcctgagcgcccagagaaacttcgtgcagagctgcgccggctactgcctggtgtgctacctgctgcaggtgaaggacagacacaacggcaacatcctgctggacgccgagggccacatcatccacatcgacttcggcttcatcctgagcagcagccccagaaacctgggcttcgagaccagcgccttcaagctgaccaccgagttcgtggacgtgatgggcggcctggacggcgacatgttcaactactacaagatgctgatgctgcagggcctgatcgccgccagaaagcacatggacaaggtggtgcagatcgtggagatcatgcagcagggcagccagctgccctgcttccacggcagcagcaccatcagaaacctgaaggagagattccacatgagcatgaccgaggagcagctgcagctgctggtggagcagatggtggacggcagcatgagaagcatcaccaccaagctgtacgacggcttccagtacctgaccaacggcatcatgtag

SEQ ID NO: 10711 - DNA, 2406 bp, Artificial Sequence; identical to SEQ ID NO: 10709
  Description of Artificial Sequence: Synthetic coding sequence

SEQ ID NO: 10712 - DNA, 2487 bp, Artificial Sequence; identical to SEQ ID NO: 9527
  Description of Artificial Sequence: Synthetic coding sequence

SEQ ID NO: 10713 - DNA, 1143 bp, Artificial Sequence
  Description of Artificial Sequence: Synthetic coding sequence
atggtgctggagagcaccatggtgtgcgtggacaacagcgagtacatgagaaacggcgacttcctgcccaccagactgcaggcccagcaggacgccgtgaacatcgtgtgccacagcaagaccagaagcaaccccgagaacaacgtgggcctgatcaccctggccaacgactgcgaggtgctgaccaccctgacccccgacaccggcagaatcctgagcaagctgcacaccgtgcagcccaagggcaagatcaccttctgcaccggcatcagagtggcccacctggccctgaagcacagacagggcaagaaccacaagatgagaatcatcgccttcgtgggcagccccgtggaggacaacgagaaggacctggtgaagctggccaagagactgaagaaggagaaggtgaacgtggacatcatcaacttcggcgaggaggaggtgaacaccgagaagctgaccgccttcgtgaacaccctgaacggcaaggacggcaccggcagccacctggtgaccgtgccccccggccccagcctggccgacgccctgatcagcagccccatcctggccggcgagggcggcgccatgctgggcctgggcgccagcgacttcgagttcggcgtggaccccagcgccgaccccgagctggccctggccctgagagtgagcatggaggagcagagacagagacaggaggaggaggccagaagagccgccgccgccagcgccgccgaggccggcatcgccaccaccggcaccgagggcgagagagacagcgacgacgccctgctgaagatgaccatcagccagcaggagttcggcagaaccggcctgcccgacctgagcagcatgaccgaggaggagcagatcgcctacgccatgcagatgagcctgcagggcgccgagttcggccaggccgagagcgccgacatcgacgccagcagcgccatggacaccagcgagcccgccaaggaggaggacgactacgacgtgatgcaggaccccgagttcctgcagagcgtgctggagaacctgcccggcgtggaccccaacaacgaggccatcagaaacgccatgggcagcctggccagccaggccaccaaggacggcaagaaggacaagaaggaggaggacaagaagtag

SEQ ID NO: 10714 - DNA, 1134 bp, Artificial Sequence
  Description of Artificial Sequence: Synthetic coding sequence
atggtgctggagagcaccatggtgtgcgtggacaacagcgagtacatgagaaacggcgacttcctgcccaccagactgcaggcccagcaggacgccgtgaacatcgtgtgccacagcaagaccagaagcaaccccgagaacaacgtgggcctgatcaccctggccaacgactgcgaggtgctgaccaccctgacccccgacaccggcagaatcctgagcaagctgcacaccgtgcagcccaagggcaagatcaccttctgcaccggcatcagagtggcccacctggccctgaagcacagacagggcaagaaccacaagatgagaatcatcgccttcgtgggcagccccgtggaggacaacgagaaggacctggtgaagctggccaagagactgaagaaggagaaggtgaacgtggacatcatcaacttcggcgaggaggaggtgaacaccgagaagctgaccgccttcgtgaacaccctgaacggcaaggacggcaccggcagccacctggtgaccgtgccccccggccccagcctggccgacgccctgatcagcagccccatcctggccggcgagggcggcgccatgctgggcctgggcgccagcgacttcgagttcggcgtggaccccagcgccgaccccgagctggccctggccctgagagtgagcatggaggagcagagacagagacaggaggaggaggccagaagagccgccgccgccagcgccgccgaggccggcatcgccaccaccggcaccgaggacagcgacgacgccctgctgaagatgaccatcagccagcaggagttcggcagaaccggcctgcccgacctgagcagcatgaccgaggaggagcagatcgcctacgccatgcagatgagcctgcagggcgccgagttcggccaggccgagagcgccgacatcgacgccagcagcgccatggacaccagcgagcccgccaaggaggaggacgactacgacgtgatgcaggaccccgagttcctgcagagcgtgctggagaacctgcccggcgtggaccccaacaacgaggccatcagaaacgccatgggcagcctggccagccaggccaccaaggacggcaagaaggacaagaaggaggaggacaagaagtag

SEQ ID NO: 10715 - DNA, 933 bp, Artificial Sequence
  Description of Artificial Sequence: Synthetic coding sequence
atgagacccgccagacactgggagaccagattcggcgccagagacttcggcggcttccaggactgcttcttcagagacagactgatggacaccgccagaatcgccgtggtgggcgccggcgtggtgggcctgagcaccgccgtgtgcatcagcaagctggtgcccagatgcagcgtgaccatcatcagcgacaagttcacccccgacaccaccagcgacgtggccgccggcatgctgatcccccacacctaccccgacacccccatccacacccagaagcagtggttcagagagaccttcaaccacctgttcgccatcgccaacagcgccgaggccggcgacgccggcgtgcacctggtgagcggcatcaagggcagcggcggctggaccctgaccagaagaatcgaggacctgtgggagctgcaccccagcttcgacatcgtggtgaactgcagcggcctgggcagcagacagctggccggcgacagcaagatcttccccgtgagaggccaggtgctgcaggtgcaggccccctgggtggagcacttcatcagagacggcagcggcctgacctacatctaccccggcaccagccacgtgaccctgggcggcaccagacagaagggcgactggaacctgagccccgacgccgagaacagcagagagatcctgagcagatgctgcgccctggagcccagcctgcacggcgcctgcaacatcagagagaaggtgggcctgagaccctacagacccggcgtgagactgcagaccgagctgctggccagagacggccagagactgcccgtggtgcaccactacggccacggcagcggcggcatcagcgtgcactggggcaccgccctggaggccgccagactggtgagcgagtgcgtgcacgccctgagaacccccatccccaagagcaacctgtag

SEQ ID NO: 10716 - DNA, 1110 bp, Artificial Sequence
  Description of Artificial Sequence: Synthetic coding sequence
atgagacccgccagacactgggagaccagattcggcgccagagacttcggcggcttccaggactgcttcttcagagacagactgatggacaccgccagaatcgccgtggtgggcgccggcgtggtgggcctgagcaccgccgtgtgcatcagcaagctggtgcccagatgcagcgtgaccatcatcagcgacaagttcacccccgacaccaccagcgacgtggccgccggcatgctgatcccccacacctaccccgacacccccatccacacccagaagcagtggttcagagagaccttcaaccacctgttcgccatcgccaacagcgccgaggccggcgacgccggcgtgcacctggtgagcggctggcagatcttccagagcacccccaccgaggaggtgcccttctgggccgacgtggtgctgggcttcagaaagatgaccgaggccgagctgaagaagttcccccagtacgtgttcggccaggccttcaccaccctgaagtgcgagtgccccgcctacctgccctggctggagaagagaatcaagggcagcggcggctggaccctgaccagaagaatcgaggacctgtgggagctgcaccccagcttcgacatcgtggtgaactgcagcggcctgggcagcagacagctggccggcgacagcaagatcttccccgtgagaggccaggtgctgcaggtgcaggccccctgggtggagcacttcatcagagacggcagcggcctgacctacatctaccccggcaccagccacgtgaccctgggcggcaccagacagaagggcgactggaacctgagccccgacgccgagaacagcagagagatcctgagcagatgctgcgccctggagcccagcctgcacggcgcctgcaacatcagagagaaggtgggcctgagaccctacagacccggcgtgagactgcagaccgagctgctggccagagacggccagagactgcccgtggtgcaccactacggccacggcagcggcggcatcagcgtgcactggggcaccgccctggaggccgccagactggtgagcgagtgcgtgcacgccctgagaacccccatccccaagagcaacctgtag

SEQ ID NO: 10717 - DNA, 1026 bp, Artificial Sequence
  Description of Artificial Sequence: Synthetic coding sequence
atggacaccgccagaatcgccgtggtgggcgccggcgtggtgggcctgagcaccgccgtgtgcatcagcaagctggtgcccagatgcagcgtgaccatcatcagcgacaagttcacccccgacaccaccagcgacgtggccgccggcatgctgatcccccacacctaccccgacacccccatccacacccagaagcagtggttcagagagaccttcaaccacctgttcgccatcgccaacagcgccgaggccggcgacgccggcgtgcacctggtgagcggctggcagatcttccagagcacccccaccgaggaggtgcccttctgggccgacgtggtgctgggcttcagaaagatgaccgaggccgagctgaagaagttcccccagtacgtgttcggccaggccttcaccaccctgaagtgcgagtgccccgcctacctgccctggctggagaagagaatcaagggcagcggcggctggaccctgaccagaagaatcgaggacctgtgggagctgcaccccagcttcgacatcgtggtgaactgcagcggcctgggcagcagacagctggccggcgacagcaagatcttccccgtgagaggccaggtgctgcaggtgcaggccccctgggtggagcacttcatcagagacggcagcggcctgacctacatctaccccggcaccagccacgtgaccctgggcggcaccagacagaagggcgactggaacctgagccccgacgccgagaacagcagagagatcctgagcagatgctgcgccctggagcccagcctgcacggcgcctgcaacatcagagagaaggtgggcctgagaccctacagacccggcgtgagactgcagaccgagctgctggccagagacggccagagactgcccgtggtgcaccactacggccacggcagcggcggcatcagcgtgcactggggcaccgccctggaggccgccagactggtgagcgagtgcgtgcacgccctgagaacccccatccccaagagcaacctgtag

SEQ ID NO: 10718 - DNA, 1074 bp, Artificial Sequence
  Description of Artificial Sequence: Synthetic coding sequence
atgggcaccatccaggaggccggcaagaagaccgacgtgggcgtgagagagatcgccgaggcccccgagctgggcgccgccctgagacacggcgagctggagctgaaggaggagtggcaggacgaggagttccccagactgctgcccgaggaggccggcaccagcgaggaccccgaggaccccaagggcgacagccaggccgccgccggcacccccagcaccctggccctgtgcggccagagacccatgagaaagagactgagcgcccccgagctgagactgagcctgaccaagggccccggcaacgacggcgccagccccacccagagcgcccccagcagccccgacggcagcagcgacctggagatcgacgagctggagacccccagcgacagcgagcagctggacagcggccacgagttcgagtgggaggacgagctgcccagagccgagggcctgggcaccagcgagaccgccgagagactgggcagaggctgcatgtgggacgtgaccggcgaggacggccaccactggagagtgttcagaatgggccccagagagcagagagtggacatgaccgtgatcgagccctacaagaaggtgctgagccacggcggctaccacggcgacggcctgaacgccgtgatcctgttcgccagctgctacctgcccagaagcagcatccccaactacacctacgtgatggagcacctgttcagatacatggtgggcaccctggagctgctggtggccgagaactacctgctggtgcacctgagcggcggcaccagcagagcccaggtgccccccctgagctggatcagacagtgctacagaaccctggacagaagactgagaaagaacctgagagccctggtggtggtgcacgccacctggtacgtgaaggccttcctggccctgctgagacccttcatcagcagcaagttcaccagaaagatcagattcctggacagcctgggcgagctggcccagctgatcagcctggaccaggtgcacatccccgaggccgtgagacagctggacagagacctgcacggcagcggcggcacctag

SEQ ID NO: 10719 - DNA, 1269 bp, Artificial Sequence
  Description of Artificial Sequence: Synthetic coding sequence
atgctgaagttcctggccaagggcgaggtgcccaagggcagctgcgaggacgagcccatggacagcaccatggacgacgccgtggccggcgacttcgccctgatcaacaagctggacatccagtgcgacctgaagaccctgagcgacgacatcaaggagagcctggagagcgagggcaagaacagcaagaaggaggagccccaggagctgctgcagagccaggacttcgtgggcgagaagctgggcagcggcgagcccagccacagcgtgaaggtgcacaccgtgcccaagcccggcaagggcgccgacctgagcaagcccccctgcagaaaggccaaggagatcagaaaggagagaaagagactgaagctgatgcagcagaaccccgccggcgagctggagggcttccaggcccagggccacccccccagcctgttcccccccaaggccaagagcaaccagcccaagagcctggaggacctgatcttcgagagcctgcccgagaacgccagccacaagctggaggtgagactggtgcccgtgagcttcgaggaccccgagttcaagagcagcttcagccagagcttcagcctgtacgtgaagtaccaggtggccatccaccaggacccccccgacgagtgcggcaagaccgagttcaccagattcctgtgcagcagccccctggaggccgagaccccccccaacggccccgactgcggctacggcagcttccaccagcagtactggctggacggcaagatcatcgccgtgggcgtgatcgacatcctgcccaactgcgtgagcagcgtgtacctgtactacgaccccgactacagcttcctgagcctgggcgtgtacagcgccctgagagagatcgccttcaccagacagctgcacgagaagaccagccagctgagctactactacatgggcttctacatccacagctgccccaagatgaagtacaagggccagtacagacccagcgacctgctgtgccccgagacctacgtgtgggtgcccatcgagcagtgcctgcccagcctggagaacagcaagtactgcagattcaaccaggaccccgaggccgtggacgaggacagaagcaccgagcccgacagactgcaggtgttccacaagagagccatcatgccctacggcgtgtacaagaagcagcagaaggaccccagcgaggaggccgccgtgctgcagtacgccagcctggtgggccagaagtgcagcgagagaatgctgctgttcagaaactag

SEQ ID NO: 10720 - DNA, 1557 bp, Artificial Sequence
  Description of Artificial Sequence: Synthetic coding sequence
atggccttctgggccggcggcagccccagcgtggtggactacttccccagcgaggacttctacagatgcggctactgcaagaacgagagcggcagcagaagcaacggcatgtgggcccacagcatgaccgtgcaggactaccaggacctgatcgacagaggctggagaagaagcggcaagtacgtgtacaagcccgtgatgaaccagacctgctgcccccagtacaccatcagatgcagacccctgcagttccagcccagcaagagccacaagaaggtgctgaagaagatgctgaagttcctggccaagggcgaggtgcccaagggcagctgcgaggacgagcccatggacagcaccatggacgacgccgtggccggcgacttcgccctgatcaacaagctggacatccagtgcgacctgaagaccctgagcgacgacatcaaggagagcctggagagcgagggcaagaacagcaagaaggaggagccccaggagctgctgcagagccaggacttcgtgggcgagaagctgggcagcggcgagcccagccacagcgtgaaggtgcacaccgtgcccaagcccggcaagggcgccgacctgagcaagcccccctgcagaaaggccaaggagatcagaaaggagagaaagagactgaagctgatgcagcagaaccccgccggcgagctggagggcttccaggcccagggccacccccccagcctgttcccccccaaggccaagagcaaccagcccaagagcctggaggacctgatcttcgagagcctgcccgagaacgccagccacaagctggaggtgagactggtgcccgtgagcttcgaggaccccgagttcaagagcagcttcagccagagcttcagcctgtacgtgaagtaccaggtggccatccaccaggacccccccgacgagtgcggcaagaccgagttcaccagattcctgtgcagcagccccctggaggccgagaccccccccaacggccccgactgcggctacggcagcttccaccagcagtactggctggacggcaagatcatcgccgtgggcgtgatcgacatcctgcccaactgcgtgagcagcgtgtacctgtactacgaccccgactacagcttcctgagcctgggcgtgtacagcgccctgagagagatcgccttcaccagacagctgcacgagaagaccagccagctgagctactactacatgggcttctacatccacagctgccccaagatgaagtacaagggccagtacagacccagcgacctgctgtgccccgagacctacgtgtgggtgcccatcgagcagtgcctgcccagcctggagaacagcaagtactgcagattcaaccaggaccccgaggccgtggacgaggacagaagcaccgagcccgacagactgcaggtgttccacaagagagccatcatgccctacggcgtgtacaagaagcagcagaaggaccccagcgaggaggccgccgtgctgcagtacgccagcctggtgggccagaagtgcagcgagagaatgctgctgttcagaaactag

SEQ ID NO: 10721 - DNA, 3003 bp, Artificial Sequence
  Description of Artificial Sequence: Synthetic coding sequence
atggccgagagaaagcccaacggcggcagcggcggcgccagcaccagcagcagcggcaccaacctgctgttcagcagcagcgccaccgagttcagcttcaacgtgcccttcatccccgtgacccaggccagcgccagccccgccagcctgctgctgcccggcgaggacagcaccgacgtgggcgaggaggacagcttcctgggccagaccagcatccacaccagcgccccccagaccttcagctacttcagccaggtgagcagcagcagcgaccccttcggcaacatcggccagagccccctgaccaccgccgccaccagcgtgggccagagcggcttccccaagcccctgaccgccctgcccttcaccaccggcagccaggacgtgagcaacgccttcagccccagcatcagcaaggcccagcccggcgccccccccagcagcctgatgggcatcaacagctacctgcccagccagcccagcagcctgccccccagctacttcggcaaccagccccagggcatcccccagcccggctacaacccctacagacacacccccggcagcagcagagccaacccctacatcgcccccccccagctgcagcagtgccagacccccggcccccccgcccaccccccccccagcggcccccccgtgcagatgtaccagatgccccccggcagcctgccccccgtgcccagcagcgtgcagagccccgcccagcagcaggtgcccgccagacccggcgcccccagcgtgcaggtgcccagccccttcctgctgcagaaccagtacgagcccgtgcagccccactggttctactgcaaggaggtggagtacaagcagctgtggatgcccttcagcgtgttcgacagcctgaacctggaggagatctacaacagcgtgcagcccgaccccgagagcgtggtgctgggcaccgacggcggcagatacgacgtgtacctgtacgacagaatcagaaaggccgcctactgggaggaggagcccgccgaggtgagaagatgcacctggttctacaagggcgacaccgacagcagattcatcccctacaccgaggagttcagcgagaagctggaggccgagtacaagaaggccgtgaccaccaaccagtggcacagaagactggagttccccagcggcgagaccatcgtgatgcacaaccccaaggtgatcgtgcagttccagcccagcagcgtgcccgacgagtggggcaccacccaggacggccagaccagacccagagtggtgaagagaggcatcgacgacaacctggacgagatccccgacggcgagatgccccaggtggaccacctggtgttcgtggtgcacggcatcggccccgtgtgcgacctgagattcagaagcatcatcgagtgcgtggacgacttcagagtggtgagcctgaagctgctgagaacccacttcaagaagagcctggacgacggcaaggtgagcagagtggagttcctgcccgtgcactggcacagcagcctgggcggcgacgccaccggcgtggacagaaacatcaagaagatcaccctgcccagcatcggcagattcagacacttcaccaacgagaccctgctggacatcctgttctacaacagccccacctactgccagaccatcgtggagaaggtgggcatggagatcaaccacctgcacgccctgttcatgagcagaaaccccgacttcaagggcggcgtgagcgtggccggccacagcctgggcagcctgatcctgttcgacatcctgagcaaccagaaggacctgaacctgagcaagtgccccggccccctggccgtggccaacggcgtggtgaagcagctgcacttccaggagaagcagatgcccgaggagcccaagctgaccctggacgagagctacgacctggtggtggagaacaaggaggtgctgaccctgcaggagaccctggaggccctgagcctgagcgagtacttcagcaccttcgagaaggagaagatcgacatggagagcctgctgatgtgcaccgtggacgacctgaaggagatgggcatccccctgggccccagaaagaagatcgccaacttcgtggagcacaaggccgccaagctgaagaaggccgccagcgagaagaaggccgtggccgccaccagcaccaagggccaggagcagagcgcccagaagaccaaggacatggccagcctgcccagcgagagcaacgagcccaagagaaagctgcccgtgggcgcctgcgtgagcagcgtgtgcgtgaactacgagagcttcgaggtgggcgccggccaggtgagcgtggcctacaacagcctggacttcgagcccgagatcttcttcgccctgggcagccccatcgccatgttcctgaccatcagaggcgtggacagaatcgacgagaactacagcctgcccacctgcaagggcttcttcaacatctaccaccccctggaccccgtggcctacagactggagcccatgatcgtgcccgacctggacctgaaggccgtgctgatcccccaccacaagggcagaaagagactgcacctggagctgaaggagagcctgagcagaatgggcagcgacctgaagcagggcttcatcagcagcctgaagagcgcctggcagaccctgaacgagttcgccagagcccacaccagcagcacccagctgcaggaggagctggagaaggtggccaaccagatcaaggaggaggaggagaagcaggtggtggaggccgagaaggtggtggagagccccgacttcagcaaggacgaggactacctgggcaaggtgggcatgctgaacggcggcagaagaatcgactacgtgctgcaggagaagcccatcgagagcttcaacgagtacctgttcgccctgcagagccacctgtgctactgggagagcgaggacaccgccctgctgctgctgaaggagatctacagaaccatgaacatcagccccgagcagccccagcactag

SEQ ID NO: 10722 - DNA, 495 bp, Artificial Sequence
  Description of Artificial Sequence: Synthetic coding sequence
atggtgaacagcgtggtgttcttcgacatcaccgtggacggcaagcccctgggcagaatcagcatcaagctgttcgccgacaagatcctgaagaccgccgagaacttcagagccctgagcaccggcgagaagggcttcagatacaagggcagctgcttccacagaatcatccccggcttcatgtgccagggcggcgacttcaccagacacaacggcaccggcgacaagagcatctacggcgagaagttcgacgacgagaacctgatcagaaagcacaccggcagcggcatcctgagcatggccaacgccggccccaacaccaacggcagccagttcttcatctgcgccgccaagaccgagtggctggacggcaagcacgtggccttcggcaaggtgaaggagagagtgaacatcgtggaggccatggagcacttcggctacagaaacagcaagaccagcaagaagatcaccatcgccgactgcggccagttctag

SEQ ID NO: 10723 - DNA, 426 bp, Artificial Sequence
  Description of Artificial Sequence: Synthetic coding sequence
atgaagatcctggacgtgggctgcggcggcggcctgctgaccgagcccggcggcagcctgttcatcaccaccatcaacaagacccagctgagctacgccctgggcatcgtgttcagcgagcagatcgccagcatcgtgcccaagggcacccacacctgggagaagttcgtgagccccgagaccctggagagcatcctggagagcaacggcctgagcgtgcagaccgtggtgggcatgctgtacaaccccttcagcggctactggcactggagcgagaacaccagcctgaactacgccgcctacgccgtgaagagcagagtgcaggagcaccccgccagcgccgagttcgtgctgaagggcgagaccgaggagctgcaggccaacgcctgcaccaaccccgccgtgcacgagaagctgaagaagtag

SEQ ID NO: 10724 - DNA, 426 bp, Artificial Sequence; identical to SEQ ID NO: 10723
  Description of Artificial Sequence: Synthetic coding sequence

SEQ ID NO: 10725 - DNA, 2157 bp, Artificial Sequence
  Description of Artificial Sequence: Synthetic coding sequence
atgctgatgaccctggagatgaccgagctgaccgacccccaccacaccatgggcgactacaaggtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10726 - DNA, 1593 bp, Artificial Sequence
  Description of Artificial Sequence: Synthetic coding sequence
atgttcaccgagggcgaggagatgtacctgcagggcagcaccgtgtggcaccccgactgcaagcagagcaccaagaccgaggagaagctgagactgcccaacatcagaagaagcagcagcgacttcttctacagcaagagcctgatcagaagaaccggcagaagccccagcctgcagcccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgagctgctgagccccggcgtgcagagactgagctacctgagaaccagcagcctgagccccacccacagcgacagcagacccaacccccccttcagacaccacttcatcccccacatcaagggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10727 - DNA, 2109 bp, Artificial Sequence
  Description of Artificial Sequence: Synthetic coding sequence
atggtgaaggagaaggtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10728 - DNA, 1206 bp, Artificial Sequence
  Description of Artificial Sequence: Synthetic coding sequence
atgttcaccgagggcgaggagatgtacctgcagggcagcaccgtgtggcaccccgactgcaagcagagcaccaagaccgaggagaagctgagagccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10729 - DNA, 1968 bp, Artificial Sequence
  Description of Artificial Sequence: Synthetic coding sequence
atggtgaaggagaaggtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagacttccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10730 - DNA, 2541 bp, Artificial Sequence
  Description of Artificial Sequence: Synthetic coding sequence
atgcccgccttcctgggcctgaagtgcctgggcaagctgtgcagcagcgagaagagcaaggtgaccagcagcgagagaaccagcgccagaggcagcaacagaaagagactgatcgtggaggacagaagagtgagcggcaccagcttcaccgcccacagaagagccaccatcacccacctgctgtacctgtgccccaaggactactgccccagaggcagagtgtgcaacagcgtggaccccttcgtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagactgcccaacatcagaagaagcagcagcgacttcttctacagcaagagcctgatcagaagaaccggcagaagccccagcctgcagcccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgagctgctgagccccggcgtgcagagactgagctacctgagaaccagcagcctgagccccacccacagcgacagcagacccaacccccccttcagacaccacttcatcccccacatcaagggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagagtaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10731 - DNA, 2109 bp, Artificial Sequence
  Description of Artificial Sequence: Synthetic coding sequence
atggtgcccgaccccgtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagagtaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10732 - DNA, 1368 bp, Artificial Sequence
  Description of Artificial Sequence: Synthetic coding sequence
atgttcaccgagggcgaggagatgtacctgcagggcagcaccgtgtggcaccccgactgcaagcagagcaccaagaccgaggagaagctgagactgcccaacatcagaagaagcagcagcgacttcttctacagcaagagcctgatcagaagaaccggcagaagccccagcctgcagcccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagacttccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10733 - DNA, 2241 bp, Artificial Sequence
  Description of Artificial Sequence: Synthetic coding sequence
atgctgatgaccctggagatgaccgagctgaccgacccccaccacaccatgggcgactacaaggtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagactgcccaacatcagaagaagcagcagcgacttcttctacagcaagagcctgatcagaagaaccggcagaagccccagcctgcagcccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagacttccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 10734 - DNA, 915 bp, Artificial Sequence
  Description of Artificial Sequence: Synthetic coding sequence
atggccgaggccagcgccgccggcgccgacagcggcgccgccgtggccgcccacagattcttctgccacttctgcaagggcgaggtgagccccaagctgcccgagtacatctgccccagatgcgagagcggcttcatcgaggaggtgaccgacgacagcagcttcctgggcggcggcggcagcagaatcgacaacaccaccaccacccacttcgccgagctgtggggccacctggaccacaccatgttcttccaggacttcagacccttcctgagcagcagccccctggaccaggacaacagagccaacgagagaggccaccagacccacaccgacttctggggcgccagaccccccagactgcccctgggcagaagatacagaagcagaggcagcagcagacccgacagaagccccgccatcgagggcatcctgcagcacatcttcgccggcttcttcgccaacagcgccatccccggcagcccccaccccttcagctggagcggcatgctgcacagcaaccccggcgactacgcctggggccagaccggcctggacgccatcgtgacccagctgctgggccagctggagaacaccggccccccccccgccgacaaggagaagatcaccagcctgcccaccgtgaccgtgacccaggagcaggtggacatgggcctggagtgccccgtgtgcaaggaggactacaccgtggaggaggaggtgagacagctgccctgcaaccacttcttccacagcagctgcatcgtgccctggctggagctgcacgacacctgccccgtgtgcagaaagagcctgaacggcgaggacagcaccagacagagccagagcaccgaggccagcgccagcaacagattcagcaacgacagccagctgcacgacagatggaccttctag

SEQ ID NO: 10735 - DNA, 636 bp, Artificial Sequence
  Description of Artificial Sequence: Synthetic coding sequence
atgagctgcaccatcgagaagatcctgaccgacgccaagaccctgctggagagactgagagagcacgacgccgccgccgagagcctggtggaccagagcgccgccctgcacagaagagtggccgccatgagagaggccggcaccgccctgcccgaccaggtgagacagagataccaggaggacgccagcgacatgaaggacatgagcaagtacaagccccacatcctgctgagccaggagaacacccagatcagagacctgcagcaggagaacagagagctgtggatcagcctggaggagcaccaggacgccctggagctgatcatgagcaagtacagaaagcagatgctgcagctgatggtggccaagaaggccgtggacgccgagcccgtgctgaaggcccaccagagccacagcgccgagatcgagagccagatcgacagaatctgcgagatgggcgaggtgatgagaaaggccgtgcaggtggacgacgaccagttctgcaagatccaggagaagctggcccagctggagctggagaacaaggagctgagagagctgctgagcatcagcagcgagagcctgcaggccagaaaggagaacagcatggacaccgccagccaggccatcaagtag

SEQ ID NO: 10736 - DNA, 2451 bp, Artificial Sequence
  Description of Artificial Sequence: Synthetic coding sequence
atggtgctgatgttccagatcagatacatcagccagacccagggcctgcccgccgagtacctgctgagcgccggcaccaagaccaccagattcttcaacagagaccccaacctgggctaccccctgtggagactgaagacccccgaggagcacgagctggagaccggcatcaagagcaaggaggccagaaagtacatcttcaactgcctggacgacatggcccaggtgaacatgagcaccgacctggagggcaccgacatgctggccgagaaggccgacagaagagagtacatcgacctgctgaagaagatgctgaccatcgacgccgacaagagaatcacccccctgaagaccctgaaccaccagttcgtgaccatgacccacctgctggacttcccccacagcaaccacgtgaagagctgcttccagaacatggagatctgcaagagaagagtgcacatgtacgacaccgtgagccagatcaagagccccttcaccacccacgtggcccccaacaccagcaccaacctgaccatgagcttcagcaaccagctgaacaccgtgcacaaccaggccagcgtgctggccagcagcagcaccgccgccgccgccaccctgagcctggccaacagcgacgtgagcctgctgaactaccagagcgccctgtaccccagcagcgccgcccccgtgcccggcgtggcccagcagggcgtgagcctgcagcccggcaccacccagatctgcacccagaccgaccccttccagcagaccttcatcgtgtgcccccccgccttccagaccggcctgcaggccaccaccaagcacagcggcttccccgtgagaatggacaacgccgtgcccatcgtgccccaggcccccgccgcccagcccctgcagatccagagcggcgtgctgacccagggcagctgcacccccctgatggtggccaccctgcacccccaggtggccaccatcaccccccagtacgccgtgcccttcaccctgagctgcgccgccggcagacccgccctggtggagcagaccgccgccgtgctgcaggcctggcccggcggcacccagcagatcctgctgcccagcacctggcagcagctgcccggcgtggccctgcacaacagcgtgcagcccaccgccatgatccccgaggccatgggcagcggccagcagctggccgactggagaaacgcccacagccacggcaaccagtacagcaccatcatgcagcagcccagcctgctgaccaaccacgtgaccctggccaccgcccagcccctgaacgtgggcgtggcccacgtggtgagacagcagcagagcagcagcctgcccagcaagaagaacaagcagagcgcccccgtgagcagcaagagcagcctggacgtgctgcccagccaggtgtacagcctggtgggcagcagccccctgagaaccaccagcagctacaacagcctggtgcccgtgcaggaccagcaccagcccatcatcatccccgacacccccagcccccccgtgagcgtgatcaccatcagaagcgacaccgacgaggaggaggacaacaagtacaagcccagcagcagcggcctgaagcccagaagcaacgtgatcagctacgtgaccgtgaacgacagccccgacagcgacagcagcctgagcagcccctacagcaccgacaccctgagcgccctgagaggcaacagcggcagcgtgctggagggccccggcagagtggtggccgacggcaccggcaccagaaccatcatcgtgccccccctgaagacccagctgggcgactgcaccgtggccacccaggccagcggcctgctgagcaacaagaccaagcccgtggccagcgtgagcggccagagcagcggctgctgcatcacccccaccggctacagagcccagagaggcggcaccagcgccgcccagcccctgaacctgagccagaaccagcagagcagcgccgcccccaccagccaggagagaagcagcaaccccgcccccagaagacagcaggccttcgtggcccccctgagccaggccccctacaccttccagcacggcagccccctgcacagcaccggccacccccacctggcccccgcccccgcccacctgcccagccaggcccacctgtacacctacgccgcccccaccagcgccgccgccctgggcagcaccagcagcatcgcccacctgttcagcccccagggcagcagcagacacgccgccgcctacaccacccaccccagcaccctggtgcaccaggtgcccgtgagcgtgggccccagcctgctgaccagcgccagcgtggcccccgcccagtaccagcaccagttcgccacccagagctacatcggcagcagcagaggcagcaccatctacaccggctaccccctgagccccaccaagatcagccagtacagctacctgtag

SEQ ID NO: 10737 - DNA, 3498 bp, Artificial Sequence
  Description of Artificial Sequence: Synthetic coding sequence
atggccagccagctgcaggtgttcagcccccccagcgtgagcagcagcgccttctgcagcgccaagaagctgaagatcgagcccagcggctgggacgtgagcggccagagcagcaacgacaagtactacacccacagcaagaccctgcccgccacccagggccaggccaacagcagccaccaggtggccaacttcaacatccccgcctacgaccagggcctgctgctgcccgcccccgccgtggagcacatcgtggtgaccgccgccgacagcagcggcagcgccgccaccagcaccttccagagcagccagaccctgacccacagaagcaacgtgagcctgctggagccctaccagaagtgcggcctgaagagaaagagcgaggaggtggacagcaacggcagcgtgcagatcatcgaggagcacccccccctgatgctgcagaacagaaccgtggtgggcgccgccgccaccaccaccaccgtgaccaccaagagcagcagcagcagcggcgagggcgactaccagctggtgcagcacgagatcctgtgcagcatgaccaacagctacgaggtgctggagttcctgggcagaggcaccttcggccaggtggccaagtgctggaagagaagcaccaaggagatcgtggccatcaagatcctgaagaaccaccccagctacgccagacagggccagatcgaggtgagcatcctgagcagactgagcagcgagaacgccgacgagtacaacttcgtgagaagctacgagtgcttccagcacaagaaccacacctgcctggtgttcgagatgctggagcagaacctgtacgacttcctgaagcagaacaagttcagccccctgcccctgaagtacatcagacccatcctgcagcaggtggccaccgccctgatgaagctgaagagcctgggcctgatccacgccgacctgaagcccgagaacatcatgctggtggaccccgtgagacagccctacagagtgaaggtgatcgacttcggcagcgccagccacgtgagcaaggccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagaccccaacctgggctaccccctgtggagactgaagacccccgaggagcacgagctggagaccggcatcaagagcaaggaggccagaaagtacatcttcaactgcctggacgacatggcccaggtgaacatgagcaccgacctggagggcaccgacatgctggccgagaaggccgacagaagagagtacatcgacctgctgaagaagatgctgaccatcgacgccgacaagagaatcacccccctgaagaccctgaaccaccagttcgtgaccatgacccacctgctggacttcccccacagcaaccacgtgaagagctgcttccagaacatggagatctgcaagagaagagtgcacatgtacgacaccgtgagccagatcaagagccccttcaccacccacgtggcccccaacaccagcaccaacctgaccatgagcttcagcaaccagctgaacaccgtgcacaaccaggccagcgtgctggccagcagcagcaccgccgccgccgccaccctgagcctggccaacagcgacgtgagcctgctgaactaccagagcgccctgtaccccagcagcgccgcccccgtgcccggcgtggcccagcagggcgtgagcctgcagcccggcaccacccagatctgcacccagaccgaccccttccagcagaccttcatcgtgtgcccccccgccttccagaccggcctgcaggccaccaccaagcacagcggcttccccgtgagaatggacaacgccgtgcccatcgtgccccaggcccccgccgcccagcccctgcagatccagagcggcgtgctgacccagcaggcctggcccggcggcacccagcagatcctgctgcccagcacctggcagcagctgcccggcgtggccctgcacaacagcgtgcagcccaccgccatgatccccgaggccatgggcagcggccagcagctggccgactggagaaacgcccacagccacggcaaccagtacagcaccatcatgcagcagcccagcctgctgaccaaccacgtgaccctggccaccgcccagcccctgaacgtgggcgtggcccacgtggtgagacagcagcagagcagcagcctgcccagcaagaagaacaagcagagcgcccccgtgagcagcaagagcagcctggacgtgctgcccagccaggtgtacagcctggtgggcagcagccccctgagaaccaccagcagctacaacagcctggtgcccgtgcaggaccagcaccagcccatcatcatccccgacacccccagcccccccgtgagcgtgatcaccatcagaagcgacaccgacgaggaggaggacaacaagtacaagcccagcagcagcggcctgaagcccagaagcaacgtgatcagctacgtgaccgtgaacgacagccccgacagcgacagcagcctgagcagcccctacagcaccgacaccctgagcgccctgagaggcaacagcggcagcgtgctggagggccccggcagagtggtggccgacggcaccggcaccagaaccatcatcgtgccccccctgaagacccagctgggcgactgcaccgtggccacccaggccagcggcctgctgagcaacaagaccaagcccgtggccagcgtgagcggccagagcagcggctgctgcatcacccccaccggctacagagcccagagaggcggcaccagcgccgcccagcccctgaacctgagccagaaccagcagagcagcgccgcccccaccagccaggagagaagcagcaaccccgcccccagaagacagcaggccttcgtggcccccctgagccaggccccctacaccttccagcacggcagccccctgcacagcaccggccacccccacctggcccccgcccccgcccacctgcccagccaggcccacctgtacacctacgccgcccccaccagcgccgccgccctgggcagcaccagcagcatcgcccacctgttcagcccccagggcagcagcagacacgccgccgcctacaccacccaccccagcaccctggtgcaccaggtgcccgtgagcgtgggccccagcctgctgaccagcgccagcgtggcccccgcccagtaccagcaccagttcgccacccagagctacatcggcagcagcagaggcagcaccatctacaccggctaccccctgagccccaccaagatcagccagtacagctacctgtag

SEQ ID NO: 10738 - DNA, 3498 bp, Artificial Sequence; identical to SEQ ID NO: 10737
  Description of Artificial Sequence: Synthetic coding sequence

SEQ ID NO: 10739 - DNA, 3633 bp, Artificial Sequence
  Description of Artificial Sequence: Synthetic coding sequence
atggccagccagctgcaggtgttcagcccccccagcgtgagcagcagcgccttctgcagcgccaagaagctgaagatcgagcccagcggctgggacgtgagcggccagagcagcaacgacaagtactacacccacagcaagaccctgcccgccacccagggccaggccaacagcagccaccaggtggccaacttcaacatccccgcctacgaccagggcctgctgctgcccgcccccgccgtggagcacatcgtggtgaccgccgccgacagcagcggcagcgccgccaccagcaccttccagagcagccagaccctgacccacagaagcaacgtgagcctgctggagccctaccagaagtgcggcctgaagagaaagagcgaggaggtggacagcaacggcagcgtgcagatcatcgaggagcacccccccctgatgctgcagaacagaaccgtggtgggcgccgccgccaccaccaccaccgtgaccaccaagagcagcagcagcagcggcgagggcgactaccagctggtgcagcacgagatcctgtgcagcatgaccaacagctacgaggtgctggagttcctgggcagaggcaccttcggccaggtggccaagtgctggaagagaagcaccaaggagatcgtggccatcaagatcctgaagaaccaccccagctacgccagacagggccagatcgaggtgagcatcctgagcagactgagcagcgagaacgccgacgagtacaacttcgtgagaagctacgagtgcttccagcacaagaaccacacctgcctggtgttcgagatgctggagcagaacctgtacgacttcctgaagcagaacaagttcagccccctgcccctgaagtacatcagacccatcctgcagcaggtggccaccgccctgatgaagctgaagagcctgggcctgatccacgccgacctgaagcccgagaacatcatgctggtggaccccgtgagacagccctacagagtgaaggtgatcgacttcggcagcgccagccacgtgagcaaggccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagaccccaacctgggctaccccctgtggagactgaagacccccgaggagcacgagctggagaccggcatcaagagcaaggaggccagaaagtacatcttcaactgcctggacgacatggcccaggtgaacatgagcaccgacctggagggcaccgacatgctggccgagaaggccgacagaagagagtacatcgacctgctgaagaagatgctgaccatcgacgccgacaagagaatcacccccctgaagaccctgaaccaccagttcgtgaccatgacccacctgctggacttcccccacagcaaccacgtgaagagctgcttccagaacatggagatctgcaagagaagagtgcacatgtacgacaccgtgagccagatcaagagccccttcaccacccacgtggcccccaacaccagcaccaacctgaccatgagcttcagcaaccagctgaacaccgtgcacaaccaggccagcgtgctggccagcagcagcaccgccgccgccgccaccctgagcctggccaacagcgacgtgagcctgctgaactaccagagcgccctgtaccccagcagcgccgcccccgtgcccggcgtggcccagcagggcgtgagcctgcagcccggcaccacccagatctgcacccagaccgaccccttccagcagaccttcatcgtgtgcccccccgccttccagaccggcctgcaggccaccaccaagcacagcggcttccccgtgagaatggacaacgccgtgcccatcgtgccccaggcccccgccgcccagcccctgcagatccagagcggcgtgctgacccagggcagctgcacccccctgatggtggccaccctgcacccccaggtggccaccatcaccccccagtacgccgtgcccttcaccctgagctgcgccgccggcagacccgccctggtggagcagaccgccgccgtgctgcaggcctggcccggcggcacccagcagatcctgctgcccagcacctggcagcagctgcccggcgtggccctgcacaacagcgtgcagcccaccgccatgatccccgaggccatgggcagcggccagcagctggccgactggagaaacgcccacagccacggcaaccagtacagcaccatcatgcagcagcccagcctgctgaccaaccacgtgaccctggccaccgcccagcccctgaacgtgggcgtggcccacgtggtgagacagcagcagagcagcagcctgcccagcaagaagaacaagcagagcgcccccgtgagcagcaagagcagcctggacgtgctgcccagccaggtgtacagcctggtgggcagcagccccctgagaaccaccagcagctacaacagcctggtgcccgtgcaggaccagcaccagcccatcatcatccccgacacccccagcccccccgtgagcgtgatcaccatcagaagcgacaccgacgaggaggaggacaacaagtacaagcccagcagcagcggcctgaagcccagaagcaacgtgatcagctacgtgaccgtgaacgacagccccgacagcgacagcagcctgagcagcccctacagcaccgacaccctgagcgccctgagaggcaacagcggcagcgtgctggagggccccggcagagtggtggccgacggcaccggcaccagaaccatcatcgtgccccccctgaagacccagctgggcgactgcaccgtggccacccaggccagcggcctgctgagcaacaagaccaagcccgtggccagcgtgagcggccagagcagcggctgctgcatcacccccaccggctacagagcccagagaggcggcaccagcgccgcccagcccctgaacctgagccagaaccagcagagcagcgccgcccccaccagccaggagagaagcagcaaccccgcccccagaagacagcaggccttcgtggcccccctgagccaggccccctacaccttccagcacggcagccccctgcacagcaccggccacccccacctggcccccgcccccgcccacctgcccagccaggcccacctgtacacctacgccgcccccaccagcgccgccgccctgggcagcaccagcagcatcgcccacctgttcagcccccagggcagcagcagacacgccgccgcctacaccacccaccccagcaccctggtgcaccaggtgcccgtgagcgtgggccccagcctgctgaccagcgccagcgtggcccccgcccagtaccagcaccagttcgccacccagagctacatcggcagcagcagaggcagcaccatctacaccggctaccccctgagccccaccaagatcagccagtacagctacctgtag

SEQ ID NO: 10740 - DNA, 3228 bp, Artificial Sequence
  Description of Artificial Sequence: Synthetic coding sequence
atggccagccagctgcaggtgttcagcccccccagcgtgagcagcagcgccttctgcagcgccaagaagctgaagatcgagcccagcggctgggacgtgagcggccagagcagcaacgacaagtactacacccacagcaagaccctgcccgccacccagggccaggccaacagcagccaccaggtggccaacttcaacatccccgcctacgaccagggcctgctgctgcccgcccccgccgtggagcacatcgtggtgaccgccgccgacagcagcggcagcgccgccaccagcaccttccagagcagccagaccctgacccacagaagcaacgtgagcctgctggagccctaccagaagtgcggcctgaagagaaagagcgaggaggtggacagcaacggcagcgtgcagatcatcgaggagcacccccccctgatgctgcagaacagaaccgtggtgggcgccgccgccaccaccaccaccgtgaccaccaagagcagcagcagcagcggcgagggcgactaccagctggtgcagcacgagatcctgtgcagcatgaccaacagctacgaggtgctggagttcctgggcagaggcaccttcggccaggtggccaagtgctggaagagaagcaccaaggagatcgtggccatcaagatcctgaagaaccaccccagctacgccagacagggccagatcgaggtgagcatcctgagcagactgagcagcgagaacgccgacgagtacaacttcgtgagaagctacgagtgcttccagcacaagaaccacacctgcctggtgttcgagatgctggagcagaacctgtacgacttcctgaagcagaacaagttcagccccctgcccctgaagtacatcagacccatcctgcagcaggtggccaccgccctgatgaagctgaagagcctgggcctgatccacgccgacctgaagcccgagaacatcatgctggtggaccccgtgagacagccctacagagtgaaggtgatcgacttcggcagcgccagccacgtgagcaaggccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagaccccaacctgggctaccccctgtggagactgaagacccccgaggagcacgagctggagaccggcatcaagagcaaggaggccagaaagtacatcttcaactgcctggacgacatggcccaggtgaacatgagcaccgacctggagggcaccgacatgctggccgagaaggccgacagaagagagtacatcgacctgctgaagaagatgctgaccatcgacgccgacaagagaatcacccccctgaagaccctgaaccaccagttcgtgaccatgacccacctgctggacttcccccacagcaaccacgtgaagagctgcttccagaacatggagatctgcaagagaagagtgcacatgtacgacaccgtgagccagatcaagagccccttcaccacccacgtggcccccaacaccagcaccaacctgaccatgagcttcagcaaccagctgaacaccgtgcacaaccaggccagcgtgctggccagcagcagcaccgccgccgccgccaccctgagcctggccaacagcgacgtgagcctgctgaactaccagagcgccctgtaccccagcagcgccgcccccgtgcccggcgtggcccagcagggcgtgagcctgcagcccggcaccacccagatctgcacccagaccgaccccttccagcagaccttcatcgtgtgcccccccgccttccagaccggcctgcaggccaccaccaagcacagcggcttccccgtgagaatggacaacgccgtgcccatcgtgccccaggcccccgccgcccagcccctgcagatccagagcggcgtgctgacccagggcagctgcacccccctgatggtggccaccctgcacccccaggtggccaccatcaccccccagtacgccgtgcccttcaccctgagctgcgccgccggcagacccgccctggtggagcagaccgccgccgtgctgcaggcctggcccggcggcacccagcagatcctgctgcccagcacctggcagcagctgcccggcgtggccctgcacaacagcgtgcagcccaccgccatgatccccgaggccatgggcagcggccagcagctggccgactggagaaacgcccacagccacggcaaccagtacagcaccatcatgcagcagcccagcctgctgaccaaccacgtgaccctggccaccgcccagcccctgaacgtgggcgtggcccacgtggtgagacagcagcagagcagcagcctgcccagcaagaagaacaagcagagcgcccccgtgagcagcaagagcagcctggacgtgctgcccagccaggtgtacagcctggtgggcagcagccccctgagaaccaccagcagctacaacagcctggtgcccgtgcaggaccagcaccagcccatcatcatccccgacacccccagcccccccgtgagcgtgatcaccatcagaagcgacaccgacgaggaggaggacaacaagtacaagcccagcagcagcggcctgaagcccagaagcaacgtgatcagctacgtgaccgtgaacgacagccccgacagcgacagcagcctgagcagcccctacagcaccgacaccctgagcgccctgagaggcaacagcggcagcgtgctggagggccccggcagagtggtggccgacggcaccggcaccagaaccatcatcgtgccccccctgaagacccagctgggcgactgcaccgtggccacccaggccagcggcctgctgagcaacaagaccaagcccgtggccagcgtgagcggccagagcagcggctgctgcatcacccccaccggctacagagcccagagaggcggcaccagcgccgcccagcccctgaacctgagccaggtgagcgccatgggctactgcctgctgttcggcccctgcaccgtggtgaccttctggagaaccctgctgctggccggctgctag

SEQ ID NO: 10741 - DNA, 543 bp, Artificial Sequence
  Description of Artificial Sequence: Synthetic coding sequence
atgcaggccgagggccagggcaccggcggcagcaccggcgacgccgacggccccggcggccccggcatccccgacggccccggcggcaacgccggcggccccggcgaggccggcgccaccggcggcagaggccccagaggcgccggcgccgccagagccagcggccccagaggcggcgcccccagaggcccccacggcggcgccgccagcgcccaggacggcagatgcccctgcggcgccagaagacccgacagcagactgctgcagctgcacatcaccatgcccttcagcagccccatggaggccgagctggtgagaagaatcctgagcagagacgccgcccccctgcccagacccggcgccgtgctgaaggacttcaccgtgagcggcaacctgctgttcatcagactgaccgccgccgaccacagacagctgcagctgagcatcagcagctgcctgcagcagctgagcctgctgatgtggatcacccagtgcttcctgcccgtgttcctggcccaggcccccagcggccagagaagatag

SEQ ID NO: 10742 - DNA, 717 bp, Artificial Sequence
  Description of Artificial Sequence: Synthetic coding sequence
atgagcgaggacctggccaagcagctggccagctacaaggcccagctgcagcaggtggaggccgccctgagcggcaacggcgagaacgaggacctgctgaagctgaagaaggacctgcaggaggtgatcgagctgaccaaggacctgctgagcacccagcccagcgagaccctggccagcagcgacagcttcgccagcacccagcccacccacagctggaaggtgggcgacaagtgcatggccgtgtggagcgaggacggccagtgctacgaggccgagatcgaggagatcgacgaggagaacggcaccgccgccatcaccttcgccggctacggcaacgccgaggtgacccccctgctgaacctgaagcccgtggaggagggcagaaaggccaaggaggacagcggcaacaagcccatgagcaagaaggagatgatcgcccagcagagagagtacaagaagaagaaggccctgaagaaggcccagagaatcaaggagctggagcaggagagagaggaccagaaggtgaagtggcagcagttcaacaacagagcctacagcaagaacaagaagggccaggtgaagagaagcatcttcgccagccccgagagcgtgaccggcaaggtgggcgtgggcacctgcggcatcgccgacaagcccatgacccagtaccaggacaccagcaagtacaacgtgagacacctgatgccccagtag

SEQ ID NO: 10743 - DNA, 717 bp, Artificial Sequence; identical to SEQ ID NO: 10742
  Description of Artificial Sequence: Synthetic coding sequence

SEQ ID NO: 10744 - DNA, 2229 bp, Artificial Sequence
  Description of Artificial Sequence: Synthetic coding sequence
gacctgagcagcggcggcggcatcgagccccagtgcagcagcgaggtgtacttcagagccagagagagaggctgcgagaacgtggcctggagcctgggcctgagaagccactgcttcctggaggccgagctgcaccccctgccctggttcctgcccaccaacgtgtgcagccccctgcccggcgccgcccacaagctggtgtgctacttcaccaactgggcccacagcagacccggccccgccagcatcctgccccacgacctggaccccttcctgtgcacccacctgatcttcgccttcgccagcatgaacaacaaccagatcgtggccaaggacctgcaggacgagaagatcctgtaccccgagttcaacaagctgaaggagagaatgtggcagcagctgcccaccggcgtgaagaaccccgcccaccagcccagcctgagccaccacagaaacagagagctgaagaccctgctgagcatcggcggctggaacttcggcaccagcagattcaccaccatgctgagcaccttcgccaacagagagaagttcatcgccagcgtgatcagcctgctgagaacccacgacttcgacggcctggacctgttcttcctgtaccccggcctgagaggcagccccatgcacgacagatggaccttcctgttcctgatcgaggagctgctgttcgccttcagaaaggaggccctgctgaccatgagacccagactgctgctgagcgccgccgtgagcggcgtgccccacatcgtgcagaccagctacgacgtgagattcctgggcagactgctggacttcatcaacgtgctgagctacgacctgcacggcagctgggagagattcaccggccacaacagccccctgttcagcctgcccgaggaccccaagagcagcgcctacgccatgaactactggagaaagctgggcgcccccagcgagaagctgatcatgggcatccccacctacggcagaaccttcagactgctgaaggccagcaagaacggcctgcaggccagagccatcggccccgccagccccggcaagtacaccaagcaggagggcttcctggcctacttcgagatctgcagcttcgtgtggggcgccaagaagcactggatcgactaccagtacgtgccctacgccaacaagggcaaggagtgggtgggctacgacaacgccatcagcttcagctacaaggcctggttcatcagaagagagcacttcggcggcgccatggtgtggaccctggacatggacgacgtgagaggcaccttctgcggcaccggccccttccccctggtgtacgtgctgaacgacatcctggtgagagccgagttcagcagcaccagcctgccccagttctggctgagcagcgccgtgaacagcagcagcaccgaccccgagagactggccgtgaccaccgcctggaccaccgacagcaagatcctgccccccggcggcgaggccggcgtgaccgagatccacggcaagtgcgagaacatgaccatcacccccagaggcaccaccgtgacccccaccaaggagaccgtgagcctgggcaagcacaccgtggccctgggcgagaagaccgagatcaccggcgccatgaccatgaccagcgtgggccaccagagcatgacccccggcgagaaggccctgacccccgtgggccaccagagcgtgaccaccggccagaagaccctgaccagcgtgggctaccagagcgtgacccccggcgagaagaccctgacccccgtgggccaccagagcgtgacccccgtgagccaccagagcgtgagccccggcggcaccaccatgacccccgtgcacttccagaccgagaccctgagacagaacaccgtggcccccagaagaaaggccgtggccagagagaaggtgaccgtgcccagcagaaacatcagcgtgacccccgagggccagaccatgcccctgagaggcgagaacctgaccagcgaggtgggcacccaccccagaatgggcaacctgggcctgcagatggaggccgagaacagaatgatgctgagcagcagccccgtgatccagctgcccgagcagacccccctggccttcgacaacagattcgtgcccatctacggcaaccacagcagcgtgaacagcgtgaccccccagaccagccccctgagcctgaagaaggagatccccgagaacagcgccgtggacgaggaggcctag

SEQ ID NO: 10745 - DNA, 2037 bp, Artificial Sequence
  Description of Artificial Sequence: Synthetic coding sequence
atgtggaagctgctgctgtgggtgggcctggtgctggtgctgaagcaccacgacggcgccgcccacaagctggtgtgctacttcaccaactgggcccacagcagacccggccccgccagcatcctgccccacgacctggaccccttcctgtgcacccacctgatcttcgccttcgccagcatgaacaacaaccagatcgtggccaaggacctgcaggacgagaagatcctgtaccccgagttcaacaagctgaaggagagaaacagagagctgaagaccctgctgagcatcggcggctggaacttcggcaccagcagattcaccaccatgctgagcaccttcgccaacagagagaagttcatcgccagcgtgatcagcctgctgagaacccacgacttcgacggcctggacctgttcttcctgtaccccggcctgagaggcagccccatgcacgacagatggaccttcctgttcctgatcgaggagctgctgttcgccttcagaaaggaggccctgctgaccatgagacccagactgctgctgagcgccgccgtgagcggcgtgccccacatcgtgcagaccagctacgacgtgagattcctgggcagactgctggacttcatcaacgtgctgagctacgacctgcacggcagctgggagagattcaccggccacaacagccccctgttcagcctgcccgaggaccccaagagcagcgcctacgccatgaactactggagaaagctgggcgcccccagcgagaagctgatcatgggcatccccacctacggcagaaccttcagactgctgaaggccagcaagaacggcctgcaggccagagccatcggccccgccagccccggcaagtacaccaagcaggagggcttcctggcctacttcgagatctgcagcttcgtgtggggcgccaagaagcactggatcgactaccagtacgtgccctacgccaacaagggcaaggagtgggtgggctacgacaacgccatcagcttcagctacaaggcctggttcatcagaagagagcacttcggcggcgccatggtgtggaccctggacatggacgacgtgagaggcaccttctgcggcaccggccccttccccctggtgtacgtgctgaacgacatcctggtgagagccgagttcagcagcaccagcctgccccagttctggctgagcagcgccgtgaacagcagcagcaccgaccccgagagactggccgtgaccaccgcctggaccaccgacagcaagatcctgccccccggcggcgaggccggcgtgaccgagatccacggcaagtgcgagaacatgaccatcacccccagaggcaccaccgtgacccccaccaaggagaccgtgagcctgggcaagcacaccgtggccctgggcgagaagaccgagatcaccggcgccatgaccatgaccagcgtgggccaccagagcatgacccccggcgagaaggccctgacccccgtgggccaccagagcgtgaccaccggccagaagaccctgaccagcgtgggctaccagagcgtgacccccggcgagaagaccctgacccccgtgggccaccagagcgtgacccccgtgagccaccagagcgtgagccccggcggcaccaccatgacccccgtgcacttccagaccgagaccctgagacagaacaccgtggcccccagaagaaaggccgtggccagagagaaggtgaccgtgcccagcagaaacatcagcgtgacccccgagggccagaccatgcccctgagaggcgagaacctgaccagcgaggtgggcacccaccccagaatgggcaacctgggcctgcagatggaggccgagaacagaatgatgctgagcagcagccccgtgatccagctgcccgagcagacccccctggccttcgacaacagattcgtgcccatctacggcaaccacagcagcgtgaacagcgtgaccccccagaccagccccctgagcctgaagaaggagatccccgagaacagcgccgtggacgaggaggcctag

SEQ ID NO: 10746 - DNA, 1005 bp, Artificial Sequence
  Description of Artificial Sequence: Synthetic coding sequence
atgggcggcgccgtgagcgccggcgaggacaacgacgagctgatcgacaacctgaaggaggcccagtacatcagaaccgagctggtggagcaggccttcagagccatcgacagagccgactactacctggaggagttcaaggagaacgcctacaaggacctggcctggaagcacggcaacatccacctgagcgccccctgcatctacagcgaggtgatggaggccctggacctgcagcccggcctgagcttcctgaacctgggcagcggcaccggctacctgagcagcatggtgggcctgatcctgggccccttcggcgtgaaccacggcgtggagctgcacagcgacgtgatcgagtacgccaagcagaagctggacttcttcatcagaaccagcgacagcttcgacaagttcgacttctgcgagcccagcttcgtgaccggcaactgcctggagatcagccccgactgcagccagtacgacagagtgtactgcggcgccggcgtgcagaaggagcacgaggagtacatgaagaacctgctgaaggtgggcggcatcctggtgatgcccctggaggagaagccctgccacagcgagagcggcaagagcagactggtgcagctgccccccgtggccgtgagaagcctgcaggacctggccagaatcgccatcagaggcaccatcaagaagatcatccaccaggagaccgtgagcaagaacggcaacggcctgaagaacacccccagattcaagagaagaagagtgagaagaagaagaatggagaccatcgtgttcctggacaaggaggtgttcgccagcagaatcagcaaccccagcgacgacaacagctgcgaggacctggaggaggagagaagagaggaggaggagaagaccccccccgagaccaagcccgacccccccgtgaacttcctgagacagaaggtgctgagcctgcccctgcccgaccccctgaagtactacctgctgtactacagagagaagtag

SEQ ID NO: 10747 - DNA, 1785 bp, Artificial Sequence
  Description of Artificial Sequence: Synthetic coding sequence
atgagcagacccagcagcagagccatctacctgcacagaaaggagtacagccagaacctgaccagcgagcccaccctgctgcagcacagagtggagcacctgatgacctgcaagcagggcagccagagagtgcagggccccgaggacgccctgcagaagctgttcgagatggacgcccagggcagagtgtggagccaggacctgatcctgcaggtgagagacggctggctgcagctgctggacatcgagaccaaggaggagctggacagctacagactggacagcatccaggccatgaacgtggccctgaacacctgcagctacaacagcatcctgagcatcaccgtgcaggagcccggcctgcccggcaccagcaccctgctgttccagtgccaggaggtgggcgccgagagactgaagaccagcctgcagaaggccctggaggaggagctggagcagagcagacccagactgggcggcctgcagcccggccaggacagatggagaggccccgccatggagagacccctgcccatggagcaggccagatacctggagcccggcatcccccccgagcagccccaccagagaaccctggagcacagcctgccccccagccccagacccctgcccagacacaccagcgccagagagcccagcgccttcaccctgcccccccccagaagaagcagcagccccgaggaccccgagagagacgaggaggtgctgaaccacgtgctgagagacatcgagctgttcatgggcaagctggagaaggcccaggccaagaccagcagaaagaagaagttcggcaagaagaacaaggaccagggcggcctgacccaggcccagtacatcgactgcttccagaagatcaagcacagcttcaacctgctgggcagactggccacctggctgaaggagaccagcgcccccgagctggtgcacatcctgttcaagagcctgaacttcatcctggccagatgccccgaggccggcctggccgcccaggtgatcagccccctgctgacccccaaggccatcaacctgctgcagagctgcctgagcccccccgagagcaacctgtggatgggcctgggccccgcctggaccaccagcagagccgactggaccggcgacgagcccctgccctaccagcccaccttcagcgacgactggcagctgcccgagcccagcagccaggcccccctgggctaccaggaccccgtgagcctgagaagaggcagccacagactgggcagcaccagccacttcccccaggagaagacccacaaccacgacccccagcccggcgaccccaacagcagacccagcagccccaagcccgcccagcccgccctgaagatgcaggtgctgtacgagttcgaggccagaaaccccagagagctgaccgtggtgcagggcgagaagctggaggtgctggaccacagcaagagatggtggctggtgaagaacgaggccggcagaagcggctacatccccagcaacatcctggagcccctgcagcccggcacccccggcacccagggccagagccccagcagagtgcccatgctgagactgagcagcagacccgaggaggtgaccgactggctgcaggccgagaacttcagcaccgccaccgtgagaaccctgggcagcctgaccggcagccagctgctgagaatcagacccggcgagctgcagatgctgtgcccccaggaggcccccagaatcctgagcagactggaggccgtgagaagaatgctgggcatcagcccctag

SEQ ID NO: 10748 - DNA, 1500 bp, Artificial Sequence
  Description of Artificial Sequence: Synthetic coding sequence
atgagcttcggcagcgagcactacctgtgcagcagcagcagctacagaaaggtgttcggcgacggcagcagactgagcgccagactgagcggcgccggcggcgccggcggcttcagaagccagagcctgagcagaagcaacgtggccagcagcgccgcctgcagcagcgccagcagcctgggcctgggcctggcctacagaagaccccccgccagcgacggcctggacctgagccaggccgccgccagaaccaacgagtacaagatcatcagaaccaacgagaaggagcagctgcagggcctgaacgacagattcgccgtgttcatcgagaaggtgcaccagctggagacccagaacagagccctggaggccgagctggccgccctgagacagagacacgccgagcccagcagagtgggcgagctgttccagagagagctgagagacctgagagcccagctggaggaggccagcagcgccagaagccaggccctgctggagagagacggcctggccgaggaggtgcagagactgagagccagatgcgaggaggagagcagaggcagagagggcgccgagagagccctgaaggcccagcagagagacgtggacggcgccaccctggccagactggacctggagaagaaggtggagagcctgctggacgagctggccttcgtgagacaggtgcacgacgaggaggtggccgagctgctggccaccctgcaggccagcagccaggccgccgccgaggtggacgtgaccgtggccaagcccgacctgaccagcgccctgagagagatcagagcccagtacgagagcctggccgccaagaacctgcagagcgccgaggagtggtacaagagcaagttcgccaacctgaacgagcaggccgccagaagcaccgaggccatcagagccagcagagaggagatccacgagtacagaagacagctgcaggccagaaccatcgagatcgagggcctgagaggcgccaacgagagcctggagagacagatcctggagctggaggagagacacagcgccgaggtggccggctaccaggacagcatcggccagctggagaacgacctgagaaacaccaagagcgagatggccagacacctgagagagtaccaggacctgctgaacgtgaagatggccctggacatcgagatcgccgcctacagaaagctgctggagggcgaggagaccagattcagcaccagcggcctgagcatcagcggcctgaaccccctgcccaaccccagctacctgctgccccccagaatcctgagcgccaccaccagcaaggtgagcagcaccggcctgagcctgaagaaggaggaggaggaggaggaggccagcaaggtggccagcaagaagaccagccagatcggcgagagcttcgaggagatcctggaggagaccgtgatcagcaccaagaagaccgagaagagcaacatcgaggagaccaccatcagcagccagaagatctag

SEQ ID NO: 10749 - DNA, 1131 bp, Artificial Sequence
  Description of Artificial Sequence: Synthetic coding sequence
atggagagctacgacgtgatcgccaaccagcccgtggtgatcgacaacggcagcggcgtgatcaaggccggcttcgccggcgaccagatccccaagtactgcttccccaactacgtgggcagacccaagcacgtgagagtgatggccggcgccctggagggcgacatcttcatcggccccaaggccgaggagcacagaggcctgctgagcatcagataccccatggagcacggcatcgtgaaggactggaacgacatggagagaatctggcagtacgtgtacagcaaggaccagctgcagaccttcagcgaggagcaccccgtgctgctgaccgaggcccccctgaaccccagaaagaacagagagagagccgccgaggtgttcttcgagaccttcaacgtgcccgccctgttcatcagcatgcaggccgtgctgagcctgtacgccaccggcagaaccaccggcgtggtgctggacagcggcgacggcgtgacccacgccgtgcccatctacgagggcttcgccatgccccacagcatcatgagaatcgacatcgccggcagagacgtgagcagattcctgagactgtacctgagaaaggagggctacgacttccacagcagcagcgagttcgagatcgtgaaggccatcaaggagagagcctgctacctgagcatcaacccccagaaggacgagaccctggagaccgagaaggcccagtactacctgcccgacggcagcaccatcgagatcggccccagcagattcagagcccccgagctgctgttcagacccgacctgatcggcgaggagagcgagggcatccacgaggtgctggtgttcgccatccagaagagcgacatggacctgagaagaaccctgttcagcaacatcgtgctgagcggcggcagcaccctgttcaagggcttcggcgacagactgctgagcgaggtgaagaagctggcccccaaggacgtgaagatcagaatcagcgccccccaggagagactgtacagcacctggatcggcggcagcatcctggccagcctggacaccttcaagaagatgtgggtgagcaagaaggagtacgaggaggacggcgccagaagcatccacagaaagaccttctag

SEQ ID NO: 10750 - DNA, 783 bp, Artificial Sequence
  Description of Artificial Sequence: Synthetic coding sequence
atgagcctgcagaagaccccccccaccagagtgttcgtggagctggtgccctgggccgacagaagcagagagaacaacctggccagcggcagagagaccctgcccggcctgagacaccccctgagcagcacccaggcccagaccgccaccagagaggtgcaggtgagcggcaccagcgaggtgagcgccggccccgacagagcccaggtggtggtgagagtgagcagcaccaaggaggccgccgccgaggccaagaagagcgtgtgcagaagactggactacatcacccagagcctgcagcagcagggcgtgcaggccgagaacatcaccgtgaccaaggacttcagaagagtggagaacgcctaccacatggaggccgaggtgtgcatcaccttcaccgagttcggcaagatgcagaacatctgcaacttcctggtggagaagctggacagcagcgtggtgatcagccccccccagttctaccacacccccggcagcgtggagaacctgagaagacaggcctgcctggtggccgtggagaacgcctggagaaaggcccaggaggtgtgcaacctggtgggccagaccctgggcaagcccctgctgatcaaggaggaggagaccaaggagtgggagggccagatcgacgaccaccagagcagcagactgagcagcagcctgaccgtgcagcagaagatcaagagcgccaccatccacgccgccagcaaggtgttcatcaccttcgaggtgaagggcaaggagaagagaaagaagcacctgtag

SEQ ID NO: 10751 - DNA, 891 bp, Artificial Sequence
  Description of Artificial Sequence: Synthetic coding sequence
atggagcccagcggcggcgagcaggagcccggcgccgtgagattcctggacctgccctgggaggacgtgctgctgccccacgtgctgaacagagtgcccctgagacagctgctgagactgcagagagtgagcagagccttcagaagcctggtgcagctgcacctggccggcctgagaagattcgacgccgcccaggtgggcccccagatccccagagccgccctggccagactgctgagagacgccgagggcctgcaggagctggccctggccccctgccacgagtggctgagcgacgaggacctggtgcccgtgctggccagaaacccccagctgagaagcgtggccctgggcggctgcggccagctgagcagaagagccctgggcgccctggccgagggctgccccagactgcagagactgagcctggcccactgcgactgggtggacggcctggccctgagaggcctggccgacagatgccccgccctggaggagctggacctgaccgcctgcagacagctgaaggacgaggccatcgtgtacctggcccagagaagaggcgccggcctgagaagcctgagcctggccgtgaacgccaacgtgggcgacgccgccgtgcaggagctggccagaaactgccccgagctgcaccacctggacctgaccggctgcctgagagtgggcagcgacggcgtgagaaccctggccgagtactgccccgtgctgagaagcctgagagtgagacactgccaccacgtggccgagagcagcctgagcagactgagaaagagaggcgtggacatcgacgtggagccccccctgcaccaggccctggtgctgctgcaggacatggccggcttcgcccccttcgtgaacctgcaggtgtag

SEQ ID NO: 10752 - DNA, 2100 bp, Artificial Sequence
  Description of Artificial Sequence: Synthetic coding sequence
atggccgacgccggcatcagaagagtggtgcccagcgacctgtaccccctggtgctgggcttcctgagagacaaccagctgagcgaggtggccaacaagttcgccaaggccaccggcgccacccagcaggacgccaacgccagcagcctgctggacatctacagcttctggctgaagagcgccaaggtgcccgagagaaagctgcaggccaacggccccgtggccaagaaggccaagaagaaggccagcagcagcgacagcgaggacagcagcgaggaggaggaggaggtgcagggcccccccgccaagaaggccgccgtgcccgccaagagagtgggcctgccccccggcaaggccgccgccaaggccagcgagagcagcagcagcgaggagagcagcgacgacgacgacgaggaggaccagaagaagcagcccgtgcagaagggcgtgaagccccaggccaaggccgccaaggccccccccaagaaggccaagagcagcgacagcgacagcgacagcagcagcgaggacgagccccccaagaaccagaagcccaagatcacccccgtgaccgtgaaggcccagaccaaggccccccccaagcccgccagagccgcccccaagatcgccaacggcaaggccgccagcagcagcagcagcagcagcagcagcagcagcagcgacgacagcgaggaggagaaggccgccgccacccccaagaagaccgtgcccaagaagcaggtggtggccaaggcccccgtgaaggccgccaccacccccaccagaaagagcagcagcagcgaggacagcagcagcgacgaggaggaggagcagaagaagcccatgaagaacaagcccggcccctacagcagcgtgcccccccccagcgcccccccccccaagaagagcctgggcacccagccccccaagaaggccgtggagaagcagcagcccgtggagagcagcgaggacagcagcgacgagagcgacagcagcagcgaggaggagaagaagccccccaccaaggccgtggtgagcaaggccaccaccaagcccccccccgccaagaaggccgccgagagcagcagcgacagcagcgacagcgacagcagcgaggacgacgaggcccccagcaagcccgccggcaccaccaagaacagcagcaacaagcccgccgtgaccaccaagagccccgccgtgaagcccgccgccgcccccaagcagcccgtgggcggcggccagaagctgctgaccagaaaggccgacagcagcagcagcgaggaggagagcagcagcagcgaggaggagaagaccaagaagatggtggccaccaccaagcccaaggccaccgccaaggccgccctgagcctgcccgccaagcaggccccccagggcagcagagacagcagcagcgacagcgacagcagcagcagcgaggaggaggaggagaagaccagcaagagcgccgtgaagaagaagccccagaaggtggccggcggcgccgcccccagcaagcccgccagcgccaagaagggcaaggccgagagcagcaacagcagcagcagcgacgacagcagcgaggaggaggaggagaagctgaagggcaagggcagccccagaccccaggcccccaaggccaacggcaccagcgccctgaccgcccagaacggcaaggccgccaagaacagcgaggaggaggaggaggagaagaagaaggccgccgtggtggtgagcaagagcggcagcctgaagaagagaaagcagaacgaggccgccaaggaggccgagaccccccaggccaagaagatcaagctgcagacccccaacaccttccccaagagaaagaagggcgagaagagagccagcagccccttcagaagagtgagagaggaggagatcgaggtggacagcagagtggccgacaacagcttcgacgccaagagaggcgccgccggcgactggggcgagagagccaaccaggtgctgaagttcaccaagggcaagagcttcagacacgagaagaccaagaagaagagaggcagctacagaggcggcagcatcagcgtgcaggtgaacagcatcaagttcgacagcgagtag

SEQ ID NO: 10753 - DNA, 1275 bp, Artificial Sequence
  Description of Artificial Sequence: Synthetic coding sequence
atggaggagaacaacctgcagtgcagcagcgtggtggacggcaacttcgaggaggtgcccagagagaccgccatccagttcaagccccccctgtacagacagagataccagttcgtgaagaacctggtggaccagcacgagcccaagaaggtggccgacctgggctgcggcgacaccagcctgctgagactgctgaaggtgaacccctgcatcgagctgctggtgggcgtggacatcaacgaggacaagctgagatggagaggcgacagcctggcccccttcctgggcgacttcctgaagcccagagacctgaacctgaccatcaccctgtaccacggcagcgtggtggagagagacagcagactgctgggcttcgacctgatcacctgcatcgagctgatcgagcacctggacagcggcgacctggccagattccccgaggtggtgttcggctacctgagccccagcatgatcgtgatcagcacccccaacagcgagttcaaccccctgttccccagcgtgaccctgagagacagcgaccacaagttcgagtggaccagaatggagttccagacctgggccctgtacgtggccaacagatacgactacagcgtggagttcaccggcgtgggcgagccccccgccggcgccgagaacgtgggctactgcacccagatcggcatcttcagaaagaacggcggcaaggccaccgagagctgcctgagcgagcagcacgaccagcacgtgtacaaggccagacagggcctgaccatgctgcccagactggtgctgaacttccacccccaggccatcctgctgccccacctgcccaagatgctgagactgcaggtgttcaccaccagctaccccagcctgcagcaggagagattcttcaagctggtgctggtgaacgaggtgagccagcaggtggagagcctgagagtgagccacctgcccagaagaaaggagcaggccggcgagagaggcgacaagcccaaggacatcggcggcagcaaggcccccgtgccctgcttcggccccgtgttcaccgaggtggagaaggccaagatcgagaacagccccacccccttctgcgtgggcgacaagttcttcgtgcccctgcagagactgctggcctaccccaagctgaacagactgtgcgccaacgaggagatgatgagaagcgtgatcgccgacagcatccccctgagcagcgacggcagcgccgtggtggccgacctgagaaactacttcgacgagcagttcgagttctag

SEQ ID NO: 10754 - DNA, 1182 bp, Artificial Sequence
  Description of Artificial Sequence: Synthetic coding sequence
atggaggagaacaacctgcagtgcagcagcgtggtggacggcaacttcgaggaggtgcccagagagaccgccatccagttcaagccccccctgtacagacagagataccagttcgtgaagaacctggtggaccagcacgagcccaagaaggtggccgacctgggctgcggcgacaccagcctgctgagactgctgaaggtgaacccctgcatcgagctgctggtgggcgtggacatcaacgaggacaagctgagatggagaggcgacagcctggcccccttcctgggcgacttcctgaagcccagagacctgaacctgaccatcaccctgtaccacggcagcgtggtggagagagacagcagactgctgggcttcgacctgatcacctgcatcgagctgatcgagcacctggacagcggcgacctggccagattccccgaggtggtgttcggctacctgagccccagcatgatcgtgatcagcacccccaacagcgagttcaaccccctgttccccagcgtgaccctgagagacagcgaccacaagttcgagtggaccagaatggagttccagacctgggccctgtacgtggccaacagatacgactacagcgtggagttcaccggcgtgggcgagccccccgccggcgccgagaacgtgggctactgcacccagatcggcatcttcagaaagaacggcggcaaggccaccgagagctgcctgagcgagcagcacgaccagcacgtgtacaaggccgtgttcaccaccagctaccccagcctgcagcaggagagattcttcaagctggtgctggtgaacgaggtgagccagcaggtggagagcctgagagtgagccacctgcccagaagaaaggagcaggccggcgagagaggcgacaagcccaaggacatcggcggcagcaaggcccccgtgccctgcttcggccccgtgttcaccgaggtggagaaggccaagatcgagaacagccccacccccttctgcgtgggcgacaagttcttcgtgcccctgcagagactgctggcctaccccaagctgaacagactgtgcgccaacgaggagatgatgagaagcgtgatcgccgacagcatccccctgagcagcgacggcagcgccgtggtggccgacctgagaaactacttcgacgagcagttcgagttctag

SEQ ID NO: 10755 - DNA, 1701 bp, Artificial Sequence
  Description of Artificial Sequence: Synthetic coding sequence
atgagcgccagcaccggcggcggcggcgacagcggcggcagcggcggcagcagcagcagcagccaggccagctgcggccccgagagcagcggcagcgagctggccctggccacccccgtgccccagatgctgcagggcctgctgggcagcgacgacgaggagcaggaggaccccaaggactactgcaagggcggctaccaccccgtgaagatcggcgacgtgttcaacggcagataccacgtggtgagaaagctgggctggggccacttcagcaccgtgtggctgtgctgggacatccagagaaagagattcgtggccctgaaggtggtgaagagcgccggccactacaccgagaccgccgtggacgagatcaagctgctgaagtgcgtgagagacagcgaccccagcgaccccaagagagagaccatcgtgcagctgatcgacgacttcagaatcagcggcgtgaacggcgtgcacgtgtgcatggtgctggaggtgctgggccaccagctgctgaagtggatcatcaagagcaactaccagggcctgcccgtgccctgcgtgaagagcatcgtgagacaggtgctgcacggcctggactacctgcacaccaagtgcaagatcatccacaccgacatcaagcccgagaacatcctgctgtgcgtgggcgacgcctacatcagaagactggccgccgaggccaccgagtggcagcaggccggcgcccccccccccagcagaagcatcgtgagcaccgccccccaggaggtgctgaccggcaagctgagcaagaacaagagaaagaagatgagaagaaagagaaagcagcagaagagactgctggaggagagactgagagacctgcagagactggaggccatggaggccgccacccaggccgaggacagcggcctgagactggacggcggcagcggcagcaccagcagcagcggctgccaccccggcggcgccagagccggccccagccccgccagcagcagccccgcccccggcggcggcagaagcctgagcgccggcagccagaccagcggcttcagcggcagcctgttcagccccgccagctgcagcatcctgagcggcagcagcaaccagagagagaccggcggcctgctgagccccagcacccccttcggcgccagcaacctgctggtgaaccccctggagccccagaacgccgacaagatcaagatcaagatcgccgacctgggcaacgcctgctgggtgcacaagcacttcaccgaggacatccagaccagacagtacagagccgtggaggtgctgatcggcgccgagtacggcccccccgccgacatctggagcaccgcctgcatggccttcgagctggccaccggcgactacctgttcgagccccacagcggcgaggactacagcagagacgaggaccacatcgcccacatcgtggagctgctgggcgacatcccccccgccttcgccctgagcggcagatacagcagagagttcttcaacagaagaggcgagctgagacacatccacaacctgaagcactggggcctgtacgaggtgctgatggagaagtacgagtggcccctggagcaggccacccagttcagcgccttcctgctgcccatgatggagtacatccccgagaagagagccagcgccgccgactgcctgcagcacccctggctgaacccctag

SEQ ID NO: 10756 - DNA, 150 bp, Artificial Sequence
  Description of Artificial Sequence: Synthetic coding sequence
atggccggccccagagtggaggtggacggcagcatcatggagggcggcggccagatcctgagagtgagcaccgccctgagctgcctgctgggcctgcccctgagagtgcagaagatcagagccggcagaagcacccccggcctgagatag

SEQ ID NO: 10757 - DNA, 1101 bp, Artificial Sequence
  Description of Artificial Sequence: Synthetic coding sequence
atggccggccccagagtggaggtggacggcagcatcatggagggcggcggccagatcctgagagtgagcaccgccctgagctgcctgctgggcctgcccctgagagtgcagaagatcagagccggcagaagcacccccggcctgagaccccagcacctgagcggcctggagatgatcagagacctgtgcgacggccagctggagggcgccgagatcggcagcaccgagatcaccttcacccccgagaagatcaagggcggcatccacaccgccgacaccaagaccgccggcagcgtgtgcctgctgatgcaggtgagcatgccctgcgtgctgttcgccgccagccccagcgagctgcacctgaagggcggcaccaacgccgagatggccccccagatcgactacaccgtgatggtgttcaagcccatcgtggagaagttcggcttcatcttcaactgcgacatcaagaccagaggctactaccccaagggcggcggcgaggtgatcgtgagaatgagccccgtgaagcagctgaaccccatcaacctgaccgagagaggctgcgtgaccaagatctacggcagagccttcgtggccggcgtgctgcccttcaaggtggccaaggacatggccgccgccgccgtgagatgcatcagaaaggagatcagagacctgtacgtgaacatccagcccgtgcaggagcccaaggaccaggccttcggcaacggcaacggcatcatcatcatcgccgagaccagcaccggctgcctgttcgccggcagcagcctgggcaagagaggcgtgaacgccgacaaggtgggcatcgaggccgccgagatgctgctggccaacctgagacacggcggcaccgtggacgagtacctgcaggaccagctgatcgtgttcatggccctggccaacggcgtgagcagaatcaagaccggccccgtgaccctgcacacccagaccgccatccacttcgccgagcagatcgccaaggccaagttcatcgtgaagaagagcgaggacgaggaggacgccgccaaggacacctacatcatcgagtgccagggcatcggcatgaccaaccccaacctgtag

SEQ ID NO: 10758 - DNA, 1155 bp, Artificial Sequence; identical to SEQ ID NO: 10264
  Description of Artificial Sequence: Synthetic coding sequence

SEQ ID NO: 10759 - DNA, 804 bp, Artificial Sequence
  Description of Artificial Sequence: Synthetic coding sequence
atggccgagcccgtgcaggaggagctgagcgtgctggccgccatcttctgcagaccccacgagtgggaggtgctgagcagaagcgagaccgacggcaccgtgttcagaatccacaccaaggccgagggcttcatggacgtggacatccccctggagctggtgttccacctgcccgtgaactaccccagctgcctgcccggcatcagcatcaacagcgagcagctgaccagagcccagtgcgtgaccgtgaaggagaacctgctggagcaggccgagagcctgctgagcgagcccatggtgcacgagctggtgctgtggatccagcagaacctgagacacatcctgagccagcccgagaccggcagcggcagcgagaagtgcaccttcagcaccagcaccaccatggacgacggcctgtggatcaccctgctgcacctggaccacatgagagccaagaccaagtacgtgaagatcgtggagaagtgggccagcgacctgagactgaccggcagactgatgttcatgggcaagatcatcctgatcctgctgcagggcgacagaaacaacctgaaggagtacctgatcctgcagaagaccagcaaggtggacgtggacagcagcggcaagaagtgcaaggagaagatgatcagcgtgctgttcgagaccaaggtgcagaccgagcacaagagattcctggccttcgaggtgaaggagtacagcgccctggacgagctgcagaaggagttcgagaccgccggcctgaagaagctgttcagcgagttcgtgctggccctggtgaagtag

SEQ ID NO: 10760 - DNA, 2010 bp, Artificial Sequence
  Description of Artificial Sequence: Synthetic coding sequence
atggccatcgtgcagaccctgcccgtgcccctggagcccgcccccgaggccgccaccgccccccaggcccccgtgatgggcagcgtgagcagcctgatcagcggcagaccctgccccggcggccccgccccccccagacaccacggcccccccggccccaccttcttcagacagcaggacggcctgctgagaggcggctacgaggcccaggagcccctgtgccccgccgtgccccccagaaaggccgtgcccgtgaccagcttcacctacatcaacgaggacttcagaaccgagagcccccccagccccagcagcgacgtggaggacgccagagagcagagagcccacaacgcccacctgagaggccccccccccaagctgatccccgtgagcggcaagctggagaagaacatggagaagatcctgatcagacccaccgccttcaagcccgtgctgcccaagcccagaggcgcccccagcctgcccagcttcatgggccccagagccaccggcctgagcggcagccagggcagcctgacccagctgttcggcggccccgccagcagcagcagcagcagcagcagcagcagcgccgccgacaagcccctggccttcagcggctgggccagcggctgccccagcggcaccctgagcgacagcggcagaaacagcctgagcagcctgcccacctacagcaccggcggcgccgagcccaccaccagcagccccggcggccacctgcccagccacggcagcggcagaggcgccctgcccggccccgccagaggcgtgcccaccggccccagccacagcgacagcggcagaagcagcagcagcaagagcaccggcagcctgggcggcagagtggccggcggcctgctgggcagcggcaccagagccagccccgacagcagcagctgcggcgagagaagcccccccccccccccccccccccccagcgacgaggccctgctgcactgcgtgctggagggcaagctgagagacagagaggccgagctgcagcagctgagagacagcctggacgagaacgaggccaccatgtgccaggcctacgaggagagacagagacactggcagagagagagagaggccctgagagaggactgcgccgcccaggcccagagagcccagagagcccagcagctgctgcagctgcaggtgttccagctgcagcaggagaagagacagctgcaggacgacttcgcccagctgctgcaggagagagagcagctggagagaagatgcgccaccctggagagagagcagagagagctgggccccagactggaggagaccaagtgggaggtgtgccagaagagcggcgagatcagcctgctgaagcagcagctgaaggagagccaggccgagctggtgcagaagggcagcgagctggtggccctgagagtggccctgagagaggccagagccaccctgagagtgagcgagggcagagccagaggcctgcaggaggccgccagagccagagagctggagctggaggcctgcagccaggagctgcagagacacagacaggaggccgagcagctgagagagaaggccggccagctggacgccgaggccgccggcctgagagagccccccgtgccccccgccaccgccgaccccttcctgctggccgagagcgacgaggccaaggtgcagagagccgccgccggcgtgggcggcagcctgagagcccaggtggagagactgagagtggagctgcagagagagagaagaagaggcgaggagcagagagacagcttcgagggcgagagactggcctggcaggccgagaaggagcaggtgatcagataccagaagcagctgcagcacaactacatccagatgtacagaagaaacagacagctggagcaggagctgcagcagctgagcctggagctggaggccagagagctggccgacctgggcctggccgagcaggccccctgcatctgcctggaggagatcaccgccaccgagatctag

SEQ ID NO: 10761 - DNA, 2010 bp, Artificial Sequence; identical to SEQ ID NO: 10760
  Description of Artificial Sequence: Synthetic coding sequence

SEQ ID NO: 10762 - DNA, 1059 bp, Artificial Sequence
  Description of Artificial Sequence: Synthetic coding sequence
atgaagctgaaggagctggagagacccgccgtgcaggcctggagccccgccagccagtaccccctgtacctggccaccggcaccagcgcccagcagctggacagcagcttcagcaccaacggcaccctggagatcttcgaggtggacttcagagaccccagcctggacctgaagcacagaggcgtgctgagcgccctgagcagattccacaagctggtgtggggcagcttcggcagcggcctgctggagagcagcggcgtgatcgtgggcggcggcgacaacggcatgctgatcctgtacaacgtgacccacatcctgagcagcggcaaggagcccgtgatcgcccagaagcagaagcacaccggcgccgtgagagccctggacctgaaccccttccagggcaacctgctggccagcggcgccagcgacagcgagatcttcatctgggacctgaacaacctgaacgtgcccatgaccctgggcagcaagagccagtaccacgagcagccccccgaggacatcaaggccctgagctggaacagacaggcccagcacatcctgagcagcgcccaccccagcggcaaggccgtggtgtgggacctgagaaagaacgagcccatcatcaaggtgagcgaccacagcaacagaatgcactgcagcggcctggcctggcaccccgacatcgccacccagctggtgctgtgcagcgaggacgacagactgcccgtgatccagctgtgggacctgagattcgccagcagccccctgaaggtgctggagagccacagcagaggcatcctgagcgtgagctggagccaggccgacgccgagctgctgctgaccagcgccaaggacagccagatcctgtgcagaaacctgggcagcagcgaggtggtgtacaagctgcccacccagagcagctggtgcttcgacgtgcagtggtgccccagagaccccagcgtgttcagcgccgccagcttcaacggctggatcagcctgtacagcgtgatgggcagaagctgggaggtgcagcacatgagacaggccgacaaggtgtag

SEQ ID NO: 10763 - DNA, 3540 bp, Artificial Sequence
  Description of Artificial Sequence: Synthetic coding sequence
atgaagctgaaggagctggagagacccgccgtgcaggcctggagccccgccagccagtaccccctgtacctggccaccggcaccagcgcccagcagctggacagcagcttcagcaccaacggcaccctggagatcttcgaggtggacttcagagaccccagcctggacctgaagcacagaggcgtgctgagcgccctgagcagattccacaagctggtgtggggcagcttcggcagcggcctgctggagagcagcggcgtgatcgtgggcggcggcgacaacggcatgctgatcctgtacaacgtgacccacatcctgagcagcggcaaggagcccgtgatcgcccagaagcagaagcacaccggcgccgtgagagccctggacctgaaccccttccagggcaacctgctggccagcggcgccagcgacagcgagatcttcatctgggacctgaacaacctgaacgtgcccatgaccctgggcagcaagagccagcagccccccgaggacatcaaggccctgagctggaacagacaggcccagcacatcctgagcagcgcccaccccagcggcaaggccgtggtgtgggacctgagaaagaacgagcccatcatcaaggtgagcgaccacagcaacagaatgcactgcagcggcctggcctggcaccccgacatcgccacccagctggtgctgtgcagcgaggacgacagactgcccgtgatccagctgtgggacctgagattcgccagcagccccctgaaggtgctggagagccacagcagaggcatcctgagcgtgagctggagccaggccgacgccgagctgctgctgaccagcgccaaggacagccagatcctgtgcagaaacctgggcagcagcgaggtggtgtacaagctgcccacccagagcagctggtgcttcgacgtgcagtggtgccccagagaccccagcgtgttcagcgccgccagcttcaacggctggatcagcctgtacagcgtgatgggcagaagctgggaggtgcagcacatgagacaggccgacaagatcagcagcagcttcagcaagggccagcccctgccccccctgcaggtgcccgagcaggtggcccaggcccccctgatcccccccctgaagaagccccccaagtggatcagaagacccaccggcgtgagcttcgccttcggcggcaagctggtgaccttcggcctgcccagcacccccgcccacctggtgccccagccctgccccagactggtgttcatcagccaggtgaccaccgagagcgagttcctgatgagaagcgccgagctgcaggaggccctgggcagcggcaacctgctgaactactgccagaacaagagccagcaggccctgctgcagagcgagaagatgctgtggcagttcctgaaggtgaccctggagcaggacagcagaatgaagttcctgaagctgctgggctacagcaaggacgagctgcagaagaaggtggccacctggctgaagagcgacgtgggcctgggcgagagcccccagcccaagggcaacgacctgaacagcgacagacagcaggccttctgcagccaggccagcaagcacaccaccaaggaggccagcgccagcagcgccttcttcgacgagctggtgccccagaacatgaccccctgggagatccccatcaccaaggacatcgacggcctgctgagccaggccctgctgctgggcgagctgggccccgccgtggagctgtgcctgaaggaggagagattcgccgacgccatcatcctggcccaggccggcggcaccgacctgctgaagcagacccaggagagatacctggccaagaagaagaccaagatcagcagcctgctggcctgcgtggtgcagaagaactggaaggacgtggtgtgcacctgcagcctgaagaactggagagaggccctggccctgctgctgacctacagcggcaccgagaagttccccgagctgtgcgacatgctgggcaccagaatggagcaggagggcagcagagccctgaccagcgaggccagactgtgctacgtgtgcagcggcagcgtggagagactggtggagtgctgggccaagtgccaccaggccctgagccccatggccctgcaggacctgatggagaaggtgatggtgctgaacagaagcctggagcagctgagaggcccccacggcgtgagccccggccccgccaccacctacagagtgacccagtacgccaacctgctggccgcccagggcagcctggccaccgccatgagcttcctgcccagagactgcgcccagccccccgtgcagcagctgagagacagactgttccacgcccagggcagcgccgtgctgggccagcagagcccccccttccccttccccagaatcgtggtgggcgccaccctgcacagcaaggagaccagcagctacagactgggcagccagcccagccaccaggtgcccacccccagccccagacccagagtgttcaccccccagagcagccccgccatgcccctggcccccagccaccccagcccctaccagggccccagaacccagaacatcagcgactacagagcccccggcccccaggccatccagcccctgcccctgagccccggcgtgagacccgccagcagccagccccagctgctgggcggccagagagtgcaggtgcccaaccccgtgggcttccccggcacctggcccctgcccggcagccccctgcccatggcctgccccggcatcatgagacccggcagcaccagcctgcccgagacccccagactgttccccctgctgcccctgagacccctgggccccggcagaatggtgagccacacccccgccccccccgccagcttccccgtgccctacctgcccggcgaccccggcgccccctgcagcagcgtgctgcccaccaccggcatcctgaccccccaccccggcccccaggacagctggaaggaggcccccgcccccagaggcaacctgcagagaaacaagctgcccgagaccttcatgccccccgcccccatcaccgcccccgtgatgagcctgacccccgagctgcagggcatcctgcccagccagccccccgtgagcagcgtgagccacgccccccccggcgtgcccggcgagctgagcctgcagctgcagcacctgccccccgagaagatggagagaaaggagctgccccccgagcaccagagcctgaagagcagcttcgaggccctgctgcagagatgcagcctgagcgccaccgacctgaagaccaagagaaagctggaggaggccgcccagagactggagtacctgtacgagaagctgtgcgagggcaccctgagcccccacgtggtggccggcctgcacgaggtggccagatgcgtggacgccggcagcttcgagcagggcctggccgtgcacgcccaggtggccggctgcagcagcttcagcgaggtgagcagcttcatgcccatcctgaaggccgtgctgatcatcgcccacaagctgctggtgtag

SEQ ID NO: 10764 - DNA, 1635 bp, Artificial Sequence; identical to SEQ ID NO: 9499
  Description of Artificial Sequence: Synthetic coding sequence

SEQ ID NO: 10765 - DNA, 1689 bp, Artificial Sequence; identical to SEQ ID NO: 10374
  Description of Artificial Sequence: Synthetic coding sequence

SEQ ID NO: 10766 - DNA, 1689 bp, Artificial Sequence; identical to SEQ ID NO: 10374
  Description of Artificial Sequence: Synthetic coding sequence

SEQ ID NO: 10767 - DNA, 1272 bp, Artificial Sequence
  Description of Artificial Sequence: Synthetic coding sequence
atggaggacaagagaagcctgagcatggccagatgcgaggagagaaacagcagaggccaggaccacggcctggagagagtgcccttccccccccagctgcagagcgagacctacctgcaccccgccgaccccagccccgcctgggacgaccccggcagcaccggcagccccaacctgagactgctgaccgaggagatcgccttccagcccctggccgaggaggccagcttcagaagaccccaccccgacggcgacgtgcccccccagggcgaggacaacctgctgagcctgcccttcccccagaagctgtggagactggtgagcagcaaccagttcagcagcatctggtgggacgacagcggcgcctgcagagtgatcaaccagaagctgttcgagaaggagatcctgaagagagacgtggcccacaaggtgttcgccaccaccagcatcaagagcttcttcagacagctgaacctgtacggcttcagaaagagaagacagtgcaccttcagaaccttcaccagaatcttcagcgccaagagactggtgagcatcctgaacaagctggagttctactgccacccctacttccagagagacagcccccacctgctggtgagaatgaagagaagagtgggcgtgaagagcgcccccagacaccaggaggaggacaagcccgaggccgccggcagctgcctggcccccgccgacaccgagcagcaggaccacaccagccccaacgagaacgaccaggtgaccccccagcacagagagcccgccggccccaacacccagatcagaagcggcagcgccccccccgccacccccgtgatggtgcccgacagcgccgtggccagcgacaacagccccgtgacccagcccgccggcgagtggagcgagggcagccaggcccacgtgacccccgtggccgccgtgcccggccccgccgccctgcccttcctgtacgtgcccggcagccccacccagatgaacagctacggccccgtggtggccctgcccaccgccagcagaagcaccctggccatggacaccaccggcctgcccgcccccggcatgctgcccttctgccacctgtgggtgcccgtgaccctggtggccgccggcgccgcccagcccgccgccagcatggtgatgttcccccacctgcccgccctgcaccaccactgcccccacagccacagaaccagccagtacatgcccgccagcgacggcccccaggcctaccccgactacgccgaccagagcacctag

SEQ ID NO: 10768 - DNA, 675 bp, Artificial Sequence
  Description of Artificial Sequence: Synthetic coding sequence
atgcccaccctgttcaagggcgtgtggggcgtggtggagcacagcagagccctgggcagattctgccccgcctgcctgcccagcggcccccacctgcacacccagcccgccctgggcaccgccgagatgaccctgctgagcagccagagcagcagcctggtggcccccagcggcagcgtgagcgccgagaaccccgagcagagaatgctggagaagagagccaaggtgatcgaggagctgctgcagaccgagagagactacatcagagacctggagatgtgcatcgagagaatcatggtgcccatgcagcaggcccaggtgcccaacatcgacttcgagggcctgttcggcaacatgcagatggtgatcaaggtgagcaagcagctgctggccgccctggagatcagcgacgccgtgggccccgtgttcctgggccacagagacgagctggagggcacctacaagatctactgccagaaccacgacgaggccatcgccctgctggagatctacgagaaggacgagaagatccagaagcacctgcaggacagcctggccgacctgaacagcctggtgctgaagaagggctgcaccaactacatcaacctgggcagcttcctgatcaagcccgtgcagagagtgatgagataccccctgctgctgatggagctgtag

SEQ ID NO: 10769 - DNA, 1878 bp, Artificial Sequence
  Description of Artificial Sequence: Synthetic coding sequence
atgagactgcccgagagacacggcggcccccagggcagcctgtgcctgatggacccctgctgccccctgagcctggccctgcaggacctggtggagagagactgcaacggcgacacccccaacctgagcttctacagaaacgagatcagattcctgcccaacggctgcttcatcgaggacatcctgcagaactggaccgacaactacgacctgctggaggacaaccacagctacatccagtggctgttccccctgagagagcccggcgtgaactggcacgccaagcccctgaccctgagagaggtggaggtgttcaagagcagccaggagatccaggagagactggtgagagcctacgagctgatgctgggcttctacggcatcagactggaggacagaggcaccggcaccgtgggcagagcccagaactaccagaagagattccagaacctgaactggagaagccacaacaacctgagaatcaccagaatcctgaagagcctgggcgagctgggcctggagcacttccaggcccccctggtgagattcttcctggaggagaccctggtgagaagagagctgcccggcgtgagacagagcgccctggactacttcatgttcgccgtgagatgcagacaccagagaagacagctggtgcacttcgcctgggagcacttcagacccagatgcaagttcgtgtggggcccccaggacaagctgagaagattcaagcccagcagcctgccccaccccctggagggcagcagaaaggtggaggaggagggcagccccggcgaccccgaccacgaggccagcacccagggcagaacctgcggccccgagcacagcaagggcggcggcagagtggacgagggcccccagcccagaagcgtggagccccaggacgccggccccctggagagaagccagggcgacgaggccggcggccacggcgaggacagacccgagcccctgagccccaaggagagcaagaagagaaagctggagctgagcagaagagagcagccccccaccgagcccggcccccagagcgccagcgaggtggagaagatcgccctgaacctggagggctgcgccctgagccagggcagcctgagaaccggcacccaggaggtgggcggccaggaccccggcgaggccgtgcagccctgcagacagcccctgggcgccagagtggccgacaaggtgagaaagagaagaaaggtggacgagggcgccggcgacagcgccgccgtggccagcggcggcgcccagaccctggccctggccggcagccccgcccccagcggccaccccaaggccggccacagcgagaacggcgtggaggaggacaccgagggcagaaccggccccaaggagggcacccccggcagccccagcgagacccccggccccagccccgccggccccgccggcgacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccaaggccggcgaggccgccgagctgcaggacgccgaggtggagagcagcgccaagagcggcaagccctag

SEQ ID NO: 10770 - DNA, 1386 bp, Artificial Sequence
  Description of Artificial Sequence: Synthetic coding sequence
atggacgaccccgactgcgacagcacctgggaggaggacgaggaggacgccgaggacgccgaggacgaggactgcgaggacggcgaggccgccggcgccagagacgccgacgccggcgacgaggacgaggagagcgaggagcccagagccgccagacccagcagcttccagagcagaatgaccggcagcagaaactggagagccaccagagacatgtgcagatacagacacaactaccccgacctggtggagagagactgcaacggcgacacccccaacctgagcttctacagaaacgagatcagattcctgcccaacggctgcttcatcgaggacatcctgcagaactggaccgacaactacgacctgctggaggacaaccacagctacatccagtggctgttccccctgagagagcccggcgtgaactggcacgccaagcccctgaccctgagagaggtggaggtgttcaagagcagccaggagatccaggagagactggtgagagcctacgagctgatgctgggcttctacggcatcagactggaggacagaggcaccggcaccgtgggcagagcccagaactaccagaagagattccagaacctgaactggagaagccacaacaacctgagaatcaccagaatcctgaagagcctgggcgagctgggcctggagcacttccaggcccccctggtgagattcttcctggaggagaccctggtgagaagagagctgcccggcgtgagacagagcgccctggactacttcatgttcgccgtgagatgcagacaccagagaagacagctggtgcacttcgcctgggagcacttcagacccagatgcaagttcgtgtggggcccccaggacaagctgagaagattcaagcccagcagcctgccccaccccctggagggcagcagaaaggtggaggaggagggcagccccggcgaccccgaccacgaggccagcacccagggcagaacctgcggccccgagcacagcaagggcggcggcagagtggacgagggcccccagcccagaagcgtggagccccaggacgccggccccctggagagaagccagggcgacgaggccggcggccacggcgaggacagacccgagcccctgagccccaaggagagcaagaagagaaagctggagctgagcagaagagagcagccccccaccgagcccggcccccagagcgccagcgaggtggagaagatcgccctgaacctggagggctgcgccctgagccagggcagcctgagaaccggcacccaggaggtgggcggccaggaccccggcgagagcagctgcccctgctgcagaggctggggcctgagaagctgctgcggcctgcccagcggcagcgccagctag

SEQ ID NO: 10771 - DNA, 1539 bp, Artificial Sequence
  Description of Artificial Sequence: Synthetic coding sequence
atgcccagccccagcagaagcggcagaagcagatgcctgaaggcccccagaagaagcagaagcggcctgagcggccccaccagcagctgctgggccagcaccatcagactggaggacagaggcaccggcaccgtgggcagagcccagaactaccagaagagattccagaacctgaactggagaagccacaacaacctgagaatcaccagaatcctgaagagcctgggcgagctgggcctggagcacttccaggcccccctggtgagattcttcctggaggagaccctggtgagaagagagctgcccggcgtgagacagagcgccctggactacttcatgttcgccgtgagatgcagacaccagagaagacagctggtgcacttcgcctgggagcacttcagacccagatgcaagttcgtgtggggcccccaggacaagctgagaagattcaagcccagcagcctgccccaccccctggagggcagcagaaaggtggaggaggagggcagccccggcgaccccgaccacgaggccagcacccagggcagaacctgcggccccgagcacagcaagggcggcggcagagtggacgagggcccccagcccagaagcgtggagccccaggacgccggccccctggagagaagccagggcgacgaggccggcggccacggcgaggacagacccgagcccctgagccccaaggagagcaagaagagaaagctggagctgagcagaagagagcagccccccaccgagcccggcccccagagcgccagcgaggtggagaagatcgccctgaacctggagggctgcgccctgagccagggcagcctgagaaccggcacccaggaggtgggcggccaggaccccggcgaggccgtgcagccctgcagacagcccctgggcgccagagtggccgacaaggtgagaaagagaagaaaggtggacgagggcgccggcgacagcgccgccgtggccagcggcggcgcccagaccctggccctggccggcagccccgcccccagcggccaccccaaggccggccacagcgagaacggcgtggaggaggacaccgagggcagaaccggccccaaggagggcacccccggcagccccagcgagacccccggccccagccccgccggccccgccggcgacgagcccgccgagagccccagcgagacccccggccccagacccgccggccccgccggcgacgagcccgccgagagccccagcgagacccccggccccagccccgccggccccaccagagacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccaaggccggcgaggccgccgagctgcaggacgccgaggtggagagcagcgccaagagcggcaagccctag

SEQ ID NO: 10772 - DNA, 312 bp, Artificial Sequence
  Description of Artificial Sequence: Synthetic coding sequence
atgggccagcagagcagcgtgagaagactgaagagaagcgtgccctgcgagagcaacgaggccaacgaggccaacgaggccaacaagaccatgcccgagacccccaccggcgacagcgacccccagcccgcccccaagaagatgaagaccagcgagagcagcaccatcctggtggtgagatacagaagaaacgtgaagagaaccagccccgaggagctggtgaacgaccacgccagagagaacagaatcaaccccgaccagatggaggaggaggagttcatcgagatcaccaccgagagacccaagaagtag

SEQ ID NO: 10773 - DNA, 1776 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaaggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcaaggcccagcaccaggaggtgtgcctgaaggaggtgcagaacagcctggagaagagcgagaaccagaacgagagcatcaagaactacctgcagttcctgaagaccagctacgtgaccatgttcgagtag

SEQ ID NO: 10774 - DNA, 1935 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaagatgagaggccagatggagagccacctgaaggagctggagagagtgtgcgacagcctgaccgccgccgagagaagactgcacgagtgccaggagagcctgcagtgctgcaagggcaagtgcgccgaccaggagcacaccatcagagagctgcagggccaggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcaaggcccagcaccaggaggtgtgcctgaaggaggtgcagaacagcctggagaagagcgagaaccagaacgagagcatcaagaactacctgcagttcctgaagaccagctacgtgaccatgttcgagtag

SEQ ID NO: 10775 - DNA, 2526 bp, Artificial Sequence
  Description of Artificial Sequence: Synthetic coding sequence
atgatggccgacggcgccgccgccggcgccggcggcagccccagcctgagagagctgagagccagaatggtggccgccgccaacgagatcgccaaggagagaagaaagcaggacgtggtgaacagagtggccacccacagcagcaacatcagaagcaccttcaagcccgtgatcgacggcagcatgctgaagaacgacatcaagcagagactggccagagagagaagagaggagaagagaagacagcaggacgccaacaaggagacccagctgctggagaaggagagaaagaccaagctgcagtacgagaagcagatggaggagagacagagaaagctgaaggagagaaaggagaaggaggagcagagaagaatcgccgccgaggagaagagacaccagaaggacgaggcccagaaggagaagttcaccgccatcctgtacagaaccctggagagaagaagactggccgacgactaccagcagaagagatggagctggggcggcagcgccatggccaacagcgagagcaagaccggcaagaccgacaaggagagaagcagcagcctgaacagaagagacagcaacctgcacagcagcaccgacaaggagcaggccgagagaaagcccagagtgaccggcgtgaccaactacgtgatgcagtacgtgaccgtgcccctgagaaagtgcaccagcgacgagctgagagccgtgatgttccccatgagcaccatgaagatccccccccagaccaaggtggaggagagccccctggagaaggtggagaccccccccaaggccagcgtggacgcccccccccaggtgaacgtggaggtgttctgcaacaccagcatggaggccagccccaaggccggcgtgggcatggcccccgaggtgagcaccgacagcttccccgtggtgagcgtggacgtgagccccgtggtgagcacctacgacagcgagatgagcatggacgccagccccgagctgagcatcgaggccctgcccaaggtggacctggagaccgtgcccaaggtgagcatcgtggccagccccgaggccagcctggaggccccccccgaggtgagcctggaggccctgcccgaggtgagcgtggaggccgcccccgagggcagcctggaggccccccccaagggcagcgccgaggtggcccccaaggagagcgtgaagggcagccccaaggagagcatggaggccagccccgaggccatggtgaaggccagccccaagaccagcctggaggccagcatggaggccagccccaaggccaaggccagagacgcccccaagaagagcgagatggacaagcaggccctgatccccatcgccaagaagagactgagcagctacaccgagtgctacaagtggagcagcagccccgagaacgcctgcggcctgcccagccccatcagcaccaacagacagatccagaagaactgcccccccagccccctgcccctgatcagcaagcagagcccccagaccagcttcccctacaagatcatgcccatccagcacaccctgagcgtgcagagcgccagcagcaccgtgaagaagaagaaggagaccgtgagcaagaccaccaacagatgcgaggccctgagccagagacacatgatctacgaggagagcggcaacaagagcaccgccggcatcatgaacgccgaggccgccaccaagatcctgaccgagctgagaagactggccagagagcagagagagaaggaggaggaggagagacagagagaggagatgcagcagagagtgatcaagaagagcaaggacatggccaaggaggccgtgggcggccaggccgaggaccacctgaagctgaaggacggccagcagcagaacgagaccaagaagaagaagggctggctggaccaggaggaccaggaggcccccctgcagaagggcgacgccaagatcaaggcccaggaggaggccgacaagagaaagaaggagcacgagagaatcatgctgcagaacctgcaggagagactggagagaaagaagagaatcgaggagatcatgaagagaaccagaaagaccgacgtgaacgccagcaaggtgaccgagaccagcagccacgacatctacgaggaggccgaggccgacaacgaggagagcgacaaggacagcctgaacgagatgttccccagcgccatcctgaacggcaccggcagccccaccaagttcaagatgcccttcaacaacgccaagaagatgacccacaagctggtgttcctggaggacggcaccagccaggtgagaaaggagcccaagacctacttcaacggcgacctgaagaacttcagacagaagagcatgaaggacaccagcatccaggaggtggtgagcagacccagcagcaagagaatgaccagccacaccaccaagaccagaaaggccgacgagaccaacaccaccagcagaagcagcgcccagaccaagagcgagggcttccacgacatcctgcccaagagcagcgacaccttcagacagtag

SEQ ID NO: 10776 - DNA, 2577 bp, Artificial Sequence
  Description of Artificial Sequence: Synthetic coding sequence
atgaccagccccagagtggccgccgccaacgagatcgccaaggagagaagaaagcaggacgtggtgaacagagtggccacccacagcagcaacatcagaagcaccttcaagcccgtgatcgacggcagcatgctgaagaacgacatcaagcagagactggccagagagagaagagaggagaagagaagacagcaggacgccaacaaggagacccagctgctggagaaggagagaaagaccaagctgcagtacgagaagcagatggaggagagacagagaaagctgaaggagagaaaggagaaggaggagcagagaagaatcgccgccgaggagaagagacaccagaaggacgaggcccagaaggagaagttcaccgccatcctgtacagaaccctggagagaagaagactggccgacgactaccagcagaagagatggagctggggcggcagcgccatggccaacagcgagagcaagaccgccaacaagagaagcgccagcaccgagaagctggagcagggcaccagcgccctgatcagacagatgcccctgagcagcgccggcctgcagaacagcgtggccaagagaaagaccgacaaggagagaagcagcagcctgaacagaagagacagcaacctgcacagcagcaccgacaaggagcaggccgagagaaagcccagagtgaccggcgtgaccaactacgtgatgcagtacgtgaccgtgcccctgagaaagtgcaccagcgacgagctgagagccgtgatgttccccatgagcaccatgaagatccccccccagaccaaggtggaggagagccccctggagaaggtggagaccccccccaaggccagcgtggacgcccccccccaggtgaacgtggaggtgttctgcaacaccagcatggaggccagccccaaggccggcgtgggcatggcccccgaggtgagcaccgacagcttccccgtggtgagcgtggacgtgagccccgtggtgagcacctacgacagcgagatgagcatggacgccagccccgagctgagcatcgaggccctgcccaaggtggacctggagaccgtgcccaaggtgagcatcgtggccagccccgaggccagcctggaggccccccccgaggtgagcctggaggccctgcccgaggtgagcgtggaggccgcccccgagggcagcctggaggccccccccaagggcagcgccgaggtggcccccaaggagagcgtgaagggcagccccaaggagagcatggaggccagccccgaggccatggtgaaggccagccccaagaccagcctggaggccagcatggaggccagccccaaggccaaggccagagacgcccccaagaagagcgagatggacaagcaggccctgatccccatcgccaagaagagactgagcagctacaccgagtgctacaagtggagcagcagccccgagaacgcctgcggcctgcccagccccatcagcaccaacagacagatccagaagaactgcccccccagccccctgcccctgatcagcaagcagagcccccagaccagcttcccctacaagatcatgcccatccagcacaccctgagcgtgcagagcgccagcagcaccgtgaagaagaagaaggagaccgtgagcaagaccaccaacagatgcgaggccctgagccagagacacatgatctacgaggagagcggcaacaagagcaccgccggcatcatgaacgccgaggccgccaccaagatcctgaccgagctgagaagactggccagagagcagagagagaaggaggaggaggagagacagagagaggagatgcagcagagagtgatcaagaagagcaaggacatggccaaggaggccgtgggcggccaggccgaggaccacctgaagctgaaggacggccagcagcagaacgagaccaagaagaagaagggctggctggaccaggaggaccaggaggcccccctgcagaagggcgacgccaagatcaaggcccaggaggaggccgacaagagaaagaaggagcacgagagaatcatgctgcagaacctgcaggagagactggagagaaagaagagaatcgaggagatcatgaagagaaccagaaagaccgacgtgaacgccagcaaggtgaccgagaccagcagccacgacatctacgaggaggccgaggccgacaacgaggagagcgacaaggacagcctgaacgagatgttccccagcgccatcctgaacggcaccggcagccccaccaagttcaagatgcccttcaacaacgccaagaagatgacccacaagctggtgttcctggaggacggcaccagccaggtgagaaaggagcccaagacctacttcaacggcgacctgaagaacttcagacagaagagcatgaaggacaccagcatccaggaggtggtgagcagacccagcagcaagagaatgaccagccacaccaccaagaccagaaaggccgacgagaccaacaccaccagcagaagcagcgcccagaccaagagcgagggcttccacgacatcctgcccaagagcagcgacaccttcagacagtag

SEQ ID NO: 10777 - DNA, 948 bp, Artificial Sequence
  Description of Artificial Sequence: Synthetic coding sequence
atgcccctgaagctgagaggcaagaagaaggccaagagcaaggagaccgccggcctggtggagggcgagcccaccggcgccggcggcggcagcctgagcgccagcagagcccccgccagaagactggtgttccacgcccagctggcccacggcagcgccaccggcagagtggagggcttcagcagcatccaggagctgtacgcccagatcgccggcgccttcgagatcagccccagcgagatcctgtactgcaccctgaacacccccaagatcgacatggagagactgctgggcggccagctgggcctggaggacttcatcttcgcccacgtgaagggcatcgagaaggaggtgaacgtgtacaagagcgaggacagcctgggcctgaccatcaccgacaacggcgtgggctacgccttcatcaagagaatcaaggacggcggcgtgatcgacagcgtgaagaccatctgcgtgggcgaccacatcgagagcatcaacggcgagaacatcgtgggctggagacactacgacgtggccaagaagctgaaggagctgaagaaggaggagctgttcaccatgaagctgatcgagcccaagaaggccttcgagatcgagctgagaagcaaggccggcaagagcagcggcgagaagatcggctgcggcagagccaccctgagactgagaagcaagggccccgccaccgtggaggagatgcccagcgagaccaaggccaaggccatcgagaagatcgacgacgtgctggagctgtacatgggcatcagagacatcgacctggccaccaccatgttcgaggccggcaaggacaaggtgaaccccgacgagttcgccgtggccctggacgagaccctgggcgacttcgccttccccgacgagttcgtgttcgacgtgtggggcgtgatcggcgacgccaagagaagaggcctgtag

SEQ ID NO: 10778 - DNA, 2487 bp, Artificial Sequence
  Description of Artificial Sequence: Synthetic coding sequence
atgaccggcagcaacagccacatcaccatcctgaccctgaaggtgctgccccacttcgagagcctgggcaagcaggagaagatccccaacaagatgagcgccttcagaaaccactgcccccacctggacagcgtgggcgagatcaccaaggaggacctgatccagaagagcctgggcacctgccaggactgcaaggtgcagggccccaacctgtgggcctgcctggagaacagatgcagctacgtgggctgcggcgagagccaggtggaccacagcaccatccacagccaggagaccaagcactacctgaccgtgaacctgaccaccctgagagtgtggtgctacgcctgcagcaaggaggtgttcctggacagaaagctgggcacccagcccagcctgccccacgtgagacagccccaccagatccaggagaacagcgtgcaggacttcaagatccccagcaacaccaccctgaagacccccctggtggccgtgttcgacgacctggacatcgaggccgacgaggaggacgagctgagagccagaggcctgaccggcctgaagaacatcggcaacacctgctacatgaacgccgccctgcaggccctgagcaactgcccccccctgacccagttcttcctggactgcggcggcctggccagaaccgacaagaagcccgccatctgcaagagctacctgaagctgatgaccgagctgtggcacaagagcagacccggcagcgtggtgcccaccaccctgttccagggcatcaagaccgtgaaccccaccttcagaggctacagccagcaggacgcccaggagttcctgagatgcctgatggacctgctgcacgaggagctgaaggagcaggtgatggaggtggaggaggacccccagaccatcaccaccgaggagaccatggaggaggacaagagccagagcgacgtggacttccagagctgcgagagctgcagcaacagcgacagagccgagaacgagaacggcagcagatgcttcagcgaggacaacaacgagaccaccatgctgatccaggacgacgagaacaacagcgagatgagcaaggactggcagaaggagaagatgtgcaacaagatcaacaaggtgaacagcgagggcgagttcgacaaggacagagacagcatcagcgagaccgtggacctgaacaaccaggagaccgtgaaggtgcagatccacagcagagccagcgagtacatcaccgacgtgcacagcaacgacctgagcaccccccagatcctgcccagcaacgagggcgtgaaccccagactgagcgccagcccccccaagagcggcaacctgtggcccggcctggcccccccccacaagaaggcccagagcgccagccccaagagaaagaagcagcacaagaagtacagaagcgtgatcagcgacatcttcgacggcaccatcatcagcagcgtgcagtgcctgacctgcgacagagtgagcgtgaccctggagaccttccaggacctgagcctgcccatccccggcaaggaggacctggccaagctgcacagcagcagccaccccaccagcatcgtgaaggccggcagctgcggcgaggcctacgccccccagggctggatcgccttcttcatggagtacgtgaagagctggttctggggccccgtggtgaccctgcaggactgcctggccgccttcttcgccagagacgagctgaagggcgacaacatgtacagctgcgagaagtgcaagaagctgagaaacggcgtgaagttctgcaaggtgcagaacttccccgagatcctgtgcatccacctgaagagattcagacacgagctgatgttcagcaccaagatcagcacccacgtgagcttccccctggagggcctggacctgcagcccttcctggccaaggacagccccgcccagatcgtgacctacgacctgctgagcgtgatctgccaccacggcaccgccagcagcggccactacatcgcctactgcagaaacaacctgaacaacctgtggtacgagttcgacgaccagagcgtgaccgaggtgagcgagagcaccgtgcagaacgccgaggcctacgtgctgttctacagaaagagcagcgaggaggcccagaaggagagaagaagaatcagcaacctgctgaacatcatggagcccagcctgctgcagttctacatcagcagacagtggctgaacaagttcaagaccttcgccgagcccggccccatcagcaacaacgacttcctgtgcatccacggcggcgtgccccccagaaaggccggctacatcgaggacctggtgctgatgctgccccagaacatctgggacaacctgtacagcagatacggcggcggccccgccgtgaaccacctgtacatctgccacacctgccagatcgaggccgagaagatcgagaagagaagaaagaccgagctggagatcttcatcagagtgaagaagtag

SEQ ID NO: 10779 - DNA, 2829 bp, Artificial Sequence; identical to SEQ ID NO: 10447
  Description of Artificial Sequence: Synthetic coding sequence

SEQ ID NO: 10780 - DNA, 2736 bp, Artificial Sequence
  Description of Artificial Sequence: Synthetic coding sequence
atgagcgccttcagaaaccactgcccccacctggacagcgtgggcgagatcaccaaggaggacctgatccagaagagcctgggcacctgccaggactgcaaggtgcagggccccaacctgtgggcctgcctggagaacagatgcagctacgtgggctgcggcgagagccaggtggaccacagcaccatccacagccaggagaccaagcactacctgaccgtgaacctgaccaccctgagagtgtggtgctacgcctgcagcaaggaggtgttcctggacagaaagctgggcacccagcccagcctgccccacgtgagacagccccaccagatccaggagaacagcgtgcaggacttcaagatccccagcaacaccaccctgaagacccccctggtggccgtgttcgacgacctggacatcgaggccgacgaggaggacgagctgagagccagaggcctgaccggcctgaagaacatcggcaacacctgctacatgaacgccgccctgcaggccctgagcaactgcccccccctgacccagttcttcctggactgcggcggcctggccagaaccgacaagaagcccgccatctgcaagagctacctgaagctgatgaccgagctgtggcacaagagcagacccggcagcgtggtgcccaccaccctgttccagggcatcaagaccgtgaaccccaccttcagaggctacagccagcaggacgcccaggagttcctgagatgcctgatggacctgctgcacgaggagctgaaggagcaggtgatggaggtggaggaggacccccagaccatcaccaccgaggagaccatggaggaggacaagagccagagcgacgtggacttccagagctgcgagagctgcagcaacagcgacagagccgagaacgagaacggcagcagatgcttcagcgaggacaacaacgagaccaccatgctgatccaggacgacgagaacaacagcgagatgagcaaggactggcagaaggagaagatgtgcaacaagatcaacaaggtgaacagcgagggcgagttcgacaaggacagagacagcatcagcgagaccgtggacctgaacaaccaggagaccgtgaaggtgcagatccacagcagagccagcgagtacatcaccgacgtgcacagcaacgacctgagcaccccccagatcctgcccagcaacgagggcgtgaaccccagactgagcgccagcccccccaagagcggcaacctgtggcccggcctggcccccccccacaagaaggcccagagcgccagccccaagagaaagaagcagcacaagaagtacagaagcgtgatcagcgacatcttcgacggcaccatcatcagcagcgtgcagtgcctgacctgcgacagagtgagcgtgaccctggagaccttccaggacctgagcctgcccatccccggcaaggaggacctggccaagctgcacagcagcagccaccccaccagcatcgtgaaggccggcagctgcggcgaggcctacgccccccagggctggatcgccttcttcatggagtacgtgaagagattcgtggtgagctgcgtgcccagctggttctggggccccgtggtgaccctgcaggactgcctggccgccttcttcgccagagacgagctgaagggcgacaacatgtacagctgcgagaagtgcaagaagctgagaaacggcgtgaagttctgcaaggtgcagaacttccccgagatcctgtgcatccacctgaagagattcagacacgagctgatgttcagcaccaagatcagcacccacgtgagcttccccctggagggcctggacctgcagcccttcctggccaaggacagccccgcccagatcgtgacctacgacctgctgagcgtgatctgccaccacggcaccgccagcagcggccactacatcgcctactgcagaaacaacctgaacaacctgtggtacgagttcgacgaccagagcgtgaccgaggtgagcgagagcaccgtgcagaacgccgaggcctacgtgctgttctacagaaagagcagcgaggaggcccagaaggagagaagaagaatcagcaacctgctgaacatcatggagcccagcctgctgcagttctacatcagcagacagtggctgaacaagttcaagaccttcgccgagcccggccccatcagcaacaacgacttcctgtgcatccacggcggcgtgccccccagaaaggccggctacatcgaggacctggtgctgatgctgccccagaacatctgggacaacctgtacagcagatacggcggcggccccgccgtgaaccacctgtacatctgccacacctgccagatcgaggccgagaagatcgagaagagaagaaagaccgagctggagatcttcatcagactgaacagagccttccagaaggaggacagccccgccaccttctactgcatcagcatgcagtggttcagagagtgggagagcttcgtgaagggcaaggacggcgacccccccggccccatcgacaacaccaagatcgccgtgaccaagtgcggcaacgtgatgctgagacagggcgccgacagcggccagatcagcgaggagacctggaacttcctgcagagcatctacggcggcggccccgaggtgatcctgagaccccccgtggtgcacgtggaccccgacatcctgcaggccgaggagaagatcgaggtggagaccagaagcctgtag

SEQ ID NO: 10781 - DNA, 465 bp, Artificial Sequence
  Description of Artificial Sequence: Synthetic coding sequence
atggccccccccgtgagatactgcatccccggcgagagactgtgcaacctggaggagggcagccccggcagcggcacctacaccagacacggctacatcttcagcagcctggccggctgcctgatgaagagcagcgagaacggcgccctgcccgtggtgagcgtggtgagagagaccgagagccagctgctgcccgacgtgggcgccatcgtgacctgcaaggtggagatctacaagagcttcagacccggcgacatcgtgctggccaaggtgatcagcctgggcgacgcccagagcaactacctgctgaccaccgccgagaacgagctgggcgtggtggtggcccacagcgagagcggcatccagatggtgcccatcagctggtgcgagatgcagtgccccaagacccacaccaaggagttcagaaaggtggccagagtgcagcccgagttcctgcagacctag

SEQ ID NO: 10782 - DNA, 513 bp, Artificial Sequence
  Description of Artificial Sequence: Synthetic coding sequence
atggccccccccgtgagatactgcatccccggcgagagactgtgcaacctggaggagggcagccccggcagcggcacctacaccagacacggctacatcttcagcagcctggccggctgcctgatgaagagcagcgagaacggcgccgtgagcagcatcaacagcagattcgccaaggtgcacatcctgtacgtgggcagcatgcccctgaagaacagcttcagaggcaccatcagaaaggaggacgtgagagccaccgagaaggacaaggtggagatctacaagagcttcagacccggcgacatcgtgctggccaaggtgatcagcctgggcgacgcccagagcaactacctgctgaccaccgccgagaacgagctgggcgtggtggtggcccacagcgagagcggcatccagatggtgcccatcagctggtgcgagatgcagtgccccaagacccacaccaaggagttcagaaaggtggccagagtgcagcccgagttcctgcagacctag

SEQ ID NO: 10783 - DNA, 537 bp, Artificial Sequence
  Description of Artificial Sequence: Synthetic coding sequence
atggccccccccgtgagatactgcatccccggcgagagactgtgcaacctggaggagggcagccccggcagcggcacctacaccagacacggctacatcttcagcagcctggccggctgcctgatgaagagcagcgagaacggcgccctgcccgtggtgagcgtggtgagagagaccgagagccagctgctgcccgacgtgggcgccatcgtgacctgcaaggtgagcagcatcaacagcagattcgccaaggtgcacatcctgtacgtgggcagcatgcccctgaagaacagcttcagaggcaccatcagaaaggaggacgtgagagccaccgagaaggacaagatcagcctgggcgacgcccagagcaactacctgctgaccaccgccgagaacgagctgggcgtggtggtggcccacagcgagagcggcatccagatggtgcccatcagctggtgcgagatgcagtgccccaagacccacaccaaggagttcagaaaggtggccagagtgcagcccgagttcctgcagacctag

SEQ ID NO: 10784 - DNA, 2811 bp, Artificial Sequence
  Description of Artificial Sequence: Synthetic coding sequence
atggccgccgccagagacccccccgaggtgagcctgagagaggccacccagagaaagctgagaagattcagcgagctgagaggcaagctggtggccagaggcgagttctgggacatcgtggccatcaccgccgccgacgagaagcaggagctggcctacaaccagcagctgagcgagaagctgaagagaaaggagctgcccctgggcgtgcagtaccacgtgttcgtggaccccgccggcgccaagatcggcaacggcggcagcaccctgtgcgccctgcagtgcctggagaagctgtacggcgacaagtggaacagcttcaccatcctgctgatccacagcgacgagtggaagaagaaggtgagcgagagctacgtgatcaccatcgagagactggaggacgacctgcagatcaaggagaaggagctgaccgagctgagaaacatcttcggcagcgacgaggccttcagcaaggtgaacctgaactacagaaccgagaacggcctgagcctgctgcacctgtgctgcatctgcggcggcaagaagagccacatcagaaccctgatgctgaagggcctgagacccagcagactgaccagaaacggcttcaccgccctgcacctggccgtgtacaaggacaacgccgagctgatcaccagcctgctgcacagcggcgccgacatccagcaggtgggctacggcggcctgaccgccctgcacatcgccaccatcgccggccacctggaggccgccgacgtgctgctgcagcacggcgccaacgtgaacatccaggacgccgtgttcttcacccccctgcacatcgccgcctactacggccacgagcaggtgaccagactgctgctgaagttcggcgccgacgtgaacgtgagcggcgaggtgggcgacagacccctgcacctggccagcgccaagggcttcctgaacatcgccaagctgctgatggaggagggcagcaaggccgacgtgaacgcccaggacaacgaggaccacgtgcccctgcacttctgcagcagattcggccaccacgacatcgtgaagtacctgctgcagagcgacctggaggtgcagccccacgtggtgaacatctacggcgacacccccctgcacctggcctgctacaacggcaagttcgaggtggccaaggagatcatccagatcagcggcaccgagagcctgaccaaggagaacatcttcagcgagaccgccttccacagcgcctgcacctacggcaagagcatcgacctggtgaagttcctgctggaccagaacgtgatcaacatcaaccaccagggcagagacggccacaccggcctgcacagcgcctgctaccacggccacatcagactggtgcagttcctgctggacaacggcgccgacatgaacctggtggcctgcgaccccagcagaagcagcggcgagaaggacgagcagacctgcctgatgtgggcctacgagaagggccacgacgccatcgtgaccctgctgaagcactacaagagaccccaggacgagctgccctgcaacgagtacagccagcccggcggcgacggcagctacgtgagcgtgcccagccccctgggcaagatcaagagcatgaccaaggagaaggccgacatcctgctgctgagagccggcctgcccagccacttccacctgcagctgagcgagatcgagttccacgagatcatcggcagcggcagcttcggcaaggtgtacaagggcagatgcagaaacaagatcgtggccatcaagagatacagagccaacacctactgcagcaagagcgacgtggacatgttctgcagagaggtgagcatcctgtgccagctgaaccacccctgcgtgatccagttcgtgggcgcctgcctgaacgaccccagccagttcgccatcgtgacccagtacatcagcggcggcagcctgttcagcctgctgcacgagcagaagagaatcctggacctgcagagcaagctgatcatcgccgtggacgtggccaagggcatggagtacctgcacaacctgacccagcccatcatccacagagacctgaacagccacaacatcctgctgtacgaggacggccacgccgtggtggccgacttcggcgagagcagattcctgcagagcctggacgaggacaacatgaccaagcagcccggcaacctgagatggatggcccccgaggtgttcacccagtgcaccagatacaccatcaaggccgacgtgttcagctacgccctgtgcctgtgggagatcctgaccggcgagatccccttcgcccacctgaagcccgccgccgccgccgccgacatggcctaccaccacatcagaccccccatcggctacagcatccccaagcccatcagcagcctgctgatcagaggctggaacgcctgccccgagggcagacccgagttcagcgaggtggtgatgaagctggaggagtgcctgtgcaacatcgagctgatgagccccgccagcagcaacagcagcggcagcctgagccccagcagcagcagcgactgcctggtgaacagaggcggccccggcagaagccacgtggccgccctgagaagcagattcgagctggagtacgccctgaacgccagaagctacgccgccctgagccagagcgccggccagtacagcagccagggcctgagcctggaggagatgaagagaagcctgcagtacacccccatcgacaagtacggctacgtgagcgaccccatgagcagcatgcacttccacagctgcagaaacagcagcagcttcgaggacagcagctag

SEQ ID NO: 10785 - DNA, 510 bp, Artificial Sequence
  Description of Artificial Sequence: Synthetic coding sequence
atggccgccgccagagacccccccgaggtgagcctgagagaggccacccagagaaagctgagaagattcagcgagctgagaggcaagctggtggccagaggcgagttctgggacatcgtggccatcaccgccgccgacgagaagcaggagctggcctacaaccagcagctgagcgagaagctgaagagaaaggagctgcccctgggcgtgcagtaccacgtgttcgtggaccccgccggcgccaagatcggcaacggcggcagcaccctgtgcgccctgcagtgcctggagaagctgtacggcgacaagtggaacagcttcaccatcctgctgatccacagcgtgagcttccagatctaccagaacgccctggccaagcaccccgtgagcttcaaggcctactggatccaggacgtgctgtggcacctggcccagctgtggagcatccccgactggggcctgatgttccagctgggcaagaccgccctgctggtggtgctgaccagctag

SEQ ID NO: 10786 - DNA, 1785 bp, Artificial Sequence
  Description of Artificial Sequence: Synthetic coding sequence
atggccgccgccagagacccccccgaggtgagcctgagagaggccacccagagaaagctgagaagattcagcgagctgagaggcaagctggtggccagaggcgagttctgggacatcgtggccatcaccgccgccgacgagaagcaggagctggcctacaaccagcagctgagcgagaagctgaagagaaaggagctgcccctgggcgtgcagtaccacgtgttcgtggaccccgccggcgccaagatcggcaacggcggcagcaccctgtgcgccctgcagtgcctggagaagctgtacggcgacaagtggaacagcttcaccatcctgctgatccacagcggcggctacagccagagactgcccaacgccagcgccctgggcaagatcttcaccgccctgcccctgggcaaccccatctaccagatgctggagctgaagctggccatgtacatcgacttccccctgaacatgaaccccggcatcctggtgacctgcgccgacgacatcgagctgtacagcatcggcgagttcgagttcatcagattcgacaagcccggcttcaccgccctggcccaccccagcagcctgaccatcggcaccacccacggcgtgttcgtgctggaccccttcgacgacctgaagcacagagacctggagtacagaagctgccacagattcctgcacaagcccagcatcgagaagatgtaccagttcaacgccgtgtgcagacccggcaacttctgccagcaggacttcgccggcggcgacatcgccgacctgaagctggacagcgactacgtgtacaccgacagcctgttctacatggaccacaagagcgccaagatgctgctggccttctacgagaagatcggcaccctgagctgcgagatcgacgcctacggcgacttcctgcaggccctgggccccggcgccaccgtggagtacaccagaaacaccagcaacgtgatcaaggaggagagcgagctggtggagatgagacagagaatcttccacctgctgaagggcaccagcctgaacgtggtggtgctgaacaacagcaagttctaccacatcggcaccaccgaggagtacctgttctacttcaccagcgacaacagcctgaagagcgagctgggcctgcagagcatcaccttcagcatcttccccgacatccccgagtgcagcggcaagaccagctgcatcatccagagcatcctggacagcagatgcagcgtggcccccggcagcgtggtggagtacagcagactgggccccgacgtgagcgtgggcgagaactgcatcatcagcggcagctacatcctgaccaaggccgccctgcccgcccacagcttcgtgtgcagcctgagcctgaagatgaacagatgcctgaagtacgccaccatggccttcggcgtgcaggacaacctgaagaagagcgtgaagaccctgagcgacatcaagctgctgcagttcttcggcgtgtgcttcctgagctgcctggacgtgtggaacctgaaggtgaccgaggagctgttcagcggcaacaagacctgcctgagcctgtggaccgccagaatcttccccgtgtgcagcagcctgagcgacagcgtgatcaccagcctgaagatgctgaacgccgtgaagaacaagagcgccttcagcctgaacagctacaagctgctgagcatcgaggagatgctgatctacaaggacgtggaggacatgatcacctacagagagcagatcttcctggagatcagcctgaagagcagcctgatgtag

SEQ ID NO: 10787 - DNA, 588 bp, Artificial Sequence
  Description of Artificial Sequence: Synthetic coding sequence
atggccccccccgtgagatactgcatccccggcgagagactgtgcaacctggaggagggcagccccggcagcggcacctacaccagacacggctacatcttcagcagcctggccggctgcctgatgaagagcagcgagaacggcgccctgcccgtggtgagcgtggtgagagagaccgagagccagctgctgcccgacgtgggcgccatcgtgacctgcaaggtgagcagcatcaacagcagattcgccaaggtgcacatcctgtacgtgggcagcatgcccctgaagaacagcttcagaggcaccatcagaaaggaggacgtgagagccaccgagaaggacaaggtggagatctacaagagcttcagacccggcgacatcgtgctggccaaggtgatcagcctgggcgacgcccagagcaactacctgctgaccaccgccgagaacgagctgggcgtggtggtggcccacagcgagagcggcatccagatggtgcccatcagctggtgcgagatgcagtgccccaagacccacaccaaggagttcagaaaggtggccagagtgcagcccgagttcctgcagacctag

SEQ ID NO: 10788 - DNA, 1626 bp, Artificial Sequence
  Description of Artificial Sequence: Synthetic coding sequence
atgaccggcgagaagatcagaagcctgagaagagaccacaagcccagcaaggaggagggcgacctgctggagcccggcgacgaggaggccgccgccgccctgggcggcaccttcaccagaagcagaatcggcaagggcggcaaggcctgccacaagatcttcagcaaccaccaccacagactgcagctgaaggccgcccccgccagcagcaacccccccggcgcccccgccctgcccctgcacaacagcagcgtgaccgccaacagccagagccccgccctgctggccggcaccaaccccgtggccgtggtggccgacggcggcagctgccccgcccactaccccgtgcacgagtgcgtgttcaagggcgacgtgagaagactgagcagcctgatcagaacccacaacatcggccagaaggacaaccacggcaacacccccctgcacctggccgtgatgctgggcaacaaggagtgcgcccacctgctgctggcccacaacgcccccgtgaaggtgaagaacgcccagggctggagccccctggccgaggccatcagctacggcgacagacagatgatcaccgccctgctgagaaagctgaagcagcagagcagagagagcgtggaggagaagagacccagactgctgaaggccctgaaggagctgggcgacttctacctggagctgcactgggacttccagagctgggtgcccctgctgagcagaatcctgcccagcgacgcctgcaagatctacaagcagggcatcaacatcagactggacaccaccctgatcgacttcaccgacatgaagtgccagagaggcgacctgagcttcatcttcaacggcgacgccgcccccagcgagagcttcgtggtgctggacaacgagcagaaggtgtaccagagaatccaccacgaggagagcgagatggagaccgaggaggaggtggacatcctgatgagcagcgacatctacagcgccaccctgagcaccaagagcatcagcttcaccagagcccagaccggctggctgttcagagaggacaagaccgagagagtgggcaacttcctggccgacttctacctggtgaacggcctggtgctggagagcagaaagagaagagagcacctgagcgaggaggacatcctgagaaacaaggccatcatggagagcctgagcaagggcggcaacatcatggagcagaacttcgagcccatcagaagacagagcctgaccccccccccccagaacaccatcacctgggaggagtacatcagcgccgagaacggcaaggccccccacctgggcagagagctggtgtgcaaggagagcaagaagaccttcaaggccaccatcgccatgagccaggagttccccctgggcatcgagctgctgctgaacgtgctggaggtggtggcccccttcaagcacttcaacaagctgagagagttcgtgcagatgaagctgccccccggcttccccgtgaagctggacatccccgtgttccccaccatcaccgccaccgtgaccttccaggagttcagatacgacgagttcgacggcagcatcttcaccatccccgacgactacaaggaggaccccagcagattccccgacctgtag

SEQ ID NO: 10789 - DNA, 840 bp, Artificial Sequence
  Description of Artificial Sequence: Synthetic coding sequence
atgccctgcagaagagaggaggaggaggaggccggcgaggaggccgagggcgaggaggaggaggaggacagcttcctgctgctgcagcagagcgtggccctgggcagcagcggcgaggtggacagactggtggcccagatcggcgagaccctgcagctggacgccgcccagcacagccccgccagcccctgcggcccccccggcgcccccctgagagcccccggccccctggccgccgccgtgcccgccgacaaggccagaagccccgccgtgcccctgctgctgccccccgccctggccgagaccgtgggccccgccccccccggcgtgctgagatgcgccctgggcgacagaggcagagtgagaggcagagccgccccctactgcgtggccgagctggccaccggccccagcgccctgagccccctgcccccccaggccgacctggacggcccccccggcgccggcaagcagggcatcccccagcccctgagcggcccctgcagaagaggctggctgagaggcgccgccgccagcagaagactgcagcagagaagaggcagccagcccgagaccagaaccggcgacgacgacccccacagactgctgcagcagctggtgctgagcggcaacctgatcaaggaggccgtgagaagactgcacagcagaagactgcagctgagagccaagctgccccagagacccctgctgggccccctgagcgcccccgtgcacgagccccccagccccagaagccccagagccgcctgcagcgaccccggcgccagcggcagagcccagctgagaaccggcgacggcgtgctggtgcccggcagctag

SEQ ID NO: 10790 - DNA, 1209 bp, Artificial Sequence
  Description of Artificial Sequence: Synthetic coding sequence
atgcccctgcacagcagcctgggcaacaagagcgagaccctgagccagaagaagaacaacaacaacaaggagaagaccaagagaaacagcagaaacccccccagaaccgccctgaaggagggcaagatggaggagctgagccaggccctggccagcagcttcagcgtgagccaggacctgaacagcaccgccgccccccaccccagactgagccagtacaagagcaagtacagcagcctggagcagagcgagagaagaagaagactgctggagctgcagaagagcaagagactggactacgtgaaccacgccagaagactggccgaggacgactggaccggcatggagagcgaggaggagaacaagaaggacgacgaggagatggacatcgacaccgtgaagaagctgcccaagcactacgccaaccagctgatgctgagcgagtggctgatcgacgtgcccagcgacctgggccaggagtggatcgtggtggtgtgccccgtgggcaagagagccctgatcgtggccagcagaggcagcaccagcgcctacaccaagagcggctactgcgtgaacagattcagcagcctgctgcccggcggcaacagaagaaacagcaccgccaaggactacaccatcctggactgcatctacaacgaggtgaaccagacctactacgtgctggacgtgatgtgctggagaggccaccccttctacgactgccagaccgacttcagattctactggatgcacagcaagctgcccgaggaggagggcctgggcgagaagaccaagctgaaccccttcaagttcgtgggcctgaagaacttcccctgcacccccgagagcctgtgcgacgtgctgagcatggacttccccttcgaggtggacggcctgctgttctaccacaagcagacccactacagccccggcagcacccccctggtgggctggctgagaccctacatggtgagcgacgtgctgggcgtggccgtgcccgccggccccctgaccaccaagcccgactacgccggccaccagctgcagcagatcatggagcacaagaagagccagaaggagggcatgaaggagaagctgacccacaaggccagcgagaacggccactacgagctggagcacctgagcacccccaagctgaagggcagcagccacagccccgaccaccccggctgcctgatggagaactag

SEQ ID NO: 10791 - DNA, 1107 bp, Artificial Sequence
  Description of Artificial Sequence: Synthetic coding sequence
atgagcctgttcggcaccaccagcggcttcggcaccagcggcaccagcatgttcggcagcgccaccaccgacaaccacaaccccatgaaggacatcgaggtgaccagcagccccgacgacagcatcggctgcctgagcttcagcccccccaccctgcccggcaacttcctgatcgccggcagctgggccaacgacgtgagatgctgggaggtgcaggacagcggccagaccatccccaaggcccagcagatgcacaccggccccgtgctggacgtgtgctggagcgacgacggcagcaaggtgttcaccgccagctgcgacaagaccgccaagatgtgggacctgagcagcaaccaggccatccagatcgcccagcacgacgcccccgtgaagaccatccactggatcaaggcccccaactacagctgcgtgatgaccggcagctgggacaagaccctgaagttctgggacaccagaagcagcaaccccatgatggtgctgcagctgcccgagagatgctactgcgccgacgtgatctaccccatggccgtggtggccaccgccgagagaggcctgatcgtgtaccagctggagaaccagcccagcgagttcagaagaatcgagagccccctgaagcaccagcacagatgcgtggccatcttcaaggacaagcagaacaagcccaccggcttcgccctgggcagcatcgagggcagagtggccatccactacatcaacccccccaaccccgccaaggacaacttcaccttcaagtgccacagaagcaacggcaccaacaccagcgccccccaggacatctacgccgtgaacggcatcgccttccaccccgtgcacggcaccctggccaccgtgggcagcgacggcagattcagcttctgggacaaggacgccagaaccaagctgaagaccagcgagcagctggaccagcccatcagcgcctgctgcttcaaccacaacggcaacatcttcgcctacgccagcagctacgactggagcaagggccacgagttctacaacccccagaagaagaactacatcttcctgagaaacgccgccgaggagctgaagcccagaaacaagaagtag

SEQ ID NO: 10792 - DNA, 552 bp, Artificial Sequence
  Description of Artificial Sequence: Synthetic coding sequence
atgagaaagagcagctgcgtggagagcttcgacgaccagagaagaatgagcctgcacctgcacggcgccgactgcgaccccaagacccagaacgagatgaacatctgcgaggaggagttcgtggagtacaagaacagagacgccatcagcgccctgatgcccctgttcagcgaggaggagagcagcgacggcagcaagcacaacaacggcctgcccgaccacatcagcgcccagctgcagaacacctacaccctgaaggccttcaccgtgggcagcaagtgcgtggtgtggagcagcctgagaaacacctggagcaagtgcgagatcctggagaccgccgaggagggcaccagagtgctgaacctgagcaacggcatggaggagatcgtgaaccccgagaacgtgtggaacggcatccccaagctggacaagagcccccccgaggccgtgagccagagagtgggcaaggacctgtacttcatgagcgtgggcgacaccaccatcaaggagaagggcttcggcggcgacggcgacctgaccgtggacctgtag

SEQ ID NO: 10793 - DNA, 1821 bp, Artificial Sequence
  Description of Artificial Sequence: Synthetic coding sequence
atgcccagcccccagctgctggtgctgttcggcagccagaccggcaccgcccaggacgtgagcgagagactgggcagagaggccagaagaagaagactgggctgcagagtgcaggccctggacagctaccccgtggtgaacctgatcaacgagcccctggtgatcttcgtgtgcgccaccaccggccagggcgacccccccgacaacatgaagaacttctggagattcatcttcagaaagaacctgcccagcaccgccctgtgccagatggacttcgccgtgctgggcctgggcgacagcagctacgccaagttcaacttcgtggccaagaagctgcacagaagactgctgcagctgggcggcagcgccctgctgcccgtgtgcctgggcgacgaccagcacgagctgggccccgacgccgccgtggacccctggctgagagacctgtgggacagagtgctgggcctgtacccccccccccccggcctgaccgagatcccccccggcgtgcccctgcccagcaagttcaccctgctgttcctgcaggaggcccccagcaccggcagcgagggccagagagtggcccaccccggcagccaggagccccccagcgagagcaagcccttcctggcccccatgatcagcaaccagagagtgaccggccccagccacttccaggacgtgagactgatcgagttcgacatcctgggcagcggcatcagcttcgccgccggcgacgtggtgctgatccagcccagcaacagcgccgcccacgtgcagagattctgccaggtgctgggcctggaccccgaccagctgttcatgctgcagcccagagagcccgacgtgagcagccccaccagactgccccagccctgcagcatgagacacctggtgagccactacctggacatcgccagcgtgcccagaagaagcttcttcgagctgctggcctgcctgagcctgcacgagctggagagagagaagctgctggagttcagcagcgcccagggccaggaggagctgttcgagtactgcaacagacccagaagaaccatcctggaggtgctgtgcgacttcccccacaccgccgccgccatcccccccgactacctgctggacctgatccccgtgatcagacccagagccttcagcatcgccagcagcctgctgacccaccccagcagactgcagatcctggtggccgtggtgcagttccagaccagactgaaggagcccagaagaggcctgtgcagcagctggctggccagcctggaccccggccagggccccgtgagagtgcccctgtgggtgagacccggcagcctggccttccccgagacccccgacacccccgtgatcatggtgggccccggcaccggcgtggcccccttcagagccgccatccaggagagagtggcccagggccagaccggcaacttcctgttcttcggctgcagatggagagaccaggacttctactgggaggccgagtggcaggagctggagaagagagactgcctgaccctgatccccgccttcagcagagagcagccccccgccctgttcagcgccctgcaggagcagaaggtgtacgtgcagcacagactgagagagctgggcagcctggtgtgggagctgctggacagacagggcgcctacttctacctggccggcaacgccaagagcatgcccgccgacgtgagcgaggccctgatgagcatcttccaggaggagggcggcctgtgcagccccgacgccgccgcctacctggccagactgcagcagaccagaagattccagaccgagacctgggcctag

SEQ ID NO: 10794 - DNA, 420 bp, Artificial Sequence
  Description of Artificial Sequence: Synthetic coding sequence
atggccgagagcgactgggacaccgtgaccgtgctgagaaagaagggccccaccgccgcccaggccaagagcaagcaggccatcctggccgcccagagaagaggcgaggacgtggagaccagcaagaagtgggccgccggccagaacaagcagcacagcatcaccaagaacaccgccaagctggacagagagaccgaggagctgcaccacgacagagtgaccctggaggtgggcaaggtgatccagcagggcagacagagcaagggcctgacccagaaggacctggccaccaagatcaacgagaagccccaggtgatcgccgactacgagagcggcagagccatccccaacaaccaggtgctgggcaagatcgagagagccatcggcgagtgccccagcaccctgagaagagtgagatag

SEQ ID NO: 10795 - DNA, 426 bp, Artificial Sequence
  Description of Artificial Sequence: Synthetic coding sequence
atggccgagagcgactgggacaccgtgaccgtgctgagaaagaagggccccaccgccgcccaggccaagagcaagcaggccatcctggccgcccagagaagaggcgaggacgtggagaccagcaagaagtgggccgccggccagaacaagcagcacagcatcaccaagaacaccgccaagctggacagagagaccgaggagctgcaccacgacagagtgaccctggaggtgggcaaggtgatccagcagggcagacagagcaagggcctgacccagaaggacctggccaccaagatcaacgagaagccccaggtgatcgccgactacgagagcggcagagccatccccaacaaccaggtgctgggcaagatcgagagagccatcgacgtgggcaccagaagcgccagagtgctgagagcccagtag

SEQ ID NO: 10796 - DNA, 150 bp, Artificial Sequence
  Description of Artificial Sequence: Synthetic coding sequence
atggccacccagagaaagcacctggtgaaggacttcaacccctacatcacctgctacatctgcaagggctacctgatcaagcccaccaccgtgaccgagtgcctgcacaccagcgccgagagctactggatgagcacctggatgagctag

SEQ ID NO: 10797 - DNA, 960 bp, Artificial Sequence
  Description of Artificial Sequence: Synthetic coding sequence
atgatggtgctgaaggtggaggagctggtgaccggcaagaagaacggcaacggcgaggccggcgagttcctgcccgaggacttcagagacggcgagtacgaggccgccgtgaccctggagaagcaggaggacctgaagaccctgctggcccaccccgtgaccctgggcgagcagcagtggaagagcgagaagcagagagaggccgagctgaagaagaagaagctggagcagagaagcaagctggagaacctggaggacctggagatcatcatccagctgaagaagagaaagaagtacagaaagaccaaggtgcccgtggtgaaggagcccgagcccgagatcatcaccgagcccgtggacgtgcccaccttcctgaaggccgccctggagaacaagctgcccgtggtggagaagttcctgagcgacaagaacaaccccgacgtgtgcgacgagtacaagagaaccgccctgcacagagcctgcctggagggccacctggccatcgtggagaagctgatggaggccggcgcccagatcgagttcagagacatgctggagagcaccgccatccactgggccagcagaggcggcaacctggacgtgctgaagctgctgctgaacaagggcgccaagatcagcgccagagacaagctgctgagcaccgccctgcacgtggccgtgagaaccggccactacgagtgcgccgagcacctgatcgcctgcgaggccgacctgaacgccaaggacagagagggcgacacccccctgcacgacgccgtgagactgaacagatacaagatgatcagactgctgatcatgtacggcgccgacctgaacatcaagaactgcgccggcaagacccccatggacctggtgctgcactggcagaacggcaccaaggccatcttcgacagcctgagagagaacagctacaagaccagcagaatcgccaccttctag

SEQ ID NO: 10798 - DNA, 1089 bp, Artificial Sequence
  Description of Artificial Sequence: Synthetic coding sequence
atgagcggctaccagagaagacccggcgccacccccctgagcagagccagaagcctggccatccccgacgacgacagattcgaggacctggaggaggccaaccccttcagcttcagagagttcctgaagaccaagaacctgggcctgagcaaggaggaccccgccagcagaatctacgccaaggaggccagcagacacagcctgggcctggaccacaacagcccccccagccagaccggcggctacggcctggagtaccagcagcccttcttcgaggaccccaccggcgccggcgacctgctggacgaggaggaggacgaggacaccggctggagcggcgcctacctgcccagcgccatcgagcagacccaccccgagagagtgcccgccggcaccagcccctgcagcacctacctgagcttcttcagcacccccagcgagctggccggccccgagagcctgcccagctgggccctgagcgacaccgacagcagagtgagccccgccagccccgccggcagccccagcgccgacttcgccgtgcacggcgagagcctgggcgacagacacctgagaaccctgcagatcagctacgacgccctgaaggacgagaacagcaagctgagaagaaagctgaacgaggtgcagagcttcagcgaggcccagaccgagatggtgagaaccctggagagaaagctggaggccaagatgatcaaggaggagagcgactaccacgacctggagagcgtggtgcagcaggtggagcagaacctggagctgatgaccaagagagccgtgaaggccgagaaccacgtggtgaagctgaagcaggagatcagcctgctgcaggcccaggtgagcaacttccagagagagaacgaggccctgagatgcggccagggcgccagcctgaccgtggtgaagcagaacgccgacgtggccctgcagaacctgagagtggtgatgaacagcgcccaggccagcatcaagcagctggtgagcggcgccgagaccctgaacctggtggccgagatcctgaagagcatcgacagaatcagcgaggtgaaggacgaggaggaggacagctag

SEQ ID NO: 10799 - DNA, 5463 bp, Artificial Sequence
  Description of Artificial Sequence: Synthetic coding sequence
atggagagcaacttcaaccaggagggcgtgcccagacccagctacgtgttcagcgccgaccccatcgccagacccagcgagatcaacttcgacggcatcaagctggacctgagccacgagttcagcctggtggcccccaacaccgaggccaacagcttcgagagcaaggactacctgcaggtgtgcctgagaatcagacccttcacccagagcgagaaggagctggagagcgagggctgcgtgcacatcctggacagccagaccgtggtgctgaaggagccccagtgcatcctgggcagactgagcgagaagagcagcggccagatggcccagaagttcagcttcagcaaggtgttcggccccgccaccacccagaaggagttcttccagggctgcatcatgcagcccgtgaaggacctgctgaagggccagagcagactgatcttcacctacggcctgaccaacagcggcaagacctacaccttccagggcaccgaggagaacatcggcatcctgcccagaaccctgaacgtgctgttcgacagcctgcaggagagactgtacaccaagatgaacctgaagccccacagaagcagagagtacctgagactgagcagcgagcaggagaaggaggagatcgccagcaagagcgccctgctgagacagatcaaggaggtgaccgtgcacaacgacagcgacgacaccctgtacggcagcctgaccaacagcctgaacatcagcgagttcgaggagagcatcaaggactacgagcaggccaacctgaacatggccaacagcatcaagttcagcgtgtgggtgagcttcttcgagatctacaacgagtacatctacgacctgttcgtgcccgtgagcagcaagttccagaagagaaagatgctgagactgagccaggacgtgaagggctacagcttcatcaaggacctgcagtggatccaggtgagcgacagcaaggaggcctacagactgctgaagctgggcatcaagcaccagagcgtggccttcaccaagctgaacaacgccagcagcagaagccacagcatcttcaccgtgaagatcctgcagatcgaggacagcgagatgagcagagtgatcagagtgagcgagctgagcctgtgcgacctggccggcagcgagagaaccatgaagacccagaacgagggcgagagactgagagagaccggcaacatcaacaccagcctgctgaccctgggcaagtgcatcaacgtgctgaagaacagcgagaagagcaagttccagcagcacgtgcccttcagagagagcaagctgacccactacttccagagcttcttcaacggcaagggcaagatctgcatgatcgtgaacatcagccagtgctacctggcctacgacgagaccctgaacgtgctgaagttcagcgccatcgcccagaaggtgtgcgtgcccgacaccctgaacagcagccaggagaagctgttcggccccgtgaagagcagccaggacgtgagcctggacagcaacagcaacagcaagatcctgaacgtgaagagagccaccatcagctgggagaacagcctggaggacctgatggaggacgaggacctggtggaggagctggagaacgccgaggagacccagaacgtggagaccaagctgctggacgaggacctggacaagaccctggaggagaacaaggccttcatcagccacgaggagaagagaaagctgctggacctgatcgaggacctgaagaagaagctgatcaacgagaagaaggagaagctgaccctggagttcaagatcagagaggaggtgacccaggagttcacccagtactgggcccagagagaggccgacttcaaggagaccctgctgcaggagagagagatcctggaggagaacgccgagagaagactggccatcttcaaggacctggtgggcaagtgcgacaccagagaggaggccgccaaggacatctgcgccaccaaggtggagaccgaggagacccacaactacgtgggcttcgaggacatcatcgacagcctgcaggacaacgtggccgacatcaagaagcaggccgagatcgcccacctgtacatcgccagcctgcccgacccccaggaggccaccgcctgcctggagctgaagttcaaccagatcaaggccgagctggccaagaccaagggcgagctgatcaagaccaaggaggagctgaagaagagagagaacgagagcgacagcctgatccaggagctggagaccagcaacaagaagatcatcacccagaaccagagaatcaaggagctgatcaacatcatcgaccagaaggaggacaccatcaacgagttccagaacctgaagagccacatggagaacaccttcaagtgcaacgacaaggccgacaccagcagcctgatcatcaacaacaagctgatctgcaacgagaccgtggaggtgcccaaggacagcaagagcaagatctgcagcgagagaaagagagtgaacgagaacgagctgcagcaggacgagccccccgccaagaagggcagcatccacgtgagcagcgccatcaccgaggaccagaagaagagcgaggaggtgagacccaacatcgccgagatcgaggacatcagagtgctgcaggagaacaacgagggcctgagagccttcctgctgaccatcgagaacgagctgaagaacgagaaggaggagaaggccgagctgaacaagcagatcgtgcacttccagcaggagctgagcctgagcgagaagaagaacctgaccctgagcaaggaggtgcagcagatccagagcaactacgacatcgccatcgccgagctgcacgtgcagaagagcaagaaccaggagcaggaggagaagatcatgaagctgagcaacgagatcgagaccgccaccagaagcatcaccaacaacgtgagccagatcaagctgatgcacaccaagatcgacgagctgagaaccctggacagcgtgagccagatcagcaacatcgacctgctgaacctgagagacctgagcaacggcagcgaggaggacaacctgcccaacacccagctggacctgctgggcaacgactacctggtgagcaagcaggtgaaggagtacagaatccaggagcccaacagagagaacagcttccacagcagcatcgaggccatctgggaggagtgcaaggagatcgtgaaggccagcagcaagaagagccaccagatcgaggagctggagcagcagatcgagaagctgcaggccgaggtgaagggctacaaggacgagaacaacagactgaaggagaaggagcacaagaaccaggacgacctgctgaaggagaaggagaccctgatccagcagctgaaggaggagctgcaggagaagaacgtgaccctggacgtgcagatccagcacgtggtggagggcaagagagccctgagcgagctgacccagggcgtgacctgctacaaggccaagatcaaggagctggagaccatcctggagacccagaaggtggagtgcagccacagcgccaagctggagcaggacatcctggagaaggagagcatcatcctgaagctggagagaaacctgaaggagttccaggagcacctgcaggacagcgtgaagaacaccaaggacctgaacgtgaaggagctgaagctgaaggaggagatcacccagctgaccaacaacctgcaggacatgaagcacctgctgcagctgaaggaggaggaggaggagaccaacagacaggagaccgagaagctgaaggaggagctgagcgccagcagcgccagaacccagaacctgaaggccgacctgcagagaaaggaggaggactacgccgacctgaaggagaagctgaccgacgccaagaagcagatcaagcaggtgcagaaggaggtgagcgtgatgagagacgaggacaagctgctgagaatcaagatcaacgagctggagaagaagaagaaccagtgcagccaggagctggacatgaagcagagaaccatccagcagctgaaggagcagctgaacaaccagaaggtggaggaggccatccagcagtacgagagagcctgcaaggacctgaacgtgaaggagaagatcatcgaggacatgagaatgaccctggaggagcaggagcagacccaggtggagcaggaccaggtgctggaggccaagctggaggaggtggagagactggccaccgagctggagaagtggaaggagaagtgcaacgacctggagaccaagaacaaccagagaagcaacaaggagcacgagaacaacaccgacgtgctgggcaagctgaccaacctgcaggacgagctgcaggagagcgagcagaagtacaacgccgacagaaagaagtggctggaggagaagatgatgctgatcacccaggccaaggaggccgagaacatcagaaacaaggagatgaagaagtacgccgaggacagagagagattcttcaagcagcagaacgagatggagatcctgaccgcccagctgaccgagaaggacagcgacctgcagaagtggagagaggagagagaccagctggtggccgccctggagatccagctgaaggccctgatcagcagcaacgtgcagaaggacaacgagatcgagcagctgaagagaatcatcagcgagaccagcaagatcgagacccagatcatggacatcaagcccaagagaatcagcagcgccgaccccgacaagctgcagaccgagcccctgagcaccagcttcgagatcagcagaaacaagatcgaggacggcagcgtggtgctggacagctgcgaggtgagcaccgagaacgaccagagcaccagattccccaagcccgagctggagatccagttcacccccctgcagcccaacaagatggccgtgaagcaccccggctgcaccacccccgtgaccgtgaagatccccaaggccagaaagagaaagagcaacgagatggaggaggacctggtgaagtgcgagaacaagaagaacgccacccccagaaccaacctgaagttccccatcagcgacgacagaaacagcagcgtgaagaaggagcagaaggtggccatcagacccagcagcaagaagacctacagcctgagaagccaggccagcatcatcggcgtgaacctggccaccaagaagaaggagggcaccctgcagaagttcggcgacttcctgcagcacagccccagcatcctgcagagcaaggccaagaagatcatcgagaccatgagcagcagcaagctgagcaacgtggaggccagcaaggagaacgtgagccagcccaagagagccaagagaaagctgtacaccagcgagatcagcagccccatcgacatcagcggccaggtgatcctgatggaccagaagatgaaggagagcgaccaccagatcatcaagagaagactgagaaccaagaccgccaagtag

SEQ ID NO: 10800 - DNA, 1485 bp, Artificial Sequence
  Description of Artificial Sequence: Synthetic coding sequence
atgaagctgggcaagaagcccatgtacaagcccgtggacccctacagcagaatgcagagcacctacaactacaacatgagaggcggcgcctacccccccagatacttctaccccttccccgtgccccccctgctgtaccaggtggagctgagcgtgggcggccagcagttcaacggcaagggcaagaccagacaggccgccaagcacgacgccgccgccaaggccctgagaatcctgcagaacgagcccctgcccgagagactggaggtgaacggcagagagagcgaggaggagaacctgaacaagagcgagatcagccaggtgttcgagatcgccctgaagagaaacctgcccgtgaacttcgaggtggccagagagagcggccccccccacatgaagaacttcgtgaccaaggtgagcgtgggcgagttcgtgggcgagggcgagggcaagagcaagaagatcagcaagaagaacgccgccatcgccgtgctggaggagctgaagaagctgccccccctgcccgccgtggagagagtgaagcccagaatcaagaagaagaccaagcccatcgtgaagaccagccccgagtacggccagggcatcaaccccatcagcagactggcccagatccagcaggccaagaaggagaaggagcccgagtacaccctgctgaccgagagaggcctgcccagaagaagagagttcgtgatgcaggtgaaggtgggcaaccacaccgccgagggcaccggcaccaacaagaaggtggccaagagaaacgccgccgagaacatgctggagatcctgggcttcaaggtgccccaggcccagcccaccaagcccgccctgaagagcgaggagaagacccccatcaagaagcccggcgacggcagaaaggtgaccttcttcgagcccggcagcggcgacgagaacggcaccagcaacaaggaggacgagttcagaatgccctacctgagccaccagcagctgcccgccggcatcctgcccatggtgcccgaggtggcccaggccgtgggcgtgagccagggccaccacaccaaggacttcaccagagccgcccccaaccccgccaaggccaccgtgaccgccatgatcgccagagagctgctgtacggcggcaccagccccaccgccgagaccatcctgaagaacaacatcagcagcggccacgtgccccacggccccctgaccagacccagcgagcagctggactacctgagcagagtgcagggcttccaggtggagtacaaggacttccccaagaacaacaagaacgagttcgtgagcctgatcaactgcagcagccagccccccctgatcagccacggcatcggcaaggacgtggagagctgccacgacatggccgccctgaacatcctgaagctgctgagcgagctggaccagcagagcaccgagatgcccagaaccggcaacggccccatgagcgtgtgcggcagatgctag

SEQ ID NO: 10801 - DNA, 1509 bp, Artificial Sequence
  Description of Artificial Sequence: Synthetic coding sequence
atgaagctgggcaagaagcccatgtacaagcccgtggacccctacagcagaatgcagagcacctacaactacaacatgagaggcggcgcctacccccccagatacttctaccccttccccgtgccccccctgctgtaccaggtggagctgagcgtgggcggccagcagttcaacggcaagggcaagaccagacaggccgccaagcacgacgccgccgccaaggccctgagaatcctgcagaacgagcccctgcccgagagactggaggtgaacggcagagagagcgaggaggagaacctgaacaagagcgagatcagccaggtgttcgagatcgccctgaagagaaacctgcccgtgaacttcgagagcttccccctgaagcaggtggccagagagagcggccccccccacatgaagaacttcgtgaccaaggtgagcgtgggcgagttcgtgggcgagggcgagggcaagagcaagaagatcagcaagaagaacgccgccatcgccgtgctggaggagctgaagaagctgccccccctgcccgccgtggagagagtgaagcccagaatcaagaagaagaccaagcccatcgtgaagccccagaccagccccgagtacggccagggcatcaaccccatcagcagactggcccagatccagcaggccaagaaggagaaggagcccgagtacaccctgctgaccgagagaggcctgcccagaagaagagagttcgtgatgcaggtgaaggtgggcaaccacaccgccgagggcaccggcaccaacaagaaggtggccaagagaaacgccgccgagaacatgctggagatcctgggcttcaaggtgccccaggcccagcccaccaagcccgccctgaagagcgaggagaagacccccatcaagaagcccggcgacggcagaaaggtgaccttcttcgagcccggcagcggcgacgagaacggcaccagcaacaaggaggacgagttcagaatgccctacctgagccaccagcagctgcccgccggcatcctgcccatggtgcccgaggtggcccaggccgtgggcgtgagccagggccaccacaccaaggacttcaccagagccgcccccaaccccgccaaggccaccgtgaccgccatgatcgccagagagctgctgtacggcggcaccagccccaccgccgagaccatcctgaagaacaacatcagcagcggccacgtgccccacggccccctgaccagacccagcgagcagctggactacctgagcagagtgcagggcttccaggtggagtacaaggacttccccaagaacaacaagaacgagttcgtgagcctgatcaactgcagcagccagccccccctgatcagccacggcatcggcaaggacgtggagagctgccacgacatggccgccctgaacatcctgaagctgctgagcgagctggaccagcagagcaccgagatgcccagaaccggcaacggccccatgagcgtgtgcggcagatgctag

SEQ ID NO: 10802 - DNA, 1491 bp, Artificial Sequence; identical to SEQ ID NO: 10231
  Description of Artificial Sequence: Synthetic coding sequence

SEQ ID NO: 10803 - DNA, 1473 bp, Artificial Sequence
  Description of Artificial Sequence: Synthetic coding sequence
atgagcgaggtgaccaagaacagcctggagaagatcctgccccagctgaagtgccacttcacctggaacctgttcaaggaggacagcgtgagcagagacctggaggacagagtgtgcaaccagatcgagttcctgaacaccgagttcaaggccaccatgtacaacctgctggcctacatcaagcacctggacggcaacaacgaggccgccctggagtgcctgagacaggccgaggagctgatccagcaggagcacgccgaccaggccgagatcagaagcctggtgacctggggcaactacgcctgggtgtactaccacctgggcagactgagcgacgcccagatctacgtggacaaggtgaagcagacctgcaagaagttcagcaacccctacagcatcgagtacagcgagctggactgcgaggagggctggacccagctgaagtgcggcagaaacgagagagccaaggtgtgcttcgagaaggccctggaggagaagcccaacaaccccgagttcagcagcggcctggccatcgccatgtaccacctggacaaccaccccgagaagcagttcagcaccgacgtgctgaagcaggccatcgagctgagccccgacaaccagtacgtgaaggtgctgctgggcctgaagctgcagaagatgaacaaggaggccgagggcgagcagttcgtggaggaggccctggagaagagcccctgccagaccgacgtgctgagaagcgccgccaagttctacagaagaaagggcgacctggacaaggccatcgagctgttccagagagtgctggagagcacccccaacaacggctacctgtaccaccagatcggctgctgctacaaggccaaggtgagacagatgcagaacaccggcgagagcgaggccagcggcaacaaggagatgatcgaggccctgaagcagtacgccatggactacagcaacaaggccctggagaagggcctgaaccccctgaacgcctacagcgacctggccgagttcctggagaccgagtgctaccagacccccttcaacaaggaggtgcccgacgccgagaagcagcagagccaccagagatactgcaacctgcagaagtacaacggcaagagcgaggacaccgccgtgcagcacggcctggagggcctgagcatcagcaagaagagcaccgacaaggaggagatcaaggaccagccccagaacgtgagcgagaacctgctgccccagaacgcccccaactactggtacctgcagggcctgatccacaagcagaacggcgacctgctgcaggccgccaagtgctacgagaaggagctgggcagactgctgagagacgcccccagcggcatcggcagcatcttcctgagcgccagcgagctggaggacggcagcgaggagatgggccagggcgccgtgagcagcagccccagagagctgctgagcaacagcgagcagctgaactag

SEQ ID NO: 10804 - DNA, 1473 bp, Artificial Sequence; identical to SEQ ID NO: 10803
  Description of Artificial Sequence: Synthetic coding sequence

SEQ ID NO: 10805 - DNA, 1509 bp, Artificial Sequence; identical to SEQ ID NO: 10801
  Description of Artificial Sequence: Synthetic coding sequence

SEQ ID NO: 10806 - DNA, 654 bp, Artificial Sequence
  Description of Artificial Sequence: Synthetic coding sequence
atggccgagggcagccagagcgcccccgaggccggcaacgacatgggcaacgacgacgccatcggcggcaacgtgagcaagtacatcgtgctgcccaccggctactgcggccagcccaagaagggccacctgatcttcgacgcctgcttcgagagcggcaacctgggcagagtggaccaggtgagcgagttcgagtacgacctgttcatcagacccgacacctgcaaccccagattcagagtgtggttcaacttcaccgtggagaacgtgaaggagagccagagagtgatcttcaacatcgtgaacttcagcaagaccaagagcctgtacagagacggcatggcccccatggtgaagagcaccagcagacccaagtggcagagactgccccccaagaacgtgtactactacagatgccccgaccacagaaagaactacgtgatgagcttcgccttctgcttcgacagagaggaggacatctaccagttcgcctactgctacccctacacctacaccagattccagcactacctggacagcctgcagaagagaaacatggactacttcttcagagagcagctgggccagagcgtgcagcagagaaagctggacctgctgaccatcaccagccccgccggcagatggagctggtag

SEQ ID NO: 10807 - DNA, 963 bp, Artificial Sequence
  Description of Artificial Sequence: Synthetic coding sequence
atggccgagggcagccagagcgcccccgaggccggcaacgacatgggcaacgacgacgccatcggcggcaacgtgagcaagtacatcgtgctgcccaccggctactgcggccagcccaagaagggccacctgatcttcgacgcctgcttcgagagcggcaacctgggcagagtggaccaggtgagcgagttcgagtacgacctgttcatcagacccgacacctgcaaccccagattcagagtgtggttcaacttcaccgtggagaacgtgaaggagagccagagagtgatcttcaacatcgtgaacttcagcaagaccaagagcctgtacagagacggcatggcccccatggtgaagagcaccagcagacccaagtggcagagactgccccccaagaacgtgtactactacagatgccccgaccacagaaagaactacgtgatgagcttcgccttctgcttcgacagagaggaggacatctaccagttcgcctactgctacccctacacctacaccagattccagcactacctggacagcctgcagaagagaaacatggactacttcttcagagagcagctgggccagagcgtgcagcagagaaagctggacctgctgaccatcaccagccccgacaacctgagagagggcgccgagcagaaggtggtgttcatcaccggcagagtgcaccccggcgagacccccagcagcttcgtgtgccagggcatcatcgacttcctggtgagccagcaccccatcgcctgcgtgctgagagagtacctggtgttcaagatcgcccccatgctgaaccccgacggcgtgtacctgggcaactacagatgcagcctgatgggcttcgacctgaacagacactggctggaccccagcccctgggtgcaccccaccctgcacggcgtgaagcagctgatcgtgcagatgtacaacgaccccgtgagcaactag

SEQ ID NO: 10808 - DNA, 1512 bp, Artificial Sequence
  Description of Artificial Sequence: Synthetic coding sequence
atggccgagggcagccagagcgcccccgaggccggcaacgacatgggcaacgacgacgccatcggcggcaacgtgagcaagtacatcgtgctgcccaccggctactgcggccagcccaagaagggccacctgatcttcgacgcctgcttcgagagcggcaacctgggcagagtggaccaggtgagcgagttcgagtacgacctgttcatcagacccgacacctgcaaccccagattcagagtgtggttcaacttcaccgtggagaacgtgaaggagagccagagagtgatcttcaacatcgtgaacttcagcaagaccaagagcctgtacagagacggcatggcccccatggtgaagagcaccagcagacccaagtggcagagactgccccccaagaacgtgtactactacagatgccccgaccacagaaagaactacgtgatgagcttcgccttctgcttcgacagagaggaggacatctaccagttcgcctactgctacccctacacctacaccagattccagcactacctggacagcctgcagaagagaaacatggactacttcttcagagagcagctgggccagagcgtgcagcagagaaagctggacctgctgaccatcaccagccccgacaacctgagagagggcgccgagcagaaggtggtgttcatcaccggcagagtgcaccccggcgagacccccagcagcttcgtgtgccagggcatcatcgacttcctggtgagccagcaccccatcgcctgcgtgctgagagagtacctggtgttcaagatcgcccccatgctgaaccccgacggcgtgtacctgggcaactacagatgcagcctgatgggcttcgacctgaacagacactggctggaccccagcccctgggtgcaccccaccctgcacggcgtgaagcagctgatcgtgcagatgtacaacgaccccaagaccagcctggagttctacatcgacatccacgcccacagcaccatgatgaacggcttcatgtacggcaacatcttcgaggacgaggagagattccagagacaggccatcttccccaagctgctgtgccagaacgccgaggacttcagctacagcagcaccagcttcaacagagacgccgtgaaggccggcaccggcagaagattcctgggcggcctgctggaccacaccagctactgctacaccctggaggtgagcttctacagctacatcatcagcggcaccaccgccgccgtgccctacaccgaggaggcctacatgaagctgggcagaaacgtggccagaaccttcctggactactacagactgaaccccgtggtggagaaggtggccatccccatgcccagactgagaaacaaggagatcgaggtgcagagaagaaaggagaagagccccccctacaagcaccccctgctgagaggccccgccagcaactaccccaacagcaagggcgacaagaagagcagcgtgaaccacaaggaccccagcacccccttctag

SEQ ID NO: 10809 - DNA, 1734 bp, Artificial Sequence
  Description of Artificial Sequence: Synthetic coding sequence
atgagccaggtgcaggtgcaggtgcagaaccccagcgccgccctgagcggcagccagatcctgaacaagaaccagagcctgctgagccagcccctgatgagcatccccagcaccaccagcagcctgcccagcgagaacgccggcagacccatccagaacagcgccctgcccagcgccagcatcaccagcaccagcgccgccgccgagagcatcacccccaccgtggagctgaacgccctgtgcatgaagctgggcaagaagcccatgtacaagcccgtggacccctacagcagaatgcagagcacctacaactacaacatgagaggcggcgcctacccccccagatacttctaccccttccccgtgccccccctgctgtaccaggtggagctgagcgtgggcggccagcagttcaacggcaagggcaagaccagacaggccgccaagcacgacgccgccgccaaggccctgagaatcctgcagaacgagcccctgcccgagagactggaggtgaacggcagagagagcgaggaggagaacctgaacaagagcgagatcagccaggtgttcgagatcgccctgaagagaaacctgcccgtgaacttcgaggtggccagagagagcggccccccccacatgaagaacttcgtgaccaaggtgagcgtgggcgagttcgtgggcgagggcgagggcaagagcaagaagatcagcaagaagaacgccgccatcgccgtgctggaggagctgaagaagctgccccccctgcccgccgtggagagagtgaagcccagaatcaagaagaagaccaagcccatcgtgaagccccagaccagccccgagtacggccagggcatcaaccccatcagcagactggcccagatccagcaggccaagaaggagaaggagcccgagtacaccctgctgaccgagagaggcctgcccagaagaagagagttcgtgatgcaggtgaaggtgggcaaccacaccgccgagggcaccggcaccaacaagaaggtggccaagagaaacgccgccgagaacatgctggagatcctgggcttcaaggtgccccaggcccagcccaccaagcccgccctgaagagcgaggagaagacccccatcaagaagcccggcgacggcagaaaggtgaccttcttcgagcccggcagcggcgacgagaacggcaccagcaacaaggaggacgagttcagaatgccctacctgagccaccagcagctgcccgccggcatcctgcccatggtgcccgaggtggcccaggccgtgggcgtgagccagggccaccacaccaaggacttcaccagagccgcccccaaccccgccaaggccaccgtgaccgccatgatcgccagagagctgctgtacggcggcaccagccccaccgccgagaccatcctgaagaacaacatcagcagcggccacgtgccccacggccccctgaccagacccagcgagcagctggactacctgagcagagtgcagggcttccaggtggagtacaaggacttccccaagaacaacaagaacgagttcgtgagcctgatcaactgcagcagccagccccccctgatcagccacggcatcggcaaggacgtggagagctgccacgacatggccgccctgaacatcctgaagctgctgagcgagctggaccagcagagcaccgagatgcccagaaccggcaacggccccatgagcgtgtgcggcagatgctag

SEQ ID NO: 10810 - DNA, 852 bp, Artificial Sequence
  Description of Artificial Sequence: Synthetic coding sequence
atgagcggcgccgtgctgctggagagagagagactgaccagcggcaccacctggcacaccgccggcctgctgtggcagctgagacccagcgacgtggaggtggagctgctggcccacaccagaagagtggtgagcagagagctggaggaggagaccggcctgcacaccggctggatccagaacggcggcctgttcatcgccagcaacagacagagactggacgagtacaagagactgatgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagaacatgcccaacgtgagagaccacgacgccagcgtgtacctgagactgcagggcgacgccctgagcgtgggcggctacgaggccaaccccatcttctgggaggaggccgtgaagtacagacccagagccgccggcggcctgtgcctgaagaccagcaccgagaaggtgtgcgccgtgtggagcgacgacctgagaagagcctag

SEQ ID NO: 10811 - DNA, 1107 bp, Artificial Sequence
  Description of Artificial Sequence: Synthetic coding sequence
atgagctacttcggcaagttctacctggtgggcctggacgccagaaaggccgccgactggctgttcagcgccgacgtgagcagaccccccggcagcaccgtgtacacctgcatgctgaaccacagaggcggcaccgagagcgacctgaccgtgagcagactggcccccagccaccaggccagccccctggcccccgccttcgagggcgacggctactacctggccatgggcggcgccgtggcccagcacaactggagccacatcaccaccgtgctgcaggaccagaagagccagtgccagctgatcgacagcagcgaggacctgggcatgatcagcatccagggccccgccagcagagccatcctgcaggaggtgctggacgccgacctgagcaacgaggccttccccttcagcacccacaagctgctgagagccgccggccacctggtgagagccatgagactgagcttcgtgggcgagctgggctgggagctgcacatccccaaggccagctgcgtgcccgtgtacagagccgtgatggccgccggcgccaagcacggcctgatcaacgccggctacagagccatcgacagcctgagcatcgagaagggctacagacactggcacgccgacctgagacccgacgacagccccctggaggccggcctggccttcacctgcaagctgaagagccccgtgcccttcctgggcagagaggccctggagcagcagagagccgccggcctgagaagaagactggtgtgcttcaccatggaggagcccctgtggaccagaccccaccccgccgtgagcggcgcccccgccttcagcaccgccagcagcagcaaggtgcccatgttcggcctggaggccatctggagaaacggccaggtggtgggccacgtgagaagagccgacttcggcttcgccatcgacaagaccatcgcctacggctacatccacgaccccagcggcggccccgtgagcctggacttcgtgaagagcggcgactacgccctggagagaatgggcgtgacctacggcgcccaggcccacctgaagagccccttcgaccccaacaacaagagagtgaagggcatctactag

SEQ ID NO: 10812 - DNA, 2757 bp, Artificial Sequence
  Description of Artificial Sequence: Synthetic coding sequence
atggccagcctgagcagagccctgagagtggccgccgcccaccccagacagagccccaccagaggcatgggcccctgcaacctgagcagcgccgccggccccaccgccgagaagagcgtgccctaccagagaaccctgaaggagggccagggcaccagcgtggtggcccagggccccagcagacccctgcccagcaccgccaacgtggtggtgatcggcggcggcagcctgggctgccagaccctgtaccacctggccaagctgggcatgagcggcgccgtgctgctggagagagagagactgaccagcggcaccacctggcacaccgccggcctgctgtggcagctgagacccagcgacgtggaggtggagctgctggcccacaccagaagagtggtgagcagagagctggaggaggagaccggcctgcacaccggctggatccagaacggcggcctgttcatcgccagcaacagacagagactggacgagtacaagagactgatgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagaacatgcccaacgtgagagaccacgacgccagcgtgtacctgagactgcagggcgacgccctgagcgtgggcggctacgaggccaaccccatcttctgggaggaggtgagcgacaagttcgccttcggcctgttcgacctggactgggaggtgttcacccagcacatcgagggcgccatcaacagagtgcccgtgctggagaagaccggcatcaagagcaccgtgtgcggccccgagagcttcacccccgaccacaagcccctgatgggcgaggcccccgagctgagaggcttcttcctgggctgcggcttcaacagcgccggcatgatgctgggcggcggctgcggccaggagctggcccactggatcatccacggcagacccgagaaggacatgcacggctacgacatcagaagattccaccacagcctgaccgaccaccccagatggatcagagagagaagccacgagagctacgccaagaactacagcgtggtgttcccccacgacgagcccctggccggcagaaacatgagaagagaccccctgcacgaggagctgctgggccagggctgcgtgttccaggagagacacggctgggagagacccggctggttccaccccagaggccccgcccccgtgctggagtacgactactacggcgcctacggcagcagagcccacgaggactacgcctacagaagactgctggccgacgagtacaccttcgccttccccccccaccacgacaccatcaagaaggagtgcctggcctgcagaggcgccgccgccgtgttcgacatgagctacttcggcaagttctacctggtgggcctggacgccagaaaggccgccgactggctgttcagcgccgacgtgagcagaccccccggcagcaccgtgtacacctgcatgctgaaccacagaggcggcaccgagagcgacctgaccgtgagcagactggcccccagccaccaggccagccccctggcccccgccttcgagggcgacggctactacctggccatgggcggcgccgtggcccagcacaactggagccacatcaccaccgtgctgcaggaccagaagagccagtgccagctgatcgacagcagcgaggacctgggcatgatcagcatccagggccccgccagcagagccatcctgcaggaggtgctggacgccgacctgagcaacgaggccttccccttcagcacccacaagctgctgagagccgccggccacctggtgagagccatgagactgagcttcgtgggcgagctgggctgggagctgcacatccccaaggccagctgcgtgcccgtgtacagagccgtgatggccgccggcgccaagcacggcctgatcaacgccggctacagagccatcgacagcctgagcatcgagaagggctacagacactggcacgccgacctgagacccgacgacagccccctggaggccggcctggccttcacctgcaagctgaagagccccgtgcccttcctgggcagagaggccctggagcagcagagagccgccggcctgagaagaagactggtgtgcttcaccatggaggacaaggtgcccatgttcggcctggaggccatctggagaaacggccaggtggtgggccacgtgagaagagccgacttcggcttcgccatcgacaagaccatcgcctacggctacatccacgaccccagcggcggccccgtgagcctggacttcgtgaagagcggcgactacgccctggagagaatgggcgtgacctacggcgcccaggcccacctgaagagccccttcgaccccaacaacaagagagtgaagggcatctactag

SEQ ID NO: 10813 - DNA, 720 bp, Artificial Sequence
  Description of Artificial Sequence: Synthetic coding sequence
atggagggcaccgtggagagccagacccccgacctgagagacgtggagggcaaggtgggcagaaagacccccgagggcctgctgagaggcctgagaggcgagtgcgagctgggcaccagcggcgccctgctgctgcccggcgccagcagcaccggccacgacctgggcgacaagatcatggccctgaagatggagctggcctacctgagagccatcgacgtgaagatcctgcagcagctggtgaccctgaacgagggcatcgaggccgtgagatggctgctggaggagagaggcaccctgaccagccactgcagcagcctgaccagcagccagtacagcctgaccggcggcagccccggcagaagcagaagaggcagctgggacagcctgcccgacaccagcaccaccgacagactggacagcgtgagcatcggcagcttcctggacaccgtggcccccagcgagctggacgagcagggcccccccggcgcccccagaagcgagatggactgggccaaggtgatcgccggcggcgagagagccagaaccgaggtggacgtggccgccaccagactgggcagcctgagagccgtgtggaagccccccggcgagagactgcagggcggcccccccgagagccccgaggacgagagcgccaagctgggcttcgaggcccactggttctgggagcagtgccaggacgacgtgaccttcctgtag

SEQ ID NO: 10814 - DNA, 294 bp, Artificial Sequence
  Description of Artificial Sequence: Synthetic coding sequence
atgagcagcggcaacgccaagatcggccaccccgcccccaacttcaaggccaccgccgacgagggcatcagcttcagaggcctgttcatcatcgacgacaagggcatcctgagacagatcaccgtgaacgacctgcccgtgggcagaagcgtggacgagaccctgagactggtgcaggccttccagttcaccgacaagcacggcgaggtgtgccccgccggctggaagcccggcagcgacaccatcaagcccgacgtgcagaagagcaaggagtacttcagcaagcagaagtag

SEQ ID NO: 10815 - DNA, 1668 bp, Artificial Sequence
  Description of Artificial Sequence: Synthetic coding sequence
atggacagaagcaagagaaacagcatcgccggcttcccccccagagtggagagactggaggagttcgagggcggcggcggcggcgagggcaacgtgagccaggtgggcagagtgtggcccagcagctacagagccctgatcagcgccttcagcagactgaccagactggacgacttcacctgcgagaagatcggcagcggcttcttcagcgaggtgttcaaggtgagacacagagccagcggccaggtgatggccctgaagatgaacaccctgagcagcaacagagccaacatgctgaaggaggtgcagctgatgaacagactgagccaccccaacatcctgagatacatcaacagcggcaacctggagcagctgctggacagcaacctgcacctgccctggaccgtgagagtgaagctggcctacgacatcgccgtgggcctgagctacctgcacttcaagggcatcttccacagagacctgaccagcaagaactgcctgatcaagagagacgagaacggctacagcgccgtggtggccgacttcggcctggccgagaagatccccgacgtgagcatgggcagcgagaagctggccgtggtgggcagccccttctggatggcccccgaggtgctgagagacgagccctacaacgagaaggccgacgtgttcagctacggcatcatcctgtgcgagatcatcgccagaatccaggccgaccccgactacctgcccagaaccgagaacttcggcctggactacgacgccttccagcacatggtgggcgactgcccccccgacttcctgcagctgaccttcaactgctgcaacatggaccccaagctgagacccagcttcgtggagatcggcaagaccctggaggagatcctgagcagactgcaggaggaggagcaggagagagacagaaagctgcagcccaccgccagaggcctgctggagaaggcccccggcgtgaagagactgagcagcctggacgacaagatcccccacaagagcccctgccccagaagaaccatctggctgagcagaagccagagcgacatcttcagcagaaagccccccagaaccgtgagcgtgctggacccctactacagacccagagacggcgccgccagaacccccaaggtgaaccccttcagcgccagacaggacctgatgggcggcaagatcaagttcttcgacctgcccagcaagagcgtgatcagcctggtgttcgacctggacgcccccggccccggcaccatgcccctggccgactggcaggagcccctggccccccccatcagaagatggagaagcctgcccggcagccccgagttcctgcaccaggaggcctgccccttcgtgggcagagaggagagcctgagcgacggccccccccccagactgagcagcctgaagtacagagtgaaggagatcccccccttcagagccagcgccctgcccgccgcccaggcccacgaggccatggactgcagcatcctgcaggaggagaacggcttcggcagcagaccccagggcaccagcccctgccccgccggcgccagcgaggagatggaggtggaggagagacccgccggcagcacccccgccaccttcagcaccagcggcatcggcctgcagacccagggcaagcaggacggctag

SEQ ID NO: 10816 - DNA, 1629 bp, Artificial Sequence; identical to SEQ ID NO: 10242
  Description of Artificial Sequence: Synthetic coding sequence

SEQ ID NO: 10817 - DNA, 1716 bp, Artificial Sequence
  Description of Artificial Sequence: Synthetic coding sequence
atggacagaagcaagagaaacagcatcgccggcttcccccccagagtggagagactggaggagttcgagggcggcggcggcggcgagggcaacgtgagccaggtgggcagagtgtggcccagcagctacagagccctgatcagcgccttcagcagactgaccagactggacgacttcacctgcgagaagatcggcagcggcttcttcagcgaggtgttcaaggtgagacacagagccagcggccaggtgatggccctgaagatgaacaccctgagcagcaacagagccaacatgctgaaggaggtgcagctgatgaacagactgagccaccccaacatcctgagattcatgggcgtgtgcgtgcaccagggccagctgcacgccctgaccgagtacatcaacagcggcaacctggagcagctgctggacagcaacctgcacctgccctggaccgtgagagtgaagctggcctacgacatcgccgtgggcctgagctacctgcacttcaagggcatcttccacagagacctgaccagcaagaactgcctgatcaagagagacgagaacggctacagcgccgtggtggccgacttcggcctggccgagaagatccccgacgtgagcatgggcagcgagaagctggccgtggtgggcagccccttctggatggcccccgaggtgctgagagacgagccctacaacgagaaggccgacgtgttcagctacggcatcatcctgtgcgagatcatcgccagaatccaggccgaccccgactacctgcccagaaccgagaacttcggcctggactacgacgccttccagcacatggtgggcgactgcccccccgacttcctgcagctgaccttcaactgctgcaacatggaccccaagctgagacccagcttcgtggagatcggcaagaccctggaggagatcctgagcagactgcaggaggaggagcaggagagagacagaaagctgcagcccaccgccagaggcctgctggagaaggcccccggcgtgaagagactgagcagcctggacgacaagatcccccacaagagcccctgccccagaagaaccatctggctgagcagaagccagagcgacatcttcagcagaaagccccccagaaccgtgagcgtgctggacccctactacagacccagagacggcgccgccagaacccccaaggtgaaccccttcagcgccagacaggacctgatgggcggcaagatcaagttcttcgacctgcccagcaagagcgtgatcagcctggtgttcgacctggacgcccccggccccggcaccatgcccctggccgactggcaggagcccctggccccccccatcagaagatggagaagcctgcccggcagccccgagttcctgcaccaggaggcctgccccttcgtgggcagagaggagagcctgagcgacggccccccccccagactgagcagcctgaagtacagagtgaaggagatcccccccttcagagccagcgccctgcccgccgcccaggcccacgaggccatggactgcagcatcctgcaggaggagaacggcttcggcagcagaccccagggcaccagcccctgccccgccggcgccagcgaggagatggaggtggaggagagacccgccggcagcacccccgccaccttcagcaccagcggcatcggcctgcagacccagggcaagcaggacggctag

SEQ ID NO: 10818 - DNA, 1416 bp, Artificial Sequence
  Description of Artificial Sequence: Synthetic coding sequence
atgctgggcagctggggctgctacagatacgccaagctgttcagctgcagcctgagcacccacgccagattcatcaagatcctggacagcgtgctgcaccacctggtgcccgcctgggaccacaccctgggcaccttcagcgagatcaagcaggtgaagcagttcctgctgctgagcagacagagacccggcctggtggcccagtgcctgagagacagcgagagcagcaagcccagcttcatgcccagactgtacatcaacagaagactggccatggagcacagagcctgccccagcagagaccccgcctgcaagaacgccgtgttcacccaggtgtacgagggcctgaagcccagcgacaagtacgagaagcccctggactacagatggcccatgagatacgaccagtggtgggagtgcaagttcatcgccgagggcatcatcgaccagggcggcggcttcagagacagcctggccgacatgagcgaggagctgtgccccagcagcgccgacacccccgtgcccctgcccttcttcgtgagaaccgccaaccagggcaacggcaccggcgaggccagagacatgtacgtgcccaaccccagctgcagagacttcgccaagtacgagtggatcggccagctgatgggcgccgccctgagaggcaaggagttcctggtgctggccctgcccggcttcgtgtggaagcagctgagcggcgaggaggtgagctggagcaaggacttccccgccgtggacagcgtgctggtgaagctgctggaggtgatggagggcatggacaaggagaccttcgagttcaagttcggcaaggagctgaccttcaccaccgtgctgagcgaccagcaggtggtggagctgatccccggcggcgccggcatcgtggtgggctacggcgacagaagcagattcatccagctggtgcagaaggccagactggaggagagcaaggagcaggtggccgccatgcaggccggcctgctgaaggtggtgccccaggccgtgctggacctgctgacctggcaggagctggagaagaaggtgtgcggcgaccccgaggtgaccgtggacgccctgagaaagctgaccagattcgaggacttcgagcccagcgacagcagagtgcagtacttctgggaggccctgaacaacttcaccaacgaggacagaagcagattcctgagattcgtgaccggcagaagcagactgcccgccagaatctacatctaccccgacaagctgggctacgagaccaccgacgccctgcccgagagcagcacctgcagcagcaccctgttcctgccccactacgccagcgccaaggtgtgcgaggagaagctgagatacgccgcctacaactgcgtggccatcgacaccgacatgagcccctgggaggagtag

SEQ ID NO: 10819 - DNA, 825 bp, Artificial Sequence
  Description of Artificial Sequence: Synthetic coding sequence
atggccgcccccgaggccgaggtgctgagcagcgccgccgtgcccgacctggagtggtacgagaagagcgaggagacccacgccagccagatcgagctgctggagaccagcagcacccaggagcccctgaacgccagcgaggccttctgccccagagactgcatggtgcccgtggtgttccccggccccgtgagccaggagggctgctgccagttcacctgcgagctgctgaagcacatcatgtaccagagacagcagctgcccctgccctacgagcagctgaagcacttctacagaaagcccagcccccaggccgaggagatgctgaagaagaagcccagagccaccaccgaggtgagcagcagaaagtgccagcaggccctggccgagctggagagcgtgctgagccacctggaggacttcttcgccagaaccctggtgcccagagtgctgatcctgctgggcggcaacgccctgagccccaaggagttctacgagctggacctgagcctgctggccccctacagcgtggaccagagcctgagcaccgccgcctgcctgagaagactgttcagagccatcttcatggccgacgccttcagcgagctgcaggccccccccctgatgggcaccgtggtgatggcccagggccacagaaactgcggcgaggactggttcagacccaagctgaactacagagtgcccagcagaggccacaagctgaccgtgaccctgagctgcggcagacccagcatcagaaccaccgcctgggaggactacatctggttccaggcccccgtgaccttcaagggcttcagagagtag

SEQ ID NO: 10820 - DNA, 2586 bp, Artificial Sequence
  Description of Artificial Sequence: Synthetic coding sequence
atggccggccccggccccggcgccgtgctggagagccccagacagctgctgggcagagtgagattcctggccgaggccgccagaagcctgagagccggcagacccctgcccgccgccctggccttcgtgcccagagaggtgctgtacaagctgtacaaggaccccgccggccccagcagagtgctgctgcccgtgtgggaggccgagggcctgggcctgagagtgggcgccgccggccccgcccccggcaccggcagcggccccctgagagccgccagagacagcatcgagctgagaagaggcgcctgcgtgagaaccaccggcgaggagctgtgcaacggccacggcctgtgggtgaagctgaccaaggagcagctggccgagcacctgggcgactgcggcctgcaggagggctggctgctggtgtgcagacccgccgagggcggcgccagactggtgcccatcgacacccccaaccacctgcagagacagcagcagctgttcggcgtggactacagacccgtgctgagatgggagcaggtggtggacctgacctacagccacagactgggcagcagaccccagcccgccgaggcctacgccgaggccgtgcagagactgctgtacgtgccccccacctggacctacgagtgcgacgaggacctgatccacttcctgtacgaccacctgggcaaggaggacgagaacctgggcagcgtgaagcagtacgtggagagcatcgacgtgagcagctacaccgaggagttcaacgtgagctgcctgaccgacagcaacgccgacacctactgggagagcgacggcagccagtgccagcactgggtgagactgaccatgaagaagggcaccatcgtgaagaagctgctgctgaccgtggacaccaccgacgacaacttcatgcccaagagagtggtggtgtacggcggcgagggcgacaacctgaagaagctgagcgacgtgagcatcgacgagaccctgatcggcgacgtgtgcgtgctggaggacatgaccgtgcacctgcccatcatcgagatcagaatcgtggagtgcagagacgacggcatcgacgtgagactgagaggcgtgaagatcaagagcagcagacagagagagctgggcctgaacgccgacctgttccagcccaccagcctggtgagataccccagactggagggcaccgaccccgaggtgctgtacagaagagccgtgctgctgcagagattcatcaagatcctggacagcgtgctgcaccacctggtgcccgcctgggaccacaccctgggcaccttcagcgagatcaagcaggtgaagcagttcctgctgctgagcagacagagacccggcctggtggcccagtgcctgagagacagcgagagcagcaagcccagcttcatgcccagactgtacatcaacagaagactggccatggagcacagagcctgccccagcagagaccccgcctgcaagaacgccgtgttcacccaggtgtacgagggcctgaagcccagcgacaagtacgagaagcccctggactacagatggcccatgagatacgaccagtggtgggagtgcaagttcatcgccgagggcatcatcgaccagggcggcggcttcagagacagcctggccgacatgagcgaggagctgtgccccagcagcgccgacacccccgtgcccctgcccttcttcgtgagaaccgccaaccagggcaacggcaccggcgaggccagagacatgtacgtgcccaaccccagctgcagagacttcgccaagtacgagtggatcggccagctgatgggcgccgccctgagaggcaaggagttcctggtgctggccctgcccggcttcgtgtggaagcagctgagcggcgaggaggtgagctggagcaaggacttccccgccgtggacagcgtgctggtgaagctgctggaggtgatggagggcatggacaaggagaccttcgagttcaagttcggcaaggagctgaccttcaccaccgtgctgagcgaccagcaggtggtggagctgatccccggcggcgccggcatcgtggtgggctacggcgacagaagcagattcatccagctggtgcagaaggccagactggaggagagcaaggagcaggtggccgccatgcaggccggcctgctgaaggtggtgccccaggccgtgctggacctgctgacctggcaggagctggagaagaaggtgtgcggcgaccccgaggtgaccgtggacgccctgagaaagctgaccagattcgaggacttcgagcccagcgacagcagagtgcagtacttctgggaggccctgaacaacttcaccaacgaggacagaagcagattcctgagattcgtgaccggcagaagcagactgcccgccagaatctacatctaccccgacaagctgggctacgagaccaccgacgccctgcccgagagcagcacctgcagcagcaccctgttcctgccccactacgccagcgccaaggtgtgcgaggagaagctgagatacgccgcctacaactgcgtggccatcgacaccgacatgagcccctgggaggagtag

SEQ ID NO: 10821 - DNA, 1197 bp, Artificial Sequence
  Description of Artificial Sequence: Synthetic coding sequence
atggagagcgtgctgagcaagtacgaggaccagatcaccatcttcaccgactacctggaggagtaccccgacaccgacgagctggtgtggatcctgggcaagcagcacctgctgaagaccgagaagagcaagctgctgagcgacatcagcgccagactgtggttcacctacagaagaaagttcagccccatcggcggcaccggccccagcagcgacgccggctggggctgcatgctgagatgcggccagatgatgctggcccaggccctgatctgcagacacctgggcagagactggagctgggagaagcagaaggagcagcccaaggagtaccagagaatcctgcagtgcttcctggacagaaaggactgctgctacagcatccaccagatggcccagatgggcgtgggcgagggcaagagcatcggcgagtggttcggccccaacaccgtggcccaggtgctgaagaagctggccctgttcgacgagtggaacagcctggccgtgtacgtgagcatggacaacaccgtggtgatcgaggacatcaagaagatgtgcagagtgctgcccctgagcgccgacaccgccggcgacagaccccccgacagcctgaccgccagcaaccagagcaagggcaccagcgcctactgcagcgcctggaagcccctgctgctgatcgtgcccctgagactgggcatcaaccagatcaaccccgtgtacgtggacgccttcaaggagtgcttcaagatgccccagagcctgggcgccctgggcggcaagcccaacaacgcctactacttcatcggcttcctgggcgacgagctgatcttcctggacccccacaccacccagaccttcgtggacaccgaggagaacggcaccgtgaacgaccagaccttccactgcctgcagagcccccagagaatgaacatcctgaacctggaccccagcgtggccctgggcttcttctgcaaggaggagaaggacttcgacaactggtgcagcctggtgcagaaggagatcctgaaggagaacctgagaatgttcgagctggtgcagaagcaccccagccactggccccccttcgtgccccccgccaagcccgaggtgaccaccaccggcgccgagttcatcgacagcaccgagcagctggaggagttcgacctggaggaggacttcgagatcctgagcgtgtag

SEQ ID NO: 10822 - DNA, 1701 bp, Artificial Sequence; identical to SEQ ID NO: 10391
  Description of Artificial Sequence: Synthetic coding sequence

SEQ ID NO: 10823 - DNA, 930 bp, Artificial Sequence
  Description of Artificial Sequence: Synthetic coding sequence
atgcccagagccagaagcggcagaagaagcagaggcgccggcggcagagaggagaccttcctgagagtgagagccaacagacagaccagactgaacgccagaatcggcaagatgaagagaagaaagcaggacgagggccaggtgtgccccctgtgcaacagacccctggccggcagcgagcaggagatgagcagacacgtggagcactgcctgagcaagagagagggcagctgcatggccgaggacgacgccgtggacatcgagcacgagaacaacaacagattcgaggagtacgagtggtgcggccagaagagaatcagagccaccaccctgctggagggcggcttcagaggcagcggcttcatcatgtgcagcggcaaggagaaccccgacagcgacgccgacctggacgtggacggcgacgacaccctggagtacggcaagccccagtacaccgaggccgacgtgatcccctgcaccggcgaggagcccggcgaggccaaggagagagaggccctgagaggcgccgtgctgaacggcggcccccccagcaccagaatcacccccgagttcagcaagtgggccagcgacgccgagatgcccagcaccagcaacggcgagagcagcaagcaggaggccatgcagaagacctgcaagaacagcgacatcgagaagatcaccgaggacagcgccgtgaccaccttcgaggccctgaaggccagagtgagagagctggagagacagctgagcagaggcgacagatacaagtgcctgatctgcatggacagctacagcatgcccctgaccagcatccagtgctggcacgtgcactgcgaggagtgctggctgagaaccctgggcgccaagaagctgtgcccccagtgcaacaccatcaccgcccccggcgacctgagaagaatctacctgtag

SEQ ID NO: 10824 - DNA, 1125 bp, Artificial Sequence
  Description of Artificial Sequence: Synthetic coding sequence
atggagagcgtgctgagcaagtacgaggaccagatcaccatcttcaccgactacctggaggagtaccccgacaccgacgagctggtgtggatcctgggcaagcagcacctgctgaagaccggcggcaccggccccagcagcgacgccggctggggctgcatgctgagatgcggccagatgatgctggcccaggccctgatctgcagacacctgggcagagactggagctgggagaagcagaaggagcagcccaaggagtaccagagaatcctgcagtgcttcctggacagaaaggactgctgctacagcatccaccagatggcccagatgggcgtgggcgagggcaagagcatcggcgagtggttcggccccaacaccgtggcccaggtgctgaagaagctggccctgttcgacgagtggaacagcctggccgtgtacgtgagcatggacaacaccgtggtgatcgaggacatcaagaagatgtgcagagtgctgcccctgagcgccgacaccgccggcgacagaccccccgacagcctgaccgccagcaaccagagcaagggcaccagcgcctactgcagcgcctggaagcccctgctgctgatcgtgcccctgagactgggcatcaaccagatcaaccccgtgtacgtggacgccttcaaggagtgcttcaagatgccccagagcctgggcgccctgggcggcaagcccaacaacgcctactacttcatcggcttcctgggcgacgagctgatcttcctggacccccacaccacccagaccttcgtggacaccgaggagaacggcaccgtgaacgaccagaccttccactgcctgcagagcccccagagaatgaacatcctgaacctggaccccagcgtggccctgggcttcttctgcaaggaggagaaggacttcgacaactggtgcagcctggtgcagaaggagatcctgaaggagaacctgagaatgttcgagctggtgcagaagcaccccagccactggccccccttcgtgccccccgccaagcccgaggtgaccaccaccggcgccgagttcatcgacagcaccgagcagctggaggagttcgacctggaggaggacttcgagatcctgagcgtgtag

SEQ ID NO: 10825 - DNA, 558 bp, Artificial Sequence
  Description of Artificial Sequence: Synthetic coding sequence
atggagggctgcgtgagcaacctgatggtgtgcaacctggcctacagcggcaagctggaggagctgaaggagagcatcctggccgacaagagcctggccaccagaaccgaccaggacagcagaaccgccctgcactgggcctgcagcgccggccacaccgagatcgtggagttcctgctgcagctgggcgtgcccgtgaacgacaaggacgacgccgccagcaagaacagacacgagatcgccgtgatgctgctggagggcggcgccaaccccgacgccaaggaccactacgaggccaccgccatgcacagagccgccgccaagggcaacctgaagatgatccacatcctgctgtactacaaggccagcaccaacatccaggacaccgagggcaacacccccctgcacctggcctgcgacgaggagagagtggaggaggccaagctgctggtgagccagggcgccagcatctacatcgagaacaaggaggagaagacccccctgcaggtggccaagggcggcctgggcctgatcctgaagagaatggtggagggctag

SEQ ID NO: 10826 - DNA, 333 bp, Artificial Sequence
  Description of Artificial Sequence: Synthetic coding sequence
atggagggctgcgtgagcaacctgatggtgtgcaacctggcctacagcggcaagctggaggagctgaaggagagcatcctggccgacaagagcctggccaccagaaccgaccaggacagcagaaccgccctgcactgggcctgcagcgccggccacaccgagatcgtggagttcctgctgcagctgggcgtgcccgtgaacgacaaggacgacgccgccagcaagaacagacacgagatcgccgtgatgctgctggagggcggcgccaaccccgacgccaaggaccactacgaggccaccgccatgcacagagccgccgccaaggacacctag

SEQ ID NO: 10827 - DNA, 546 bp, Artificial Sequence
  Description of Artificial Sequence: Synthetic coding sequence
atggtgctgggcgccggctggggctgggcctaccagctgcacctgctgcaggccctgaagagaaagcccgacctgttcctgtgcgagagactggacgtgaaggccgtgttccagtgcgccgtgctggccctgaagttccccgaggcccccaccgtgaaggccagctgcggcttcttcaccgagctgctgcccagatgcggcgaggtggagagcgtgggcaaggtggtgcaggaggacggcagaatgctgctgatcgccgtgctggaggccatcggcggccaggccagcagaagcctgatggactgcttcgccgacatcctgttcgccctgaacaagcactgcttcagcctgctgagcatgtggatcaaggaggccctgcagccccccggcttccccagcgccagactgagccccgagcagaaggacaccttcagccagcagatcctgagagagagagtgaacaagagaagagtgaaggagatggtgaaggagttcaccctgctgtgcagaggcctgcacggcaccgactacaccgccgactactag

SEQ ID NO: 10828 - DNA, 2892 bp, Artificial Sequence
  Description of Artificial Sequence: Synthetic coding sequence
atggagagaagagaggagcagcccggcgccgccggcgccggcgccgcccccgccctggacttcaccgtggagaacgtggagaaggccctgcaccagctgtactacgaccccaacatcgagaacaagaacctggcccagaagtggctgatgcaggcccaggtgagcccccaggcctggcacttcagctggcagctgctgcagcccgacaaggtgcccgagatccagtacttcggcgccagcgccctgcacatcaagatcagcagatactggagcgacatccccaccgaccagtacgagagcctgaaggcccagctgttcacccagatcaccagattcgccagcggcagcaagatcgtgctgaccagactgtgcgtggccctggccagcctggccctgagcatgatgcccgacgcctggccctgcgccgtggccgacatggtgagactgttccaggccgaggacagccccgtggacggccagggcagatgcctggccctgctggagctgctgaccgtgctgcccgaggagttccagaccagcagactgccccagtacagaaagggcctggtgagaaccagcctggccgtggagtgcggcgccgtgttccccctgctggagcagctgctgcagcagcccagcagccccagctgcgtgagacagaaggtgctgaagtgcttcagcagctgggtgcagctggaggtgcccctgcaggactgcgaggccctgatccaggccgccttcgccgccctgcaggacagcgagctgttcgacagcagcgtggaggccatcgtgaacgccatcagccagcccgacgcccagagatacgtgaacaccctgctgaagctgatccccctggtgctgggcctgcaggagcagctgagacaggccgtgcagaacggcgacatggagaccagccacggcatctgcagaatcgccgtggccctgggcgagaaccacagcagagccctgctggaccaggtggagcactggcagagcttcctggccctggtgaacatgatcatgttctgcaccggcatccccggccactaccccgtgaacgagaccaccagcagcctgaccctgaccttctggtacaccctgcaggacgacatcctgagcttcgaggccgagaagcaggccgtgtaccagcaggtgtacagacccgtgtacttccagctggtggacgtgctgctgcacaaggcccagttccccagcgacgaggagtacggcttctggagcagcgacgagaaggagcagttcagaatctacagagtggacatcagcgacaccctgatgtacgtgtacgagatgctgggcgccgagctgctgagcaacctgtacgacaagctgggcagactgctgaccagcagcgaggagccctacagctggcagcacaccgaggccctgctgtacggcttccagagcatcgccgagaccatcgacgtgaactacagcgacgtggtgcccggcctgatcggcctgatccccagaatcagcatcagcaacgtgcagctggccgacaccgtgatgttcaccatcggcgccctgagcgagtggctggccgaccaccccgtgatgatcaacagcgtgctgcccctggtgctgcacgccctgggcaaccccgagctgagcgtgagcagcgtgagcaccctgaagaagatctgcagagagtgcaagtacgacctgcccccctacgccgccaacatcgtggccgtgagccaggacgtgctgatgaagcagatccacaagaccagccagtgcatgtggctgatgcaggccctgggcttcctgctgagcgccctgcaggtggaggagatcctgaagaacctgcacagcctgatcagcccctacatccagcagctggagaagctggccgaggagatccccaaccccagcaacaagctggccatcgtgcacatcctgggcctgctgagcaacctgttcaccaccctggacatcagccaccacgaggacgaccacgagggccccgagctgagaaagctgcccgtgccccagggccccaaccccgtggtggtggtgctgcagcaggtgttccagctgatccagaaggtgctgagcaagtggctgaacgacgcccaggtggtggaggccgtgtgcgccatcttcgagaagagcgtgaagaccctgctggacgacttcgcccccatggtgccccagctgtgcgagatgctgggcagaatgtacagcaccatcccccaggccagcgccctggacctgaccagacagctggtgcacatcttcgcccacgagcccgcccacttcccccccatcgaggccctgttcctgctggtgaccagcgtgaccctgaccctgttccagcagggccccagagaccaccccgacatcgtggacagcttcatgcagctgctggcccaggccctgaagagaaagcccgacctgttcctgtgcgagagactggacgtgaaggccgtgttccagtgcgccgtgctggccctgaagttccccgaggcccccaccgtgaaggccagctgcggcttcttcaccgagctgctgcccagatgcggcgaggtggagagcgtgggcaaggtggtgcaggaggacggcagaatgctgctgatcgccgtgctggaggccatcggcggccaggccagcagaagcctgatggactgcttcgccgacatcctgttcgccctgaacaagcactgcttcagcctgctgagcatgtggatcaaggaggccctgcagccccccggcttccccagcgccagactgagccccgagcagaaggacaccttcagccagcagatcctgagagagagagtgaacaagagaagagtgaaggagatggtgaaggagttcaccctgctgtgcagaggcctgcacggcaccgactacaccgccgactactag

SEQ ID NO: 10829 - DNA, 2907 bp, Artificial Sequence
  Description of Artificial Sequence: Synthetic coding sequence
atgagactgctgagacacaccgagagcgagcagtggttccacagattccccctgtgccccagcctgaccttctgggcccccgtggccatgtggccccagacccactgcgtgggcggcagaagcagcggcctgaccaagtggacctacagcttcagcgccagcctgcaggacggcagcttcccctacgacagcgtgccctggcagcagaacaccaaccagccccccggcagcctgagcgtggtgaccaccgtgtggggcgtgaccaacaccagccagagccaggccgacgtgctgatcccccacgccacctgcagacccggccccctgctgatcaccgcctgggagccctacggccagtgccagcagccccacgagagcagaagacagccccacggcgtgggccacgaccaccagcagcccagaccccagctgcccaccgtgtgcggcgccgccgccgccgtgctgagccagggctggcccagaagcgccctgcaccccgccgagcacgtgtggcccgcccagctgcccagacagagaggcctgtggggccagcccgccgccgccgccgccgccgccgccgtggccgccgccgccgccaccgccaccgccaccgccaccgccaccgtggccgccctgcaggagacccagaacaaggacatcaaccagtacggccccgcccccgtgctgctgcccgacctgctgaaggacggcctgggcgacgaggagagaggcgcccccatcggcatgcagaacagcatgaaccccgccagcatggccgccggcatgacccccagcggcatgagcggcccccccatgggcatgaaccagcccagaccccccggcatcagccccttcggcacccacggccagagaatgccccagcagacctaccccggccccagaccccagagcctgcccatccagaacatcaagagaccctaccccggcgagcccaactacggcaaccagcagtacggccccaacagccagttccccacccagcccggccagtaccccgcccccaacccccccagacccctgaccagccccaactaccccggccagagaatgcccagccagcccagcagcggccagtaccccccccccaccgtgaacatgggccagtactacaagcccgagcagttcaacggccagaacaacaccttcagcggcagcagctacagcaactacagccagggcaacgtgaacagaccccccagacccgtgcccgtggccaactacccccacagccccgtgcccggcaaccccaccccccccatgacccccggcagcagcatccccccctacctgagccccagccaggacgtgaagccccccttcccccccgacatcaagcccaacatgagcgccctgccccccccccccgaccacaacgacgagctgagactgaccttccccgtgagagacggcgtggtgctggagcccttcagactggagcacaacctggccgtgagcaaccacgtgttccacctgagacccaccgtgcaccagaccctgatgtggagcgacctggagctgcagttcaagtgctaccaccacgaggacagacagatgaacaccaactggcccgccagcgtgcaggtgagcgtgaacgccacccccctgaccatcgagagaggcgacaacaagaccagccacaagcccctgcacctgaagcacgtgtgccagcccggcagaaacaccatccagatcaccgtgaccgcctgctgctgcagccacctgttcgtgctgcagctggtgcacagacccagcgtgagaagcgtgctgcagggcctgctgaagaagagactgctgcccgccgagcactgcatcaccaagaagagaaacttcagcagcgtggccgccagcagcggcaacaccaccctgaacggcgaggacggcgtggagcagaccgccatcaaggtgagcctgaagtgccccatcaccttcagaagaatccagctgcccgccagaggccacgactgcaagcacgtgcagtgcttcgacctggagagctacctgcagctgaactgcgagagaggcacctggagatgccccgtgtgcaagaccgccctgctggagggcctggaggtggaccagtacatgtggggcatcctgaacgccatccacagcgagttcgaggaggtgaccatcgaccccacctgcagctggagacccgtgcccatcaagagcgacctgcacatcaaggacgaccccgacggcatccccagcaagagattcaagaccatgagccccagccagatgatcatgcccaacgtgatggagatgatcgccgccctgggccccggccccagcccctaccccctgccccccccccccggcggcaccaacagcaacgactacagcagccagaacaactaccagggccacggcaacttcgacttcccccacggcaaccccggcggcaccagcatgaacgacttcatgcacggccccccccagctgagccacccccccgacatgcccaacaacatggccgccctggagaagcccctgagccaccccatgcaggagaccatgccccacgccggcagcagcgaccagccccaccccagcatccagcagggcctgcacgtgccccaccccagcagccagagcggcccccccctgcaccacagcggcgcccccccccccccccccagccagccccccagacagcccccccaggccgcccccagcagccacccccacagcgacctgaccttcaaccccagcagcgccctggagggccaggccggcgcccagggcgccagcgacatgcccgagcccagcctggacctgctgcccgagctgaccaaccccgacgagctgctgagctacctggacccccccgacctgcccagcaacagcaacgacgacctgctgagcctgttcgagaacaactag

SEQ ID NO: 10830 - DNA, 603 bp, Artificial Sequence
  Description of Artificial Sequence: Synthetic coding sequence
atggccatggagatgagactgcccgtggccagaaagcccctgagcgagagactgggcagagacaccaagaagcacctggtggtgcccggcgacaccatcaccaccgacaccggcttcatgagaggccacggcacctacatgggcgaggagaagctgatcgccagcgtggccggcagcgtggagagagtgaacaagctgatctgcgtgaaggccctgaagaccagatacatcggcgaggtgggcgacatcgtggtgggcagaatcaccgaggtgcagcagaagagatggaaggtggagaccaacagcagactggacagcgtgctgctgctgagcagcatgaacctgcccggcggcgagctgagaagaagaagcgccgaggacgagctggccatgagaggcttcctgcaggagggcgacctgatcagcgccgaggtgcaggccgtgttcagcgacggcgccgtgagcctgcacaccagaagcctgaagtacggcaagacccacttccacgacctgccctgcggcgccagcgtgatcctgggcaacaacggcttcatctggatctaccccacccccgagcacaaggaggaggaggccggcggctag

SEQ ID NO: 10831 - DNA, 792 bp, Artificial Sequence
  Description of Artificial Sequence: Synthetic coding sequence
atggccatggagatgagactgcccgtggccagaaagcccctgagcgagagactgggcagagacaccaagaagcacctggtggtgcccggcgacaccatcaccaccgacaccggcttcatgagaggccacggcacctacatgggcgaggagaagctgatcgccagcgtggccggcagcgtggagagagtgaacaagctgatctgcgtgaaggccctgaagaccagatacatcggcgaggtgggcgacatcgtggtgggcagaatcaccgagagaagaagaagcgccgaggacgagctggccatgagaggcttcctgcaggagggcgacctgatcagcgccgaggtgcaggccgtgttcagcgacggcgccgtgagcctgcacaccagaagcctgaagtacggcaagctgggccagggcgtgctggtgcaggtgagccccagcctggtgaagagacagaagacccacttccacgacctgccctgcggcgccagcgtgatcctgggcaacaacggcttcatctggatctaccccacccccgagcacaaggaggaggaggccggcggcttcatcgccaacctggagcccgtgagcctggccgacagagaggtgatcagcagactgagaaactgcatcatcagcctggtgacccagagaatgatgctgtacgacaccagcatcctgtactgctacgaggccagcctgccccaccagatcaaggacatcctgaagcccgagatcatggaggagatcgtgatggagaccagacagagactgctggagcaggagggctag

SEQ ID NO: 10832 - DNA, 858 bp, Artificial Sequence
  Description of Artificial Sequence: Synthetic coding sequence
atggccatggagatgagactgcccgtggccagaaagcccctgagcgagagactgggcagagacaccaagaagcacctggtggtgcccggcgacaccatcaccaccgacaccggcttcatgagaggccacggcacctacatgggcgaggagaagctgatcgccagcgtggccggcagcgtggagagagtgaacaagctgatctgcgtgaaggccctgaagaccagatacatcggcgaggtgggcgacatcgtggtgggcagaatcaccgaggtgcagcagaagagatggaaggtggagaccaacagcagactggacagcgtgctgctgctgagcagcatgaacctgcccggcggcgagctgagaagaagaagcgccgaggacgagctggccatgagaggcttcctgcaggagggcgacctgatcagcgccgaggtgcaggccgtgttcagcgacggcgccgtgagcctgcacaccagaagcctgaagtacggcaaggtgagccccagcctggtgaagagacagaagacccacttccacgacctgccctgcggcgccagcgtgatcctgggcaacaacggcttcatctggatctaccccacccccgagcacaaggaggaggaggccggcggcttcatcgccaacctggagcccgtgagcctggccgacagagaggtgatcagcagactgagaaactgcatcatcagcctggtgacccagagaatgatgctgtacgacaccagcatcctgtactgctacgaggccagcctgccccaccagatcaaggacatcctgaagcccgagatcatggaggagatcgtgatggagaccagacagagactgctggagcaggagggctag

SEQ ID NO: 10833 - DNA, 882 bp, Artificial Sequence
  Description of Artificial Sequence: Synthetic coding sequence
atggccatggagatgagactgcccgtggccagaaagcccctgagcgagagactgggcagagacaccaagaagcacctggtggtgcccggcgacaccatcaccaccgacaccggcttcatgagaggccacggcacctacatgggcgaggagaagctgatcgccagcgtggccggcagcgtggagagagtgaacaagctgatctgcgtgaaggccctgaagaccagatacatcggcgaggtgggcgacatcgtggtgggcagaatcaccgaggtgcagcagaagagatggaaggtggagaccaacagcagactggacagcgtgctgctgctgagcagcatgaacctgcccggcggcgagctgagaagaagaagcgccgaggacgagctggccatgagaggcttcctgcaggagggcgacctgatcagcgccgaggtgcaggccgtgttcagcgacggcgccgtgagcctgcacaccagaagcctgaagtacggcaagctgggccagggcgtgctggtgcaggtgagccccagcctggtgaagagacagaagacccacttccacgacctgccctgcggcgccagcgtgatcctgggcaacaacggcttcatctggatctaccccacccccgagcacaaggaggaggaggccggcggcttcatcgccaacctggagcccgtgagcctggccgacagagaggtgatcagcagactgagaaactgcatcatcagcctggtgacccagagaatgatgctgtacgacaccagcatcctgtactgctacgaggccagcctgccccaccagatcaaggacatcctgaagcccgagatcatggaggagatcgtgatggagaccagacagagactgctggagcaggagggctag

SEQ ID NO: 10834 - DNA, 3195 bp, Artificial Sequence
  Description of Artificial Sequence: Synthetic coding sequence
atggccagcgagagcgagaccctgaaccccagcgccagaatcatgaccttctaccccaccatggaggagttcagaaacttcagcagatacatcgcctacatcgagagccagggcgcccacagagccggcctggccaaggtggtgccccccaaggagtggaagcccagagccagctacgacgacatcgacgacctggtgatccccgcccccatccagcagctggtgaccggccagagcggcctgttcacccagtacaacatccagaagaaggccatgaccgtgagagagttcagaaagatcgccaacagcgacaagtactgcacccccagatacagcgagttcgaggagctggagagaaagtactggaagaacctgaccttcaacccccccatctacggcgccgacgtgaacggcaccctgtacgagaagcacgtggacgagtggaacatcggcagactgagaaccatcctggacctggtggagaaggagagcggcatcaccatcgagggcgtgaacaccccctacctgtacttcggcatgtggaagaccagcttcgcctggcacaccgaggacatggacctgtacagcatcaactacctgcacttcggcgagcccaagagctggtacagcgtgccccccgagcacggcaagagactggagagactggccaagggcttcttccccggcagcgcccagagctgcgaggccttcctgagacacaagatgaccctgatcagccccctgatgctgaagaagtacggcatccccttcgacaaggtgacccaggaggccggcgagttcatgatcaccttcccctacggctaccacgccggcttcaaccacggcttcaactgcgccgagagcaccaacttcgccaccagaagatggatcgagtacggcaagcaggccgtgctgtgcagctgcagaaaggacatggtgaagatcagcatggacgtgttcgtgagaaagttccagcccgagagatacaagctgtggaaggccggcaaggacaacaccgtgatcgaccacaccctgcccacccccgaggccgccgagttcctgaaggagagcgagctgccccccagagccggcaacgaggaggagtgccccgaggaggacatggagggcgtggaggacggcgaggagggcgacctgaagaccagcctggccaagcacagaatcggcaccaagagacacagagtgtgcctggagatcccccaggaggtgagccagagcgagctgttccccaaggaggacctgagcagcgagcagtacgagatgaccgagtgccccgccgccctggcccccgtgagacccacccacagcagcgtgagacaggtggaggacggcctgaccttccccgactacagcgacagcaccgaggtgaagttcgaggagctgaagaacgtgaagctggaggaggaggacgaggaggaggagcaggccgccgccgccctggacctgagcgtgaaccccgccagcgtgggcggcagactggtgttcagcggcagcaagaagaagagcagcagcagcctgggcagcggcagcagcagagacagcatcagcagcgacagcgagaccagcgagcccctgagctgcagagcccagggccagaccggcgtgctgaccgtgcacagctacgccaagggcgacggcagagtgaccgtgggcgagccctgcaccagaaagaagggcagcgccgccagaagcttcagcgagagagagctggccgaggtggccgacgagtacatgttcagcctggaggagaacaagaagagcaagggcagaagacagcccctgagcaagctgcccagacaccaccccctggtgctgcaggagtgcgtgagcgacgacgagaccagcgagcagctgacccccgaggaggaggccgaggagaccgaggcctgggccaagcccctgagccagctgtggcagaacagaccccccaacttcgaggccgagaaggagttcaacgagaccatggcccagcaggccccccactgcgccgtgtgcatgatcttccagacctaccaccaggtggagttcggcggcttcaaccagaactgcggcaacgccagcgacctggccccccagaagcagagaaccaagcccctgatccccgagatgtgcttcaccagcaccggctgcagcaccgacatcaacctgagcaccccctacctggaggaggacggcaccagcatcctggtgagctgcaagaagtgcagcgtgagagtgcacgccagctgctacggcgtgccccccgccaaggccagcgaggactggatgtgcagcagatgcagcgccaacgccctggaggaggactgctgcctgtgcagcctgagaggcggcgccctgcagagagccaacgacgacagatgggtgcacgtgagctgcgccgtggccatcctggaggccagattcgtgaacatcgccgagagaagccccgtggacgtgagcaagatccccctgcccagattcaagctgaagtgcatcttctgcaagaagagaagaaagagaaccgccggctgctgcgtgcagtgcagccacggcagatgccccaccgccttccacgtgagctgcgcccaggccgccggcgtgatgatgcagcccgacgactggcccttcgtggtgttcatcacctgcttcagacacaagatccccaacctggagagagccaagggcgccctgcagagcatcaccgccggccagaaggtgatcagcaagcacaagaacggcagattctaccagtgcgaggtggtgagactgaccaccgagaccttctacgaggtgaacttcgacgacggcagcttcagcgacaacctgtaccccgaggacatcgtgagccaggactgcctgcagttcggcccccccgccgagggcgaggtggtgcaggtgagatggaccgacggccaggtgtacggcgccaagttcgtggccagccaccccatccagatgtaccaggtggagttcgaggacggcagccagctggtggtgaagagagacgacgtgtacaccctggacgaggagctgcccaagagagtgaagagcagactgagcgtggccagcgacatgagattcaacgagatcttcaccgagaaggaggtgaagcaggagaagaagagacagagagtgatcaacagcagatacagagaggactacatcgagcccgccctgtacagagccatcatggagtag

SEQ ID NO: 10835 - DNA, 2745 bp, Artificial Sequence; identical to SEQ ID NO: 9882
  Description of Artificial Sequence: Synthetic coding sequence

SEQ ID NO: 10836 - DNA, 1215 bp, Artificial Sequence
  Description of Artificial Sequence: Synthetic coding sequence
atggacttcaacatgaagaagctggccagcgacgccggcatcttcttcaccagagccgtgcagttcaccgaggagaagttcggccaggccgagaagaccgagctggacgcccacttcgagaacctgctggccagagccgacagcaccaagaactggaccgagaagatcctgagacagaccgaggtgctgctgcagcccaaccccagcgccagagtggaggagttcctgtacgagaagctggacagaaaggtgcccagcagagtgaccaacggcgagctgctggcccagtacatggccgacgccgccagcgagctgggccccaccaccccctacggcaagaccctgatcaaggtggccgaggccgagaagcagctgggcgccgccgagagagacttcatccacaccgccagcatcagcttcctgacccccctgagaaacttcctggagggcgactggaagaccatcagcaaggagagaagactgctgcagaacagaagactggacctggacgcctgcaaggccagactgaagaaggccaaggccgccgaggccaaggccacctgcgagggcgacaccgtgcccgacttccaggagaccagacccagaaactacatcctgagcgccagcgccagcgccctgtggaacgacgaggtggacaaggccgagcaggagctgagagtggcccagaccgagttcgacagacaggccgaggtgaccagactgctgctggagggcatcagcagcacccacgtgaaccacctgagatgcctgcacgagttcgtgaagagccagaccacctactacgcccagtgctacagacacatgctggacctgcagaagcagctgggcagcagccagggcgccatcttccccggcaccttcgtgggcaccaccgagcccgccagcccccccctgagcagcaccagccccaccaccgccgccgccaccatgcccgtggtgcccagcgtggccagcctggccccccccggcgaggccagcctgtgcctggaggaggtggccccccccgccagcggcaccagaaaggccagagtgctgtacgactacgaggccgccgacagcagcgagctggccctgctggccgacgagctgatcaccgtgtacagcctgcccggcatggaccccgactggctgatcggcgagagaggcaacaagaagggcaaggtgcccgtgacctacctggagctgctgagctag

SEQ ID NO: 10837 - DNA, 1188 bp, Artificial Sequence
  Description of Artificial Sequence: Synthetic coding sequence
atggacttcaacatgaagaagctggccagcgacgccggcatcttcttcaccagagccgtgcagttcaccgaggagaagttcggccaggccgagaagaccgagctggacgcccacttcgagaacctgctggccagagccgacagcaccaagaactggaccgagaagatcctgagacagaccgaggtgctgctgcagcccaaccccagcgccagagtggaggagttcctgtacgagaagctggacagaaaggtgcccagcagagtgaccaacggcgagctgctggcccagtacatggccgacgccgccagcgagctgggccccaccaccccctacggcaagaccctgatcaaggtggccgaggccgagaagcagctgggcgccgccgagagagacttcatccacaccgccagcatcagcttcctgacccccctgagaaacttcctggagggcgactggaagaccatcagcaaggagagaagactgctgcagaacagaagactggacctggacgcctgcaaggccagactgaagaaggccaaggccgccgaggccaaggccaccaccgtgcccgacttccaggagaccagacccagaaactacatcctgagcgccagcgccagcgccctgtggaacgacgaggtggacaaggccgagcaggagctgagagtggcccagaccgagttcgacagacaggccgaggtgaccagactgctgctggagggcatcagcagcacccacgtgaaccacctgagatgcctgcacgagttcgtgaagagccagaccacctactacgcccagtgctacagacacatgctggacctgcagaagcagctgggcagattccccggcaccttcgtgggcaccaccgagcccgccagcccccccctgagcagcaccagccccaccaccgccgccgccaccatgcccgtggtgcccagcgtggccagcctggccccccccggcgaggccagcctgtgcctggaggaggtggccccccccgccagcggcaccagaaaggccagagtgctgtacgactacgaggccgccgacagcagcgagctggccctgctggccgacgagctgatcaccgtgtacagcctgcccggcatggaccccgactggctgatcggcgagagaggcaacaagaagggcaaggtgcccgtgacctacctggagctgctgagctag

SEQ ID NO: 10838 - DNA, 1188 bp, Artificial Sequence; identical to SEQ ID NO: 10837
  Description of Artificial Sequence: Synthetic coding sequence

SEQ ID NO: 10839 - DNA, 615 bp, Artificial Sequence
  Description of Artificial Sequence: Synthetic coding sequence
atgagctggacctgccccagatgccagcagcccgtgttcttcgccgagaaggtgagcagcctgggcaagaactggcacagattctgcctgaagtgcgagagatgccacagcatcctgagccccggcggccacgccgagcacaacggcagaccctactgccacaagccctgctacggcgccctgttcggccccagaggcgtgaacatcggcggcgtgggcagctacctgtacaacccccccacccccagccccggctgcaccacccccctgagccccagcagcttcagcccccccagacccagaaccggcctgccccagggcaagaagagccccccccacatgaagaccttcaccggcgagaccagcctgtgccccggctgcggcgagcccgtgtacttcgccgagaaggtgatgagcctgggcagaaactggcacagaccctgcctgagatgccagagatgccacaagaccctgaccgccggcagccacgccgagcacgacggcgtgccctactgccacgtgccctgctacggctacctgttcggccccaagggcgtgaacatcggcgacgtgggctgctacatctacgaccccgtgaagatcaagttcaagtag

SEQ ID NO: 10840 - DNA, 1221 bp, Artificial Sequence
  Description of Artificial Sequence: Synthetic coding sequence
atggagagcctgagaggctacacccacagcgacatcggctacagaagcctggccgtgggcgaggacatcgaggaggtgaacgacgagaagctgaccgtgaccagcctgatggccagaggcggcgaggacgaggagaacaccagaagcaagcccgagtacggcaccgaggccgagaacaacgtgggcaccgagggcagcgtgcccagcgacgaccaggacagagagggcggcggcggccacgagcccgagcagcagcaggaggagccccccctgaccaagcccgagcagcagcaggaggagccccccctgctggagctgaagcaggagcaggaggagcccccccagaccaccgtggagggcccccagcccgccgagggcccccagaccgccgagggcccccagccccccgagagaaagagaagaagaagaaccgccttcacccagttccagctgcaggagctggagaacttcttcgacgagagccagtaccccgacgtggtggccagagagagactggccgccagactgaacctgaccgaggacagagtgcaggtgtggttccagaacagaagagccaagtggaagagaaaccagagagtgctgatgctgagaaacaccgccaccgccgacctggcccaccccctggacatgttcctgggcggcgcctactacgccgcccccgccctggaccccgccctgtgcgtgcacctggtgccccagctgcccagaccccccgtgctgcccgtgccccccatgccccccagaccccccatggtgcccatgccccccagaccccccatcgcccccatgccccccatggcccccgtgccccccggcagcagaatggcccccgtgccccccggccccagaatggcccccgtgcccccctggccccccatggcccccgtgcccccctggccccccatggcccccgtgcccaccggcccccccatggcccccgtgccccccggcccccccatggccagagtgccccccggcccccccatggccagagtgccccccggcccccccatggcccccctgccccccggcccccccatggcccccctgccccccggcccccccatggcccccctgccccccggcccccccatggcccccctgccccccagaagccacgtgccccacaccggcctggcccccgtgcacatcacctgggcccccgtgatcaacagctactacgcctgccccttcttctag

SEQ ID NO: 10841 - DNA, 873 bp, Artificial Sequence
  Description of Artificial Sequence: Synthetic coding sequence
atgagccccagcgccaagaagagacccaagaacagcagagtgagcaagatgcaggacgagaagctgagagacgagaccgagcagcccgtgagcaaggtgatcgagagaaacagactgagaaccgtgctgaagaacctgagcctgctgaagctgctgaagagcagcaacagaagaatccaggagctgcacaagctggccaagagatgctggcacagcctgctgagcgtgcccaagatcctgagaatcagcagcggcgagaacagcgcctgcaacaagaccaagcagaacaacgaggagttccaggagatcggctgcagcgagaaggagctgaagagcaagaagctggagagcaccggcgaccccaagaagaaggagtacaaggagtggaagagccaggtgcagagcggcatgagaaacaaggagaagaccagcctggccgccatgcccagaaaggagaagcacatcgagcccgaggtgcccagaaccagcagagacgacagcctgaaccccggcgtgcagggcagacagcccctgaccgagggccccagagtgatcttcatcaagccctacagaaacagaacccccatgggccacatgaagcagctggacgtggccgaccagtggatctggttcgagggcctgcccaccagaatccacctgcccgcccccagagtgatgtgcagaagcagcaccctgagatgggtgaagagaagatgcaccagattctgcagcgccagcctggagatgcccatgtggcacccctacaaggtggacgtgacctggaccagagccagaggcgccagcagaggctggagaagcagacaccagctgaagggcagaaacggctggagaaacagcagagtgtacaagtag

SEQ ID NO: 10842 - DNA, 1644 bp, Artificial Sequence; identical to SEQ ID NO: 10555
  Description of Artificial Sequence: Synthetic coding sequence

SEQ ID NO: 10843 - DNA, 1881 bp, Artificial Sequence
  Description of Artificial Sequence: Synthetic coding sequence
atgtgcagcaccctgaagaagtgcggcacctacagaaccgaggtggccgagtgccacgaccacggcagcaccttccagggcagaaagaagggcggcagcagcttcagagacaacttcgacaagagaagctgccactacgagcacggcggctacgagagaccccccagccactgccaggagaacgacggcagcgtggagatgagagacgtgcacaaggaccagcagctgagacacaccccctacagcatcagatgcgagagaagaatgaagtggcacagcgaggacgagatcagaatcaccacctggagaaacagaaagccccccgagagaaagatgagccagaacacccaggacggctacaccagaaactggttcaaggtgaccatcccctacggcatcaagtacgacaaggcctggctgatgaacagcatccagagccactgcagcgacagattcacccccgtggacttccactacgtgagaaacagagcctgcttcttcgtgcaggacgccagcgccgccagcgccctgaaggacgtgagctacaagatctacgacgacgagaaccagaagatctgcatcttcgtgaaccacagcaccgccccctacagcgtgaagaacaagctgaagcccggccagatggagatgctgaagctgaccatgaacaagagatacaacgtgagccagcaggccctggacctgcagaacctgagattcgaccccgacctgatgggcagagacatcgacatcatcctgaacagaagaaactgcatggccgccaccctgaagatcatcgagagaaacttccccgagctgctgagcctgaacctgtgcaacaacaagctgtaccagctggacggcctgagcgacatcaccgagaaggcccccaaggtgaagaccctgaacctgagcaagaacaagctggagagcgcctgggagctgggcaaggtgaagggcctgaagctggaggagctgtggctggagggcaaccccctgtgcagcaccttcagcgaccagagcgcctacgtgagcgccatcagagactgcttccccaagctgctgagactggacggcagagagctgagcgcccccgtgatcgtggacatcgacagcagcgagaccatgaagccctgcaaggagaacttcaccggcagcgagaccctgaagcacctggtgctgcagttcctgcagcagtactacagcatctacgacagcggcgacagacagggcctgctgggcgcctaccacgacgaggcctgcttcagcctggccatccccttcgaccccaaggacagcgcccccagcagcctgtgcaagtacttcgaggacagcagaaacatgaagaccctgaaggacccctacctgaagggcgagctgctgagaagaaccaagagagacatcgtggacagcctgagcgccctgcccaagacccagcacgacctgagcagcatcctggtggacgtgtggtgccagaccgagagaatgctgtgcttcagcgtgaacggcgtgttcaaggaggtggagggccagagccagggcagcgtgctggccttcaccagaaccttcatcgccacccccggcagcagcagcagcctgtgcatcgtgaacgacgagctgttcgtgagagacgccagcccccaggagacccagagcgccttcagcatccccgtgagcaccctgagcagcagcagcgagcccagcctgagccaggagcagcaggagatggtgcaggccttcagcgcccagagcggcatgaagctggagtggagccagaagtgcctgcaggacaacgagtggaactacaccagagccggccaggccttcaccatgctgcagaccgagggcaagatccccgccgaggccttcaagcagatcagctag

SEQ ID NO: 10844 - DNA, 1881 bp, Artificial Sequence; identical to SEQ ID NO: 10843
  Description of Artificial Sequence: Synthetic coding sequence

SEQ ID NO: 10845 - DNA, 1230 bp, Artificial Sequence
  Description of Artificial Sequence: Synthetic coding sequence
atgaagtggcacagcgaggacgagatcagaatcaccacctggagaaacagaaagccccccgagagaaagatgagccagaacacccaggacggctacaccagaaactggttcaaggtgaccatcccctacggcatcaagtacgacaaggcctggctgatgaacagcatccagagccactgcagcgacagattcacccccgtggacttccactacgtgagaaacagagcctgcttcttcgtgcaggacgccagcgccgccagcgccctgaaggacgtgagctacaagatctacgacgacgagaaccagaagatctgcatcttcgtgaaccacagcaccgccccctacagcgtgaagaacaagctgaagcccggccagatggagatgctgaagctgaccatgaacaagagatacaacgtgagccagcaggccctggacctgcagaacctgagattcgaccccgacctgatgggcagagacatcgacatcatcctgaacagaagaaactgcatggccgccaccctgaagatcatcgagagaaacttccccgagctgctgagcctgaacctgtgcaacaacaagctgtaccagctggacggcctgagcgacatcaccgagaaggcccccaaggtgaagaccctgaacctgagcaagaacaagctggagagcgcctgggagctgggcaaggtgaagggcctgaagctggaggagctgtggctggagggcaaccccctgtgcagcaccttcagcgaccagagcgcctacgtgagcgccatcagagactgcttccccaagctgctgagactggacggcagagagctgagcgcccccgtgatcgtggacatcgacagcagcgagaccatgaagccctgcaaggagaacttcaccggcagcgagaccctgaagcacctggtgctgcagttcctgcagcagtactacagcatctacgacagcggcgacagacagggcctgctgggcgcctaccacgacgaggcctgcttcagcctggccatccccttcgaccccaaggacagcgcccccagcagcctgtgcaagtacttcgaggacagcagaaacatgaagaccctgaaggacccctacctgaagggcgagctgctgagaagaaccaagagagacatcgtggacagcctgagcgccctgcccaagacccagcacgacctgagcagcatcctggtggacgtgtggtgccagaccgtgcccagcggccagtag

SEQ ID NO: 10846 - DNA, 1326 bp, Artificial Sequence; identical to SEQ ID NO: 9196
  Description of Artificial Sequence: Synthetic coding sequence

SEQ ID NO: 10847 - DNA, 1158 bp, Artificial Sequence
  Description of Artificial Sequence: Synthetic coding sequence
atggccagcgtggccgccgccagagccgtgcccgtgggcagcggcctgagaggcctgcagagaaccctgcccctggtggtgatcctgggcgccaccggcaccggcaagagcaccctggccctgcagctgggccagagactgggcggcgagatcgtgagcgccgacagcatgcagccccaggagatgggcaccgagaaggtgatcgacagaaaggtggagctggagaaggaggacggcctggtgctgcacaagagactgagccaggtggaccccgagatggccgccaagctgcacccccacgacaagagaaaggtggccagaagcctgcaggtgttcgaggagaccggcatcagccacagcgagttcctgcacagacagcacaccgaggagggcggcggccccctgggcggccccctgaagttcagcaacccctgcatcctgtggctgcacgccgaccaggccgacgagagactggacaagagagtggacgacatgctggccgccggcctgctggaggagctgagagacttccacagaagatacaaccagaagaacgtgagcgagaacagccaggactaccagcacggcatcttccagagcatcggcttcaaggagttccacgagtacctgatcaccgagggcaagtgcaccctggagaccagcaaccagctgctgaagaagggcatcgaggccctgaagcaggtgaccaagagatacgccagaaagcagaacagatgggtgaagaacagattcctgagcagacccggccccatcgtgccccccgtgtacggcctggaggtgagcgacgtgagcaagtgggaggagagcgtgctggagcccgccctggagatcgtgcagagcttcatccagggccacaagcccaccgccacccccatcaagatgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 10848 - DNA, 987 bp, Artificial Sequence
  Description of Artificial Sequence: Synthetic coding sequence
atgaagagacccaaggagcccagcggcagcgacggcgagagcgacggccccatcgacgtgggccaggagggccagctgagccagatggccagacccctgagcacccccagcagcagccagatgcaggccagaaagaagcacagaggcatcatcgagaagagaagaagagacagaatcaacagcagcctgagcgagctgagaagactggtgcccaccgccttcgagaagcagggcagcagcaagctggagaaggccgaggtgctgcagatgaccgtggaccacctgaagatgctgcacgccaccggcggcaccggcttcttcgacgccagagccctggccgtggacttcagaagcatcggcttcagagagtgcctgaccgaggtgatcagatacctgggcgtgctggagggccccagcagcagagccgaccccgtgagaatcagactgctgagccacctgaacagctacgccgccgagatggagcccagccccacccccaccggccccctggccttccccgcctggccctggagcttcttccacagctgccccggcctgcccgccctgagcaaccagctggccatcctgggcagagtgcccagccccgtgctgcccggcgtgagcagccccgcctaccccatccccgccctgagaaccgcccccctgagaagagccaccggcatcatcctgcccgccagaagaaacgtgctgcccagcagaggcgccagcagcaccagaagagccagacccctggagagacccgccacccccgtgcccgtggcccccagcagcagagccgccagaagcagccacatcgcccccctgctgcagagcagcagccccaccccccccggccccaccggcagcgccgcctacgtggccgtgcccacccccaacagcagcagccccggccccgccggcagacccgccggcgccatgctgtaccacagctgggtgagcgagatcaccgagatcggcgccttctag

SEQ ID NO: 10849 - DNA, 2262 bp, Artificial Sequence
  Description of Artificial Sequence: Synthetic coding sequence
atggagaccttcgagcccatcagccaggagcccctgagccaggccagctacgacaaggcccccgaccccgtgcccgagctgcaggacagcttctacgccgagctgcagagagccgagagcctgcaggagaagagcatcaaggaggccaagaccaagtgcagaaccatcgccagcctgctgaccgccgcccccaacccccacagcaagggcgtgctgatgttcaagaagagaagacagagagccaagaagtacaccctggtgagcttcggcgccgccgccggcaccggcgccgaggaggaggacggcgtgccccccaccagcgagagcgagctggacgaggaggccttcagcgacgccagaagcctgaccaaccagagcgactgggacagcccctacctggacatggagctggccagagccggcagcagagccagcgagggccagggcagcggcctgggcggccagctgagcgaggtgagcggcagaggcgtgcagctgttcgagcagcagagacagagagccgacagcagcacccaggagctggccagagtggagcccgccgccatgctgaacggcgagggcctgcagagcccccccagagcccagagcgccccccccgaggccgccgtgctgccccccagccccctgcccgcccccgtggccagccccagacccttccagcccggcggcggcgcccccacccccgcccccagcatcttcaacagaagcgccagacccttcacccccggcctgcagggccagagacccaccaccaccagcgtgatcttcagacccctggcccccaagagagccaacgacagcctgggcggcctgagccccgcccccccccccttcctgagcagccagggccccacccccctgcccagcttcaccagcggcgtgcccagccacgcccccgtgagcggcagccccagcacccccagaagcagcggccccgtgaccgccaccagcagcctgtacatccccgcccccagcagacccgtgacccccggcggcgcccccgagccccccgccccccccagcgccgccgccatgaccagcaccgccagcatcttcctgagcgcccccctgagacccagcgccagacccgaggcccccgcccccggccccggcgcccccgagccccccagcgccagagagcagagaatcagcgtgcccgccgccagaaccggcatcctgcaggaggccagaagaagaggcaccagaaagcagatgttcagacccggcaaggaggagaccaagaacagccccaaccccgagctgctgagcctggtgcagaacctggacgagaagcccagagccggcggcgccgagagcggccccgaggaggacgccctgagcctgggcgccgaggcctgcaacttcatgcagcccgtgggcgccagaagctacaagaccctgccccacgtgacccccaagacccccccccccatggcccccaagacccccccccccatgacccccaagacccccccccccgtggcccccaagccccccagcagaggcctgctggacggcctggtgaacggcgccgccagcagcgccggcatccccgagccccccagactgcagggcagaggcggcgagctgttcgccaagagacagagcagagccgacagatacgtggtggagggcacccccggccccggcctgggccccagacccagaagccccagccccacccccagcctgccccccagctggaagtacagccccaacatcagagcccccccccccatcgcctacaaccccctgctgagccccttcttcccccaggccgccagaaccctgcccaaggcccagagccagggccccagagccacccccaagcagggcatcaaggccctggacttcatgagacaccagccctaccagctgaagaccgccatgttctgcttcgacgaggtgccccccacccccggccccatcgccagcggcagccccaagaccgccagagtgcaggagatcagaagattcagcacccccgccccccagcccaccgccgagcccctggcccccaccgtgctggcccccagagccgccaccaccctggacgagcccatctggagaaccgagctggccagcgcccccgtgcccagccccgcccccccccccgaggcccccagaggcctgggcgccagccccagcagctgcggcttccaggtggccagacccagattcagcgccaccagaaccggcctgcaggcccacgtgtggagacccggcgccggccaccagtag

SEQ ID NO: 10850 - DNA, 1041 bp, Artificial Sequence; identical to SEQ ID NO: 9303
  Description of Artificial Sequence: Synthetic coding sequence

SEQ ID NO: 10851 - DNA, 1569 bp, Artificial Sequence
  Description of Artificial Sequence: Synthetic coding sequence
atgagcccccagaagagagtgaagaacgtgcaggcccagaacagaaccagccagggcagcagcagcttccagaccaccctgagcgcctggaaggtgaagcaggaccccagcaacagcaagaacatcagcaagcacggccagaacaaccccgtgggcgactacgagcacgccgacgaccaggccgaggaggacgccctgcagatggccgtgggctacttcgagaagggccccatcaaggccagccagaacaaggacaagaccctggagaagcacctgaagaccgtggagaacgtggcctggaagaacggcctggccagcgaggagatcgacatcctgctgaacatcgccctgagcggcaagttcggcaacgccgtgaacaccagaatcctgaagtgcatgatccccgccaccgtgatcagcgaggacagcgtggtgaaggccgtgagctggctgtgcgtgggcaagtgcagcggcagcaccaaggtgctgttctacagatggctggtggccatgttcgacttcatcgacagaaaggagcagatcaacctgctgtacggcttcttcttcgccagcctgcaggacgacgccctgtgcccctacgtgtgccacctgctgtacctgctgaccaagaaggagaacgtgaagcccttcagagtgagaaagctgctggacctgcaggccaagatgggcatgcagccccacctgcaggccctgctgagcctgtacaagttcttcgcccccgccctgatcagcgtgagcctgcccgtgagaaagaagatctacttcaagaacagcgagaacctgtggaagaccgccctgctggccgtgaagcagagaaacagaggccccagccccgagcccctgaagctgatgctgggccccgccaacgtgagacccctgaagagaaagtggaacagcctgagcgtgatccccgtgctgaacagcagcagctacaccaaggagtgcggcaagaaggagatgagcctgagcgactgcctgaacagaagcggcagcttccccctggagcagctgcagagcttcccccagctgctgcagaacatccactgcctggagctgcccagccagatgggcagcgtgctgaacaacagcctgctgctgcactacatcaactgcgtgagagacgagcccgtgctgctgagattctactactggctgagccagaccctgcaggaggagtgcatctggtacaaggtgaacaactacgagcacggcaaggagttcaccaacttcctggacaccatcatcagagccgagtgcttcctgcaggagggcttctacagctgcgaggccttcctgtacaagagcctgcccctgtgggacggcctgtgctgcagaagccagttcctgcagctggtgagctggatccccttcagcagcttcagcgaggtgaagcccctgctgttcgaccacctggcccagctgttcttcaccagcaccatctacttcaagtgcagcgtgctgcagagcctgaaggagctgctgcagaactggctgctgtggctgagcatggacatccacatgaagcccgtgaccaacagccccctgtag

SEQ ID NO: 10852 - DNA, 2271 bp, Artificial Sequence
  Description of Artificial Sequence: Synthetic coding sequence
atgagcccccagaagagagtgaagaacgtgcaggcccagaacagaaccagccagggcagcagcagcttccagaccaccctgagcgcctggaaggtgaagcaggaccccagcaacagcaagaacatcagcaagcacggccagaacaaccccgtgggcgactacgagcacgccgacgaccaggccgaggaggacgccctgcagatggccgtgggctacttcgagaagggccccatcaaggccagccagaacaaggacaagaccctggagaagcacctgaagaccgtggagaacgtggcctggaagaacggcctggccagcgaggagatcgacatcctgctgaacatcgccctgagcggcaagttcggcaacgccgtgaacaccagaatcctgaagtgcatgatccccgccaccgtgatcagcgaggacagcgtggtgaaggccgtgagctggctgtgcgtgggcaagtgcagcggcagcaccaaggtgctgttctacagatggctggtggccatgttcgacttcatcgacagaaaggagcagatcaacctgctgtacggcttcttcttcgccagcctgcaggacgacgccctgtgcccctacgtgtgccacctgctgtacctgctgaccaagaaggagaacgtgaagcccttcagagtgagaaagctgctggacctgcaggccaagatgggcatgcagccccacctgcaggccctgctgagcctgtacaagttcttcgcccccgccctgatcagcgtgagcctgcccgtgagaaagaagatctacttcaagaacagcgagaacctgtggaagaccgccctgctggccgtgaagcagagaaacagaggccccagccccgagcccctgaagctgatgctgggccccgccaacgtgagacccctgaagagaaagtggaacagcctgagcgtgatccccgtgctgaacagcagcagctacaccaaggagtgcggcaagaaggagatgagcctgagcgactgcctgaacagaagcggcagcttccccctggagcagctgcagagcttcccccagctgctgcagaacatccactgcctggagctgcccagccagatgggcagcgtgctgaacaacagcctgctgctgcactacatcaactgcgtgagagacgagcccgtgctgctgagattctactactggctgagccagaccctgcaggaggagtgcatctggtacaaggtgaacaactacgagcacggcaaggagttcaccaacttcctggacaccatcatcagagccgagtgcttcctgcaggagggcttctacagctgcgaggccttcctgtacaagagcctgcccctgtgggacggcctgtgctgcagaagccagttcctgcagctggtgagctggatccccttcagcagcttcagcgaggtgaagcccctgctgttcgaccacctggcccagctgttcttcaccagcaccatctacttcaagtgcagcgtgctgcagagcctgaaggagctgctgcagaactggctgctgtggctgagcatggacatccacatgaagcccgtgaccaacagccccctggagaccaccctgggcggcagcatgaacagcgtgagcaagctgatccactacgtgggctggctgagcaccaccgccatgagactggagagcaacaacaccttcctgctgcacttcatcctggacttctacgagaaggtgtgcgacatctacatcaactacaacctgcccctggtggtgctgttcccccccggcatcttctacagcgccctgctgagcctggacaccagcatcctgaaccagctgtgcttcatcatgcacagatacagaaagaacctgaccgccgccaagaagaacgagctggtgcagaagaccaagagcgagttcaacttcagcagcaagacctaccaggagttcaaccactacctgaccagcatggtgggctgcctgtggaccagcaagcccttcggcaagggcatctacatcgaccccgagatcctggagaagaccggcgtggccgagtacaagaacagcctgaacgtggtgcaccaccccagcttcctgagctacgccgtgagcttcctgctgcaggagagccccgaggagagaaccgtgaacgtgagcagcatcagaggcaagaagtggagctggtacctggactacctgttcagccagggcctgcagggcctgaagctgttcatcagaagcagcgtgcaccacagcagcatccccagagccgagggcatcaactgcaacaaccagtactag

SEQ ID NO: 10853 - DNA, 933 bp, Artificial Sequence
  Description of Artificial Sequence: Synthetic coding sequence
atggccgacgccgccgccaccgccggcgccggcggcagcggcaccagaagcggcagcaagcagagcaccaaccccgccgacaactaccacctggccagaagaagaaccctgcaggtggtggtgagcagcctgctgaccgaggccggcttcgagagcgccgagaaggccagcgtggagaccctgaccgagatgctgcagagctacatcagcgagatcggcagaagcgccaagagctactgcgagcacaccgccagaacccagcccaccctgagcgacatcgtggtgaccctggtggagatgggcttcaacgtggacaccctgcccgcctacgccaagagaagccagagaatggtgatcaccgccccccccgtgaccaaccagcccgtgacccccaaggccctgaccgccggccagaacagaccccaccccccccacatccccagccacttccccgagttccccgacccccacacctacatcaagacccccacctacagagagcccgtgagcgactaccaggtgctgagagagaaggccgccagccagagaagagacgtggagagagccctgaccagattcatggccaagaccggcgagacccagagcctgttcaaggacgacgtgagcaccttccccctgatcgccgccagacccttcaccatcccctacctgaccgccctgctgcccagcgagctggagatgcagcagatggaggagaccgacagcagcgagcaggacgagcagaccgacaccgagaacctggccctgcacatcagcatggaggacagcggcgccgagaaggagaacaccagcgtgctgcagcagaaccccagcctgagcggcagcagaaacggcgaggagaacatcatcgacaacccctacctgagacccgtgaagaagcccaagatcagaagaaagaagagcctgagctag

SEQ ID NO: 10854 - DNA, 1935 bp, Artificial Sequence
  Description of Artificial Sequence: Synthetic coding sequence
atggaggagaccatgaagctggccaccatggaggacaccgtggagtactgcctgttcctgatccccgacgagagcagagacagcgacaagcacaaggagatcctgcagaagtacatcgagagaatcatcaccagattcgcccccatgctggtgccctacatctggcagaaccagcccttcaacctgaagtacaagcccggcaagggcggcgtgcccgcccacatgttcggcgtgaccaagttcggcgacaacatcgaggacgagtggttcatcgtgtacgtgatcaagcagatcaccaaggagttccccgagctggtggccagaatcgaggacaacgacggcgagttcctgctgatcgaggccgccgacttcctgcccaagtggctggaccccgagaacagcaccaacagagtgttcttctgccacggcgagctgtgcatcatccccgcccccagaaagagcggcgccgagagctggctgcccaccaccccccccaccatcccccaggccctgaacatcatcaccgcccacagcgagaagatcctggccagcgagagcatcagagccgccgtgaacagaagaatcagaggctaccccgagaagatccaggccagcctgcacagagcccactgcttcctgcccgccggcatcgtggccgtgctgaagcagagacccagactggtggccgccgccgtgcaggccttctacctgagagaccccatcgacctgagagcctgcagagtgttcaagaccttcctgcccgagaccagaatcatgaccagcgtgaccttcaccaagtgcctgtacgcccagctggtgcagcagagattcgtgcccgacagaagaagcggctacagactgcccccccccagcgacccccagtacagagcccacgagctgggcatgaagctggcccacggcttcgagatcctgtgcagcaagtgcagcccccacttcagcgactgcaagaagagcctggtgaccgccagccccctgtgggccagcttcctggagagcctgaagaagaacgactacttcaagggcctgatcgagggcagcgcccagtacagagagagactggagatggccgagaactacttccagctgagcgtggactggcccgagagcagcctggccatgagccccggcgaggagatcctgaccctgctgcagaccatccccttcgacatcgaggacctgaagaaggaggccgccaacctgccccccgaggacgacgaccagtggctggacctgagccccgaccagctggaccagctgctgcaggaggccgtgggcaagaaggagagcgagagcgtgagcaaggaggagaaggagcagaactacgacctgaccgaggtgagcgagagcatgaaggccttcatcagcaaggtgagcacccacaagggcgccgagctgcccagagagcccagcgaggcccccatcaccttcgacgccgacagcttcctgaactacttcgacaagatcctgggccccagacccaacgagagcgacagcgacgacctggacgacgaggacttcgagtgcctggacagcgacgacgacctggacttcgagacccacgagcccggcgaggaggccagcctgaagggcaccctggacaacctgaagagctacatggcccagatggaccaggagctggcccacacctgcatcagcaagagcttcaccaccagaaaccaggtggagcccgtgagccagaccaccgacaacaacagcgacgaggaggacagcggcaccggcgagagcgtgatggcccccgtggacgtggacctgaacctggtgagcaacatcctggagagctacagcagccaggccggcctggccggccccgccagcaacctgctgcagagcatgggcgtgcagctgcccgacaacaccgaccacagacccaccagcaagcccaccaagaactag

SEQ ID NO: 10855 - DNA, 2163 bp, Artificial Sequence
  Description of Artificial Sequence: Synthetic coding sequence
atgagcgtgagcggcaagaaggagttcgacgtgaagcagatcctgagactgagatggagatggttcagccaccccttccagggcagcaccaacaccggcagctgcctgcagcaggagggctacgagcacagaggcacccccgtgcagggcagactgaagagccacagcagagacagaaacggcctgaagaagagcaacagccccgtgcaccacaacatcctggcccccgtgcccggccccgcccccgcccaccagagagccgtgcagaacctgcagcagcacaacctgatcgtgcacttccaggccaacgaggacacccccaagagcgtgcccgagaagaacctgttcaaggaggcctgcgagaagagagcccaggacctggagatgatggccgacgacaacatcgaggacagcaccgccagactggacacccagcacagcgaggacatgaacgccaccagaagcgaggagcagttccacgtgatcaaccacgccgagcagaccctgagaaagatggagaactacctgaaggagaagcagctgtgcgacgtgctgctgatcgccggccacctgagaatccccgcccacagactggtgctgagcgccgtgagcgactacttcgccgccatgttcaccaacgacgtgctggaggccaagcaggaggaggtgagaatggagggcgtggaccccaacgccctgaacagcctggtgcagtacgcctacaccggcgtgctgcagctgaaggaggacaccatcgagagcctgctggccgccgcctgcctgctgcagctgacccaggtgatcgacgtgtgcagcaacttcctgatcaagcagctgcaccccagcaactgcctgggcatcagaagcttcggcgacgcccagggctgcaccgagctgctgaacgtggcccacaagtacaccatggagcacttcatcgaggtgatcaagaaccaggagttcctgctgctgcccgccaacgagatcagcaagctgctgtgcagcgacgacatcaacgtgcccgacgaggagaccatcttccacgccctgatgcagtgggtgggccacgacgtgcagaacagacagggcgagctgggcatgctgctgagctacatcagactgcccctgctgcccccccagctgctggccgacctggagaccagcagcatgttcaccggcgacctggagtgccagaagctgctgatggaggccatgaagtaccacctgctgcccgagagaagaagcatgatgcagagccccagaaccaagcccagaaagagcaccgtgggcgccctgtacgccgtgggcggcatggacgccatgaagggcaccaccaccatcgagaagtacgacctgagaaccaacagctggctgcacatcggcaccatgaacggcagaagactgcagttcggcgtggccgtgatcgacaacaagctgtacgtggtgggcggcagagacggcctgaagaccctgaacaccgtggagtgcttcaaccccgtgggcaagatctggaccgtgatgccccccatgagcacccacagacacggcctgggcgtggccaccctggagggccccatgtacgccgtgggcggccacgacggctggagctacctgaacaccgtggagagatgggaccccgagggcagacagtggaactacgtggccagcatgagcacccccagaagcaccgtgggcgtggtggccctgaacaacaagctgtacgccatcggcggcagagacggcagcagctgcctgaagagcatggagtacttcgacccccacaccaacaagtggagcctgtgcgcccccatgagcaagagaagaggcggcgtgggcgtggccacctacaacggcttcctgtacgtggtgggcggccacgacgcccccgccagcaaccactgcagcagactgagcgactgcgtggagagatacgaccccaagggcgacagctggagcaccgtggcccccctgagcgtgcccagagacgccgtggccgtgtgccccctgggcgacaagctgtacgtggtgggcggctacgacggccacacctacctgaacaccgtggagagctacgacgcccagagaaacgagtggaaggagagcatgcaggagctgctgcagaacttctacaccacccagaagctgaaggagaccctgggccactag

SEQ ID NO: 10856 - DNA, 2157 bp, Artificial Sequence
  Description of Artificial Sequence: Synthetic coding sequence
atgagcgtgagcggcaagaaggagttcgacgtgaagcagatcctgagactgagatggagatggttcagccaccccttccagggcagcaccaacaccggcagctgcctgcagcaggagggctacgagcacagaggcacccccgtgcagggcagactgaagagccacagcagagacagaaacggcctgaagaagagcaacagccccgtgcaccacaacatcctggcccccgtgcccggccccgcccccgcccaccagagagccgtgcagaacctgcagcagcacaacctgatcgtgcacttccaggccaacgaggacacccccaagagcgtgcccgagaagaacctgttcaaggaggcctgcgagaagagagcccaggacctggagatgatggccgacgacaacatcgaggacagcaccgccagactggacacccagcacagcgaggacatgaacgccaccagaagcgaggagcagttccacgtgatcaaccacgccgagcagaccctgagaaagatggagaactacctgaaggagaagcagctgtgcgacgtgctgctgatcgccggccacctgagaatccccgcccacagactggtgctgagcgccgtgagcgactacttcgccgccatgttcaccaacgacgtgctggaggccaagcaggaggaggtgagaatggagggcgtggaccccaacgccctgaacagcctggtgcagtacgcctacaccggcgtgctgcagctgaaggaggacaccatcgagagcctgctggccgccgcctgcctgctgcagctgacccaggtgatcgacgtgtgcagcaacttcctgatcaagcagctgcaccccagcaactgcctgggcatcagaagcttcggcgacgcccagggctgcaccgagctgctgaacgtggcccacaagtacaccatggagcacttcatcgaggtgatcaagaaccaggagttcctgctgctgcccgccaacgagatcagcaagctgctgtgcagcgacgacatcaacgtgcccgacgaggagaccatcttccacgccctgatgcagtgggtgggccacgacgtgcagaacagacagggcgagctgggcatgctgctgagctacatcagactgcccctgctgcccccccagctgctggccgacctggagaccagcagcatgttcaccggcgacctggagtgccagaagctgctgatggaggccatgaagtaccacctgctgcccgagagaagaagcatgatgcagagccccagaaccaagcccagaaagagcaccgtgggcgccctgtacgccgtgggcggcatggacgccatgaagggcaccaccaccatcgagaagtacgacctgagaaccaacagctggctgcacatcggcaccatgaacggcagaagactgcagttcggcgtggccgtgatcgacaacaagctgtacgtggtgggcggcagagacggcctgaagaccctgaacaccgtggagtgcttcaaccccgtgggcaagatctggaccgtgatgccccccatgagcacccacagacacggcctgggcgtggccaccctggagggccccatgtacgccgtgggcggccacgacggctggagctacctgaacaccgtggagagatgggaccccgagggcagacagtggaactacgtggccagcatgagcacccccagaagcaccgtgggcgtggtggccctgaacaacaagctgtacgccatcggcggcagagacggcagcagctgcctgaagagcatggagtacttcgacccccacaccaacaagtggagcctgtgcgcccccatgagcaagagaagaggcggcgtgggcgtggccacctacaacggcttcctgtacgtggtgggcggccacgacgcccccgccagcaaccactgcagcagactgagcgactgcgtggagagatacgaccccaagggcgacagctggagcaccgtggcccccctgagcgtgcccagagacgccgtggccgtgtgccccctgggcgacaagctgtacgtggtgggcggctacgacggccacacctacctgaacaccgtggagagctacgacgcccagagaaacgagtggaaggaggaggtgcccgtgaacatcggcagagccggcgcctgcgtggtggtggtgaagctgccctag

SEQ ID NO: 10857 - DNA, 1134 bp, Artificial Sequence
  Description of Artificial Sequence: Synthetic coding sequence
atgaacggccccgtgagccccaagagcaaggccagacccagcagccccagcaccagctggcacagacccgccagcccctgccccagccccggccccggccacaccctgccccccaagccccccagccccagaggcaccaccgccagccccaagggcagagtgagaagaaaggaggaggccaaggagagccccagcgccgccggccccgaggacaagagccagagcaagagaagagccagcaacgagaaggagagcgccgcccccgccagccccgcccccagccccgcccccagccccacccccgcccccccccagaaggagcagccccccgccgagacccccaccgcccccgccccccccgtgacccccagcaagcccatggccggcaccaccgacagagaggaggccaccagactgctggccgagaagagaagacaggccagagagcagagagagagagaggagcaggagagaagactgcaggccgagagagacaagagaatgagagaggagcagctggccagagaggccgaggccagagccgagagagaggccgaggccagaagaagagaggagcaggaggccagagagaaggcccaggccgagcaggaggagcaggagagactgcagaagcagaaggaggaggccgaggccagaagcagagaggaggccgagagacagagactggagagagagaagcacttccagcagcaggagcaggagagacaggagagaagaaagagactggaggagatcatgaagagaaccagaaagagcgaggtgagcgagaccaagaagcaggacagcaaggaggccaacgccaacggcagcagccccgagcccgtgaaggccgtggaggccagaagccccggcctgcagaaggaggccgtgcagaaggaggagcccatcccccaggagccccagtggagcctgcccagcaaggagctgcccgccagcctggtgaacggcctgcagcccctgcccgcccaccaggagaacggcttcagcaccaacggccccagcggcgacaagagcctgagcagaacccccgagaccctgctgcccttcgccgaggccgaggccttcctgaagaaggccgtggtgcagagcccccaggtgaccgaggtgctgtag

SEQ ID NO: 10858 - DNA, 2427 bp, Artificial Sequence
  Description of Artificial Sequence: Synthetic coding sequence
atggagagcggccccagagccgagctgggcgccggcgccccccccgccgtggtggccagaaccccccccgagcccagacccagccccgagggcgaccccagccccccccccccccccatgagcgccctggtgcccgacaccccccccgacaccccccccgccatgaagaacgccaccagcagcaagcagctgcccctggagcccgagagccccagcggccaggtgggccccagacccgcccccccccaggaggagagccccagcagcgaggccaagagcagaggccccaccccccccgccatgggccccagagacgccagaccccccagaagaagcagccagcccagccccaccgccgtgcccgccagcgacagcccccccaccaagcaggaggtgaagaaggccggcgagagacacaagctggccaaggagagaagagaggagagagccaagtacctggccgccaagaaggccgtgtggctggagaaggaggagaaggccaaggccctgagagagaagcagctgcaggagagaagaagaagactggaggagcagagactgaaggccgagcagagaagagccgccctggaggagagacagagacagaagctggagaagaacaaggagagatacgaggccgccatccagagaagcgtgaagaagacctgggccgagatcagacagcagagatggagctgggccggcgccctgcaccacagcagccccggccacaagaccagcggcagcagatgcagcgtgagcgccgtgaacctgcccaagcacgtggacagcatcatcaacaagagactgagcaagagcagcgccaccctgtggaacagccccagcagaaacagaagcctgcagctgagcgcctgggagagcagcatcgtggacagactgatgacccccaccctgagcttcctggccagaagcagaagcgccgtgaccctgcccagaaacggcagagaccaggccgtgcccgtgtgccccagaagcgccagcgccagccccctgaccccctgcagcgtgaccagaagcgtgcacagatgcgcccccgccggcgagagaggcgagagaagaaagcccaacgccggcggcagccccgcccccgtgagaagaagacccgaggccagccccgtgcagaagaaggagaagaaggacaaggagagagagaacgagaaggagaagagcgccctggccagagagagaagcctgaagaagagacagagcctgcccgccagccccagagccagactgagcgccagcaccgccagcgagctgagccccaagagcaaggccagacccagcagccccagcaccagctggcacagacccgccagcccctgccccagccccggccccggccacaccctgccccccaagccccccagccccagaggcaccaccgccagccccaagggcagagtgagaagaaaggaggaggccaaggagagccccagcgccgccggccccgaggacaagagccagagcaagagaagagccagcaacgagaaggagagcgccgcccccgccagccccgcccccagccccgcccccagccccacccccgcccccccccagaaggagcagccccccgccgagacccccaccgacgccgccgtgctgaccagcccccccgcccccgccccccccgtgacccccagcaagcccatggccggcaccaccgacagagaggaggccaccagactgctggccgagaagagaagacaggccagagagcagagagagagagaggagcaggagagaagactgcaggccgagagagacaagagaatgagagaggagcagctggccagagaggccgaggccagagccgagagagaggccgaggccagaagaagagaggagcaggaggccagagagaaggcccaggccgagcaggaggagcaggagagactgcagaagcagaaggaggaggccgaggccagaagcagagaggaggccgagagacagagactggagagagagaagcacttccagcagcaggagcaggagagacaggagagaagaaagagactggaggagatcatgaagagaaccagaaagagcgaggtgagcgagaccaagaagcaggacagcaaggaggccaacgccaacggcagcagccccgagcccgtgaaggccgtggaggccagaagccccggcctgcagaaggaggccgtgcagaaggaggagcccatcccccaggagccccagtggagcctgcccagcaaggagctgcccgccagcctggtgaacggcctgcagcccctgcccgcccaccaggagaacggcttcagcaccaacggccccagcggcgacaagagcctgagcagaacccccgagaccctgctgcccttcgccgaggccgaggccttcctgaagaaggccgtggtgcagagcccccaggtgaccgaggtgctgtag

SEQ ID NO: 10859 - DNA, 2526 bp, Artificial Sequence
  Description of Artificial Sequence: Synthetic coding sequence
atggagagcggccccagagccgagctgggcgccggcgccccccccgccgtggtggccagaaccccccccgagcccagacccagccccgagggcgaccccagccccccccccccccccatgagcgccctggtgcccgacaccccccccgacaccccccccgccatgaagaacgccaccagcagcaagcagctgcccctggagcccgagagccccagcggccaggtgggccccagacccgcccccccccaggaggagagccccagcagcgaggccaagagcagaggccccaccccccccgccatgggccccagagacgccagaccccccagaagaagcagccagcccagccccaccgccgtgcccgccagcgacagcccccccaccaagcaggaggtgaagaaggccggcgagagacacaagctggccaaggagagaagagaggagagagccaagtacctggccgccaagaaggccgtgtggctggagaaggaggagaaggccaaggccctgagagagaagcagctgcaggagagaagaagaagactggaggagcagagactgaaggccgagcagagaagagccgccctggaggagagacagagacagaagctggagaagaacaaggagagatacgaggccgccatccagagaagcgtgaagaagacctgggccgagatcagacagcagagatggagctgggccggcgccctgcaccacagcagccccggccacaagaccagcggcagcagatgcagcgtgagcgccgtgaacctgcccaagcacgtggacagcatcatcaacaagagactgagcaagagcagcgccaccctgtggaacagccccagcagaaacagaagcctgcagctgagcgcctgggagagcagcatcgtggacagactgatgacccccaccctgagcttcctggccagaagcagaagcgccgtgaccctgcccagaaacggcagagaccagggcagaggctgcgaccccggcagaggccccacctggggcagagccggcgccagcctggccagaggcccccagcccgacagaacccaccccagcgccgccgtgcccgtgtgccccagaagcgccagcgccagccccctgaccccctgcagcgtgaccagaagcgtgcacagatgcgcccccgccggcgagagaggcgagagaagaaagcccaacgccggcggcagccccgcccccgtgagaagaagacccgaggccagccccgtgcagaagaaggagaagaaggacaaggagagagagaacgagaaggagaagagcgccctggccagagagagaagcctgaagaagagacagagcctgcccgccagccccagagccagactgagcgccagcaccgccagcgagctgagccccaagagcaaggccagacccagcagccccagcaccagctggcacagacccgccagcccctgccccagccccggccccggccacaccctgccccccaagccccccagccccagaggcaccaccgccagccccaagggcagagtgagaagaaaggaggaggccaaggagagccccagcgccgccggccccgaggacaagagccagagcaagagaagagccagcaacgagaaggagagcgccgcccccgccagccccgcccccagccccgcccccagccccacccccgcccccccccagaaggagcagccccccgccgagacccccaccgacgccgccgtgctgaccagcccccccgcccccgccccccccgtgacccccagcaagcccatggccggcaccaccgacagagaggaggccaccagactgctggccgagaagagaagacaggccagagagcagagagagagagaggagcaggagagaagactgcaggccgagagagacaagagaatgagagaggagcagctggccagagaggccgaggccagagccgagagagaggccgaggccagaagaagagaggagcaggaggccagagagaaggcccaggccgagcaggaggagcaggagagactgcagaagcagaaggaggaggccgaggccagaagcagagaggaggccgagagacagagactggagagagagaagcacttccagcagcaggagcaggagagacaggagagaagaaagagactggaggagatcatgaagagaaccagaaagagcgaggtgagcgagaccaagcagaagcaggacagcaaggaggccaacgccaacggcagcagccccgagcccgtgaaggccgtggaggccagaagccccggcctgcagaaggaggccgtgcagaaggaggagcccatcccccaggagccccagtggagcctgcccagcaaggagctgcccgccagcctggtgaacggcctgcagcccctgcccgcccaccaggagaacggcttcagcaccaacggccccagcggcgacaagagcctgagcagaacccccgagaccctgctgcccttcgccgaggccgaggccttcctgaagaaggccgtggtgcagagcccccaggtgaccgaggtgctgtag

SEQ ID NO: 10860 - DNA, 495 bp, Artificial Sequence
  Description of Artificial Sequence: Synthetic coding sequence
aacctgcccaagcacgtggacagcatcatcaacaagagacagagactggagagagagaagcacttccagcagcaggagcaggagagacaggagagaagaaagagactggaggagatcatgaagagaaccagaaagagcgaggtgagcgagaccaagaagcaggacagcaaggaggccaacgccaacggcagcagccccgagcccgtgaaggccgtggaggccagaagccccggcctgcagaaggaggccgtgcagaaggaggagcccatcccccaggagccccagtggagcctgcccagcaaggagctgcccgccagcctggtgaacggcctgcagcccctgcccgcccaccaggagaacggcttcagcaccaacggccccagcggcgacaagagcctgagcagaacccccgagaccctgctgcccttcgccgaggccgaggccttcctgaagaaggccgtggtgcagagcccccaggtgaccgaggtgctgtag

SEQ ID NO: 10861 - DNA, 345 bp, Artificial Sequence
  Description of Artificial Sequence: Synthetic coding sequence
atggtgatcagagtgtacatcgccagcagcagcggcagcaccgccatcaagaagaagcagcaggacgtgctgggcttcctggaggccaacaagatcggcttcgaggagaaggacatcgccgccaacgaggagaacagaaagtggatgagagagaacgtgcccgagaacagcagacccgccaccggctaccccctgcccccccagatcttcaacgagagccagtacagaggcgactacgacgccttcttcgaggccagagagaacaacgccgtgtacgccttcctgggcctgaccgccccccccggcagcaaggaggccgaggtgcaggccaagcagcaggcctag

SEQ ID NO: 10862 - DNA, 537 bp, Artificial Sequence
  Description of Artificial Sequence: Synthetic coding sequence
atgagcggcttcagcaccgaggagagagccgcccccttcagcctggagtacagagtgttcctgaagaacgagaagggccagtacatcagccccttccacgacatccccatctacgccgacaaggacgtgttccacatggtggtggaggtgcccagatggagcaacgccaagatggagatcgccaccaaggaccccctgaaccccatcaagcaggacgtgaagaagggcaagctgagatacgtggccaacctgttcccctacaagggctacatctggaactacggcgccatcccccagacctgggaggaccccggccacaacgacaagcacaccggctgctgcggcgacaacgaccccatcgacgtgtgcgagatcggcagcaaggtgtgcgccagaggcgagatcatcggcgtgaaggtgctgggcatcctggccatgatcgacgagggcgagaccgactggaaggtgatcgccatcaacgtggacgaccccgacgccgccaactacaacgtgtgcaacagcgtggtgatcctgtag

SEQ ID NO: 10863 - DNA, 870 bp, Artificial Sequence
  Description of Artificial Sequence: Synthetic coding sequence
atgagcggcttcagcaccgaggagagagccgcccccttcagcctggagtacagagtgttcctgaagaacgagaagggccagtacatcagccccttccacgacatccccatctacgccgacaaggacgtgttccacatggtggtggaggtgcccagatggagcaacgccaagatggagatcgccaccaaggaccccctgaaccccatcaagcaggacgtgaagaagggcaagctgagatacgtggccaacctgttcccctacaagggctacatctggaactacggcgccatcccccagacctgggaggaccccggccacaacgacaagcacaccggctgctgcggcgacaacgaccccatcgacgtgtgcgagatcggcagcaaggtgtgcgccagaggcgagatcatcggcgtgaaggtgctgggcatcctggccatgatcgacgagggcgagaccgactggaaggtgatcgccatcaacgtggacgaccccgacgccgccaactacaacgacatcaacgacgtgaagagactgaagcccggctacctggaggccaccgtggactggttcagaagatacaaggtgcccgacggcaagcccgagaacgagttcgccttcaacgccgagttcaaggacaaggacttcgccatcgacatcatcaagagcacccacgaccactggaaggccctggtgaccaagaagaccaacggcaagggcatcagctgcatgaacaccaccctgagcgagagccccttcaagtgcgaccccgacgccgccagagccatcgtggacgccctgccccccccctgcgagagcgcctgcaccgtgcccaccgacgtggacaagtggttccaccaccagaagaactag

SEQ ID NO: 10864 - DNA, 2103 bp, Artificial Sequence
  Description of Artificial Sequence: Synthetic coding sequence
atgaccgagagatgcagcctgtggagcgccctgagcgccgccgcctgctgcttctacagaggcagcttcgtgcagttcagcaaggagaagtacatcctggacagcagccccgagaagctgcacaaggagctggaggaggagctgaagctgagcagcaccgacctgagaagccacgcctggtaccacggcagaatccccagagaggtgagcgagaccctggtgcagagaaacggcgacttcctgatcagagacagcctgaccagcctgggcgactacgtgctgacctgcagatggagaaaccaggccctgcacttcaagatcaacaaggtggtggtgaaggccggcgagagctacacccacatccagtacctgttcgagcaggagagcttcgaccacgtgcccgccctggtgagataccacgtgggcagcagaaaggccgtgagcgagcagagcggcgccatcatctactgccccgtgaacagaaccttccccctgagatacctggaggccagctacggcctgggccagggcagcagcaagcccgccagccccgtgagccccagcggccccaagggcagccacatgaagagaagaagcgtgaccatgaccgacggcctgaccgccgacaaggtgaccagaagcgacggctgccccaccagcaccagcctgcccagacccagagacagcatcagaagctgcgccctgagcatggaccagatccccgacctgcacagccccatgagccccatcagcgagagccccagcagccccgcctacagcaccgtgaccagagtgcacgccgcccccgccgcccccagcgccaccgccctgcccgccagccccgtggccagaagaagcagcgagccccagctgtgccccggcagcgcccccaagacccacggcgagagcgacaagggcccccacaccagccccagccacaccctgggcaaggccagccccagccccagcctgagcagctacagcgaccccgacagcggccactactgccagctgcagccccccgtgagaggcagcagagagtgggccgccaccgagaccagcagccagcaggccagaagctacggcgagagactgaaggagctgagcgagaacggcgcccccgagggcgactggggcaagaccttcaccgtgcccatcgtggaggtgaccagcagcttcaaccccgccaccttccagagcctgctgatccccagagacaacagacccctggaggtgggcctgctgagaaaggtgaaggagctgctggccgaggtggacgccagaaccctggccagacacgtgaccaaggtggactgcctggtggccagaatcctgggcgtgaccaaggagatgcagaccctgatgggcgtgagatggggcatggagctgctgaccctgccccacggcagacagctgagactggacctgctggagagattccacaccatgagcatcatgctggccgtggacatcctgggctgcaccggcagcgccgaggagagagccgccctgctgcacaagaccatccagctggccgccgagctgagaggcaccatgggcaacatgttcagcttcgccgccgtgatgggcgccctggacatggcccagatcagcagactggagcagacctgggtgaccctgagacagagacacaccgagggcgccatcctgtacgagaagaagctgaagcccttcctgaagagcctgaacgagggcaaggagggcccccccctgagcaacaccaccttcccccacgtgctgcccctgatcaccctgctggagtgcgacagcgccccccccgagggccccgagccctggggcagcaccgagcacggcgtggaggtggtgctggcccacctggaggccgccagaaccgtggcccaccacggcggcctgtaccacaccaacgccgaggtgaagctgcagggcttccaggccagacccgagctgctggaggtgttcagcaccgagttccagatgagactgctgtggggcagccagggcgccagcagcagccaggccagaagatacgagaagttcgacaaggtgctgaccgccctgagccacaagctggagcccgccgtgagaagcagcgagctgtag

SEQ ID NO: 10865 - DNA, 2379 bp, Artificial Sequence
  Description of Artificial Sequence: Synthetic coding sequence
atggcccccgccctgcccagcccccacaaggccgtggccagacccgagctgctgctggacaccgccgcccacagcggcaagctgagagcccccgacggcggcgagggcgccgagtgcgccggccacaacggcggccccagctggggcgtgggccagggccagagccaggagcccagcagacagggcatcccccaggccccctggctggtgagctggcagagaagaggcttcccccccagcagcttctgccccggccccctgagaaccgagaagctgagagccggcagatgccccctgctgctgtgcggcggcgccgccggcgagcccgaggccggcagcgactacgtgaagttcagcaaggagaagtacatcctggacagcagccccgagaagctgcacaaggagctggaggaggagctgaagctgagcagcaccgacctgagaagccacgcctggtaccacggcagaatccccagagaggtgagcgagaccctggtgcagagaaacggcgacttcctgatcagagacagcctgaccagcctgggcgactacgtgctgacctgcagatggagaaaccaggccctgcacttcaagatcaacaaggtggtggtgaaggccggcgagagctacacccacatccagtacctgttcgagcaggagagcttcgaccacgtgcccgccctggtgagataccacgtgggcagcagaaaggccgtgagcgagcagagcggcgccatcatctactgccccgtgaacagaaccttccccctgagatacctggaggccagctacggcctgggccagggcagcagcaagcccgccagccccgtgagccccagcggccccaagggcagccacatgaagagaagaagcgtgaccatgaccgacggcctgaccgccgacaaggtgaccagaagcgacggctgccccaccagcaccagcctgcccagacccagagacagcatcagaagctgcgccctgagcatggaccagatccccgacctgcacagccccatgagccccatcagcgagagccccagcagccccgcctacagcaccgtgaccagagtgcacgccgcccccgccgcccccagcgccaccgccctgcccgccagccccgtggccagaagaagcagcgagccccagctgtgccccggcagcgcccccaagacccacggcgagagcgacaagggcccccacaccagccccagccacaccctgggcaaggccagccccagccccagcctgagcagctacagcgaccccgacagcggccactactgccagctgcagccccccgtgagaggcagcagagagtgggccgccaccgagaccagcagccagcaggccagaagctacggcgagagactgaaggagctgagcgagaacggcgcccccgagggcgactggggcaagaccttcaccgtgcccatcgtggaggtgaccagcagcttcaaccccgccaccttccagagcctgctgatccccagagacaacagacccctggaggtgggcctgctgagaaaggtgaaggagctgctggccgaggtggacgccagaaccctggccagacacgtgaccaaggtggactgcctggtggccagaatcctgggcgtgaccaaggagatgcagaccctgatgggcgtgagatggggcatggagctgctgaccctgccccacggcagacagctgagactggacctgctggagagattccacaccatgagcatcatgctggccgtggacatcctgggctgcaccggcagcgccgaggagagagccgccctgctgcacaagaccatccagctggccgccgagctgagaggcaccatgggcaacatgttcagcttcgccgccgtgatgggcgccctggacatggcccagatcagcagactggagcagacctgggtgaccctgagacagagacacaccgagggcgccatcctgtacgagaagaagctgaagcccttcctgaagagcctgaacgagggcaaggagggcccccccctgagcaacaccaccttcccccacgtgctgcccctgatcaccctgctggagtgcgacagcgccccccccgagggccccgagccctggggcagcaccgagcacggcgtggaggtggtgctggcccacctggaggccgccagaaccgtggcccaccacggcggcctgtaccacaccaacgccgaggtgaagctgcagggcttccaggccagacccgagctgctggaggtgttcagcaccgagttccagatgagactgctgtggggcagccagggcgccagcagcagccaggccagaagatacgagaagttcgacaaggtgctgaccgccctgagccacaagctggagcccgccgtgagaagcagcgagctgtag

SEQ ID NO: 10866 - DNA, 2112 bp, Artificial Sequence
  Description of Artificial Sequence: Synthetic coding sequence
atgaccgccgtgggcagaagatgccccgccctgggcagcagaggcgccgccggcgagcccgaggccggcagcgactacgtgaagttcagcaaggagaagtacatcctggacagcagccccgagaagctgcacaaggagctggaggaggagctgaagctgagcagcaccgacctgagaagccacgcctggtaccacggcagaatccccagagaggtgagcgagaccctggtgcagagaaacggcgacttcctgatcagagacagcctgaccagcctgggcgactacgtgctgacctgcagatggagaaaccaggccctgcacttcaagatcaacaaggtggtggtgaaggccggcgagagctacacccacatccagtacctgttcgagcaggagagcttcgaccacgtgcccgccctggtgagataccacgtgggcagcagaaaggccgtgagcgagcagagcggcgccatcatctactgccccgtgaacagaaccttccccctgagatacctggaggccagctacggcctgggccagggcagcagcaagcccgccagccccgtgagccccagcggccccaagggcagccacatgaagagaagaagcgtgaccatgaccgacggcctgaccgccgacaaggtgaccagaagcgacggctgccccaccagcaccagcctgcccagacccagagacagcatcagaagctgcgccctgagcatggaccagatccccgacctgcacagccccatgagccccatcagcgagagccccagcagccccgcctacagcaccgtgaccagagtgcacgccgcccccgccgcccccagcgccaccgccctgcccgccagccccgtggccagaagaagcagcgagccccagctgtgccccggcagcgcccccaagacccacggcgagagcgacaagggcccccacaccagccccagccacaccctgggcaaggccagccccagccccagcctgagcagctacagcgaccccgacagcggccactactgccagctgcagccccccgtgagaggcagcagagagtgggccgccaccgagaccagcagccagcaggccagaagctacggcgagagactgaaggagctgagcgagaacggcgcccccgagggcgactggggcaagaccttcaccgtgcccatcgtggaggtgaccagcagcttcaaccccgccaccttccagagcctgctgatccccagagacaacagacccctggaggtgggcctgctgagaaaggtgaaggagctgctggccgaggtggacgccagaaccctggccagacacgtgaccaaggtggactgcctggtggccagaatcctgggcgtgaccaaggagatgcagaccctgatgggcgtgagatggggcatggagctgctgaccctgccccacggcagacagctgagactggacctgctggagagattccacaccatgagcatcatgctggccgtggacatcctgggctgcaccggcagcgccgaggagagagccgccctgctgcacaagaccatccagctggccgccgagctgagaggcaccatgggcaacatgttcagcttcgccgccgtgatgggcgccctggacatggcccagatcagcagactggagcagacctgggtgaccctgagacagagacacaccgagggcgccatcctgtacgagaagaagctgaagcccttcctgaagagcctgaacgagggcaaggagggcccccccctgagcaacaccaccttcccccacgtgctgcccctgatcaccctgctggagtgcgacagcgccccccccgagggccccgagccctggggcagcaccgagcacggcgtggaggtggtgctggcccacctggaggccgccagaaccgtggcccaccacggcggcctgtaccacaccaacgccgaggtgaagctgcagggcttccaggccagacccgagctgctggaggtgttcagcaccgagttccagatgagactgctgtggggcagccagggcgccagcagcagccaggccagaagatacgagaagttcgacaaggtgctgaccgccctgagccacaagctggagcccgccgtgagaagcagcgagctgtag

SEQ ID NO: 10867 - DNA, 1869 bp, Artificial Sequence
  Description of Artificial Sequence: Synthetic coding sequence
atggaccagctgccccagaagaacctgctgagactgcaccccgccggcagcgccggctgcagcaccggcgtggagagcagcagcatggacggcttctggatggaggtggagcagatccagcagagagacgagctgagagaggaggacagcggcggcaacgagggccagctgcccgaggagggcgaggccgagagccagtggctgcaggacaccggcctgagcggcctgctgggcggcctgggcctggacggcgaccaccaggagctgctgagcaccctgacccagacccaggtggccgccgtgtgcagaagactggacatctacgccagaagcgtgagaagacagcacaagacccccgtgagagacgtgagagacgtgttcggcgtgttcaacagcggcaagatgagcagcgagaacggcgacagcggcatgaagggcgcccagctgagcagcggcgccagcaagttcccccccgccgccgagcccggcggcctgcaggagcaggccggcagagaggaggccttcaacatggacagcgcctacagcgagcaggccgccgtgctgctgcagagaagcagacccagcagaggcggcaccagcgcctggggcaagtgcagcctgcccaagttcaccgtgcccaagggcagactgggcgtgaccagaatcggcgacctgagcctgcaggacatgagaaaggtgcccagcctggccctgatcgagctgaccgccctgtgcgacatcctgggcctggacctgaagagaagcaaggccggcaagtggaaggccgccgagaccagactgttcggcgtgcccctggacagcctgctggaggccgaccacaaggtgctgcccagcacccaggtgcccctggtgctgcaggccctgctgagctgcctggagaagagaggcctggacatggagggcatcctgagagtgcccggcagccaggccagagtgaagggcctggagcagaagctggagagagacttctacgccggcctgttcagctgggacgaggtgcaccacaacgacgccagcgacctgctgaagagattcatcagaaagctgcccacccccctgctgaccgccgagtacctgcccgccttcgccgtggtgcccaacatccccaacctgaagcagagactgcaggtgctgcacctgctgatcctgatcctgcccgagcccaacagaaacgccctgaaggccctgctggagttcctgagaaaggtggtggccagagagcagcacaacaagatgaccctgagaaacgtgagcaccgtgatggcccccaacctgttcctgcaccagggcagaccccccaagctgcccaagggcaaggagaagcagctggccgagggcgccgccgaggtggtgcagatcatggtgcactaccaggacctgctgtggaccgtggccagcttcctggtggcccaggtgagaaagctgaacgacagcagcagcagaagaccccagctgtgcgacgccggcctgaagacctggctgagaagaatgcacgccgacagagacaaggccggcgacggcctggaggccacccccaaggtggccaagatccaggtggtgtggcccatcaaggaccccctgaaggtgcccctgacccccagcaccaaggtggcccacgtgctgagacagttcaccgagcacctgagccccggcagcaagggccaggaggacagcgaggacatggacagcctgctgctgcaccacagaagcatggagagcgccaacatcctgctgtacgaggtgggcggcaacatcaacgagcacagactggaccccgacgcctacctgctggacctgtacagagccaacccccacggcgagtgggtgctgaagcagaaccccacctag

SEQ ID NO: 10868 - DNA, 846 bp, Artificial Sequence
  Description of Artificial Sequence: Synthetic coding sequence
atggccaccgagctgcagtgccccgacagcatgccctgccacaaccagcaggtgaacagcgccagcacccccagccccgagcagctgagacccggcgacctgatcctggaccacgccggcggcaacagagccagcagagccaaggtgatcctgctgaccggctacgcccacagcagcctgcccgccgagctggacagcggcgcctgcggcggcagcagcctgaacagcgagggcaacagcggcagcggcgacagcagcagctacgacgcccccgccggcaacagcttcctggaggactgcgagctgagcagacagatcggcgcccagctgaagctgctgcccatgaacgaccagatcagagagctgcagaccatcatcagagacaagaccgccagcagaggcgacttcatgttcagcgccgacagactgatcagactggtggtggaggagggcctgaaccagctgccctacaaggagtgcatggtgaccacccccaccggctacaagtacgagggcgtgaagttcgagaagggcaactgcggcgtgagcatcatgagaagcggcgaggccatggagcagggcctgagagactgctgcagaagcatcagaatcggcaagatcctgatccagagcgacgaggagacccagagagccaaggtgtactacgccaagttcccccccgacatctacagaagaaaggtgctgctgatgtaccccatcctgagcaccggcaacaccgtgatcgaggccgtgaaggtgctgatcgagcacggcgtgcagcccagcgtgatcatcctgctgagcctgttcagcaccccccacggcgagttcagcatgagacagtag

SEQ ID NO: 10869 - DNA, 930 bp, Artificial Sequence
  Description of Artificial Sequence: Synthetic coding sequence
atggccaccgagctgcagtgccccgacagcatgccctgccacaaccagcaggtgaacagcgccagcacccccagccccgagcagctgagacccggcgacctgatcctggaccacgccggcggcaacagagccagcagagccaaggtgatcctgctgaccggctacgcccacagcagcctgcccgccgagctggacagcggcgcctgcggcggcagcagcctgaacagcgagggcaacagcggcagcggcgacagcagcagctacgacgcccccgccggcaacagcttcctggaggactgcgagctgagcagacagatcggcgcccagctgaagctgctgcccatgaacgaccagatcagagagctgcagaccatcatcagagacaagaccgccagcagaggcgacttcatgttcagcgccgacagactgatcagactggtggtggaggagggcctgaaccagctgccctacaaggagtgcatggtgaccacccccaccggctacaagtacgagggcgtgaagttcgagaagggcaactgcggcgtgagcatcatgagaagcggcgaggccatggagcagggcctgagagactgctgcagaagcatcagaatcggcaagatcctgatccagagcgacgaggagacccagagagccaaggtgtactacgccaagttcccccccgacatctacagaagaaaggtgctgctgatgtaccccatcctgagcaccggcaacaccgtgatcgaggccgtgaaggtgctgatcgagcacggcgtgcagcccagcgtgatcatcctgctgagcctgttcagcaccccccacggcgccaagagcatcatccaggagttccccgagatcaccatcctgaccaccgaggtgcaccccgtggcccccacccacttcggccagaagtacttcggcaccgactag

SEQ ID NO: 10870 - DNA, 633 bp, Artificial Sequence
  Description of Artificial Sequence: Synthetic coding sequence
atggtgagcggcagcgagcagaagttcctgatcggcctgggcaagagccagatctacacctgggacggcagacagagcgacagatggatcaagctggacctgaagaccgagctgcccagagacaccctgctgagcgtggagatcgtgcacgagctgaagggcgagggcaaggcccagagaaagatcagcgccatccacatcctggacgtgctggtgctgaacggcaccgacgtgagagagcagcacttcaaccagagaatccagctggccgagaagttcgtgaaggccgtgagcaagcccagcagacccgacatgaaccccatcagagtgaaggaggtgtacagactggaggagatggagaagatcttcgtgagactggagatgaagatcatcaagggcagcagcggcacccccaagctgagctacaccggcagagacgacagacacttcgtgcccatgggcctgtacatcgtgagaaccgtgaacgagccctggaccatgggcttcagcaagagcttcaagaagaagttcttctacaacaagaagaccaaggacagcaccttcgacctgcccgccgacagcatcgcccccttccacctgcccagcctggcctgcctgagcaagatggactag

SEQ ID NO: 10871 - DNA, 1119 bp, Artificial Sequence
  Description of Artificial Sequence: Synthetic coding sequence
atgaagagaagaaccgaccccgagtgcaccgcccccatcaagaagcagaagaagagagtggccgagctggccctgagcctgagcagcaccagcgacgacgagccccccagcagcgtgagccacggcgccaaggccagcaccaccagcctgagcggcagcgacagcgagaccgagggcaagcagcacagcagcgacagcttcgacgacgccttcaaggccgacagcctggtggagggcaccagcagcagatacagcatgtacaacagcgtgagccagaagctgatggccaagatgggcttcagagagggcgagggcctgggcaagtacagccagggcagaaaggacatcgtggaggccagcagccagaagggcagaagaggcctgggcctgaccctgagaggcttcgaccaggagctgaacgtggactggagagacgagcccgagcccagcgcctgcgagcaggtgagctggttccccgagtgcaccaccgagatccccgacacccaggagatgagcgactggatggtggtgggcaagagaaagatgatcatcgaggacgagaccgagttctgcggcgaggagctgctgcacagcgtgctgcagtgcaagaagcccctggtgaaggacagagaggccgagctgctgtacttcgccgacgtgtgcgccggccccggcggcttcagcgagtacgtgctgtggagaaagaagtggcacgccaagggcttcggcatgaccctgaagggccccaacgacttcaagctggaggacttctacagcgccagcagcgagctgttcgagccctactacggcgagggcggcatcgacggcgacggcgacatcaccagacccgagaacatcagcgccttcagaaacttcgtgctggacaacaccgacagaaagggcgtgcacttcctgatggccgacggcggcttcagcgtggagggccaggagaacctgcaggagatcctgagcaagcagctgctgctgtgccagttcctgatggccctgagcatcgtgagaaccggcggccacttcatctgcaagaccttcgacctgttcacccccttcagcgtgggcctggtgtacctgctgtactgctgcttcgagagagtgtgctag

SEQ ID NO: 10872 - DNA, 615 bp, Artificial Sequence; identical to SEQ ID NO: 10477
  Description of Artificial Sequence: Synthetic coding sequence

SEQ ID NO: 10873 - DNA, 1443 bp, Artificial Sequence
  Description of Artificial Sequence: Synthetic coding sequence
atggccggctacctgagcgagagcgacttcgtgatggtggaggagggcttcagcaccagagacctgctgaaggagctgaccctgggcgccagccaggccaccaccgacgaggtggccgccttcttcgtggccgacctgggcgccatcgtgagaaagcacttctgcttcctgaagtgcctgcccagagtgagacccttctacgccgtgaagtgcaacagcagccccggcgtgctgaaggtgctggcccagctgggcctgggcttcagctgcgccaacaaggccgagatggagctggtgcagcacatcggcatccccgccagcaagatcatctgcgccaacccctgcaagcagatcgcccagatcaagtacgccgccaagcacggcatccagctgctgagcttcgacaacgagatggagctggccaaggtggtgaagagccaccccagcgccaagatggtgctgtgcatcgccaccgacgacagccacagcctgagctgcctgagcctgaagttcggcgtgagcctgaagagctgcagacacctgctggagaacgccaagaagcaccacgtggaggtggtgggcgtgagcttccacatcggcagcggctgccccgacccccaggcctacgcccagagcatcgccgacgccagactggtgttcgagatgggcaccgagctgggccacaagatgcacgtgctggacctgggcggcggcttccccggcaccgagggcgccaaggtgagattcgaggagatcgccagcgtgatcaacagcgccctggacctgtacttccccgagggctgcggcgtggacatcttcgccgagctgggcagatactacgtgaccagcgccttcaccgtggccgtgagcatcatcgccaagaaggaggtgctgctggaccagcccggcagagaggcccccctgccccccccccacatcgccacctgcgccgccagcgagcccagcccccccgccgaggagaacggcagcaccagcaagaccatcgtgtaccacctggacgagggcgtgtacggcatcttcaacagcgtgctgttcgacaacatctgccccacccccatcctgcagaagaagcccagcaccgagcagcccctgtacagcagcagcctgtggggccccgccgtggacggctgcgactgcgtggccgagggcctgtggctgccccagctgcacgtgggcgactggctggtgttcgacaacatgggcgcctacaccgtgggcatgggcagccccttctggggcacccaggcctgccacatcacctacgccatgagcagagtggcctgggaggccctgagaagacagctgatggccgccgagcaggaggacgacgtggagggcgtgtgcaagcccctgagctgcggctgggagatcaccgacaccctgtgcgtgggccccgtgttcacccccgccagcatcatgtag

SEQ ID NO: 10874 - DNA, 1383 bp, Artificial Sequence; identical to SEQ ID NO: 9655
  Description of Artificial Sequence: Synthetic coding sequence

SEQ ID NO: 10875 - DNA, 2508 bp, Artificial Sequence
  Description of Artificial Sequence: Synthetic coding sequence
atgaagagaagaaccgaccccgagtgcaccgcccccatcaagaagcagaagaagagagtggccgagctggccctgagcctgagcagcaccagcgacgacgagccccccagcagcgtgagccacggcgccaaggccagcaccaccagcctgagcggcagcgacagcgagaccgagggcaagcagcacagcagcgacagcttcgacgacgccttcaaggccgacagcctggtggagggcaccagcagcagatacagcatgtacaacagcgtgagccagaagctgatggccaagatgggcttcagagagggcgagggcctgggcaagtacagccagggcagaaaggacatcgtggaggccagcagccagaagggcagaagaggcctgggcctgaccctgagaggcttcgaccaggagctgaacgtggactggagagacgagcccgagcccagcgcctgcgagcaggtgagctggttccccgagtgcaccaccgagatccccgacacccaggagatgagcgactggatggtggtgggcaagagaaagatgatcatcgaggacgagaccgagttctgcggcgaggagctgctgcacagcgtgctgcagtgcaagagcgtgttcgacgtgctggacggcgaggagatgagaagagccagaaccagagccaacccctacgagatgatcagaggcgtgttcttcctgaacagagccgccatgaagatggccaacatggacttcgtgttcgacagaatgttcaccaaccccagagacagctacggcaagcccctggtgaaggacagagaggccgagctgctgtacttcgccgacgtgtgcgccggccccggcggcttcagcgagtacgtgctgtggagaaagaagtggcacgccaagggcttcggcatgaccctgaagggccccaacgacttcaagctggaggacttctacagcgccagcagcgagctgttcgagccctactacggcgagggcggcatcgacggcgacggcgacatcaccagacccgagaacatcagcgccttcagaaacttcgtgctggacaacaccgacagaaagggcgtgcacttcctgatggccgacggcggcttcagcgtggagggccaggagaacctgcaggagatcctgagcaagcagctgctgctgtgccagttcctgatggccctgagcatcgtgagaaccggcggccacttcatctgcaagaccttcgacctgttcacccccttcagcgtgggcctggtgtacctgctgtactgctgcttcgagagagtgtgcctgttcaagcccatcaccagcagacccgccaacagcgagagatacgtggtgtgcaagggcctgaaggtgggcatcgacgacgtgagagactacctgttcgccgtgaacatcaagctgaaccagctgagaaacaccgacagcgacgtgaacctggtggtgcccctggaggtgatcaagggcgaccacgagttcaccgactacatgatcagaagcaacgagagccactgcagcctgcagatcaaggccctggccaagatccacgccttcgtgcaggacaccaccctgagcgagcccagacaggccgagatcagaaaggagtgcctgagactgtggggcatccccgaccaggccagagtggcccccagcagcagcgaccccaagagcaagttcttcgagctgatccagggcaccgagatcgacatcttcagctacaagcccaccctgctgaccagcaagaccctggagaagatcagacccgtgttcgactacagatgcatggtgagcggcagcgagcagaagttcctgatcggcctgggcaagagccagatctacacctgggacggcagacagagcgacagatggatcaagctggacctgaagaccgagctgcccagagacaccctgctgagcgtggagatcgtgcacgagctgaagggcgagggcaaggcccagagaaagatcagcgccatccacatcctggacgtgctggtgctgaacggcaccgacgtgagagagcagcacttcaaccagagaatccagctggccgagaagttcgtgaaggccgtgagcaagcccagcagacccgacatgaaccccatcagagtgaaggaggtgtacagactggaggagatggagaagatcttcgtgagactggagatgaagatcatcaagggcagcagcggcacccccaagctgagctacaccggcagagacgacagacacttcgtgcccatgggcctgtacatcgtgagaaccgtgaacgagccctggaccatgggcttcagcaagagcttcaagaagaagttcttctacaacaagaagaccaaggacagcaccttcgacctgcccgccgacagcatcgcccccttccacatctgctactacggcagactgttctgggagtggggcgacggcatcagagtgcacgacagccagaagccccaggaccaggacaagctgagcaaggaggacgtgctgagcttcatccagatgcacagagcctag

SEQ ID NO: 10876 - DNA, 252 bp, Artificial Sequence
  Description of Artificial Sequence: Synthetic coding sequence
tgacaggagctgctgaaggagaagaccctggccgagcagaacctggaggacaccagacagcagctgctggccgccagaagcagccaggccaaggccatcaacaccctggagaccagagtgagagagctggagcagaccctgcaggccagcgaggagcagctgcagcagagcaagggcatcgtggccgcccaggagacccagatccaggagctggtgagcgcctactggagctgctgcatccccggcccctag

SEQ ID NO: 10877 - DNA, 2304 bp, Artificial Sequence
  Description of Artificial Sequence: Synthetic coding sequence
atgttcgccaagctgaagaagaagatcgccgaggagaccgccgtggcccagagacccggcggcgccaccagaatccccagaagcgtgagcaaggagagcgtggccagcatgggcgccgacagcggcgacgacttcgccagcgacggcagcagcagcagagaggacctgagcagccagctgctgagaagaaacgagcagatcagaaagctggaggccagactgagcgactacgccgagcaggtgagaaacctgcagaagatcaaggagaagctggagatcgccctggagaagcaccaggacagcagcatgagaaagttccaggagcagaacgagaccttccaggccaacagagccaagatggccgagggcctggccctggccctggccagaaaggaccaggagtggagcgagaagatggaccagctggagaaggagaagaacatcctgaccgcccagctgcaggagatgaagaaccagagcatgaacctgttccagagaagagacgagatggacgagctggagggcttccagcagcaggagctgagcaagatcaagcacatgctgctgaagaaggaggagagcctgggcaagatggagcaggagctggaggccagaaccagagagctgagcagaacccaggaggagctgatgaacagcaaccagatgagcagcgacctgagccagaagctggaggagctgcagagacactacagcaccctggaggagcagagagaccacgtgatcgccagcaagaccggcgccgagagcaagatcaccgccctggagcagaaggagcaggagctgcaggccctgatccagcagctgagcatcgacctgcagaaggtgaccgccgagacccaggagaaggaggacgtgatcacccacctgcaggagaaggtggccagcctggagaagagactggagcagaacctgagcggcgaggagcacctgcaggagctgctgaaggagaagaccctggccgagcagaacctggaggacaccagacagcagctgctggccgccagaagcagccaggccaaggccatcaacaccctggagaccagagtgagagagctggagcagaccctgcaggccagcgaggagcagctgcagcagagcaagggcatcgtggccgcccaggagacccagatccaggagctggccgccgccaaccaggagagcagccacgtgcagcagcaggccctggccctggagcagcagttcctggagagaacccaggccctggaggcccagatcgtggccctggagagaaccagagccgccgaccagaccaccgccgagcagggcatgagacagctggagcaggagaacgccgccctgaaggagtgcagaaacgagtacgagagaagcctgcagaaccaccagttcgagctgaagaagctgaaggaggagtggagccagagagagatcgtgagcgtggccatggcccaggccctggaggaggtgagaaagcagagagaggagttccagcagcaggccgccaacctgaccgccatcatcgacgagaaggagcagaacctgagagagaagaccgaggtgctgctgcagaaggagcaggagatcctgcagctggagagaggccacaacagcgccctgctgcagatccaccagctgcaggccgagctggaggccctgagaaccctgaaggccgaggaggccgccgtggtggccgagcaggaggacctgctgagactgagaggccccctgcaggccgaggccctgagcgtgaacgagagccacgtgaccagcagagccatgcaggaccccgtgttccagctgcccaccgccggcagaacccccaacggcgaggtgggcgccatggacctgacccagctgcagaaggagaagcaggacctggagcagcagctgctggagaagaacaagaccatcaagcagatgcagcagagaatgctggagctgagaaagaccctgcagaaggagctgaagatcagacccgacaacgagctgttcgaggtgagagagaagcccggccccgagatggccaacatggcccccagcgtgaccaacaacaccgacctgaccgacgccagagagatcaacttcgagtacctgaagcacgtggtgctgaagttcatgagctgcagagagagcgaggccttccacctgatcaaggccgtgagcgtgctgctgaacttcagccaggaggaggagaacatgctgaaggagaccctggagtacaagatgagctggttcggcagcaagcccgcccccaagggcagcatcagacccagcatcagcaaccccagaatcccctggagctag

SEQ ID NO: 10878 - DNA, 291 bp, Artificial Sequence
  Description of Artificial Sequence: Synthetic coding sequence
tgagccaagatcaaggccagagacctgagaggcaagaagaaggaggagctgctgaagcagctggacgacctgaaggtggagctgagccagctgagagtggccaaggtgaccggcggcgccgccagcaagctgagcaagatcagagtggtgagaaagagcatcgccagagtgctgaccgtgatcaaccagacccagaaggagaacctgagaaagttctacaaggccgccgccggcggcccctgcatccagatggacagagtgctgccccagccccccgcctgcagctgctag

SEQ ID NO: 10879 - DNA, 1035 bp, Artificial Sequence
  Description of Artificial Sequence: Synthetic coding sequence
atgagaagaagaagagaggaggagggcatccagctgagaaagcagaagagagagcagcagctgttcaagagaagaaacgtggagctgatcaacgaggaggccgccatgttcgacagcctgctgatggacagctacgtgagcagcaccaccggcgagagcgtgatcaccagagagatggtggagatgctgttcagcgacgacagcgacctgcagctggccaccacccagaagttcagaaagctgctgagcaaggagcccagcccccccatcgacgaggtgatcaacacccccagagtggtggacagattcgtggagttcctgaagagaaacgagaactgcaccctgcaggccgtgtgggccctgggcaacatcgccggcgacagcagcgtgtgcagagactacgtgctgaactgcagcatcctgaaccccctgctgaccctgctgaccaagagcaccagactgaccatgaccagaaacgccgtgtgggccctgagcaacctgtgcagaggcaagaaccccccccccgagttcgccaaggtgagcccctgcctgcccgtgctgagcagactgctgttcagcagcgacagcgacctgctggccgacgcctgctgggccctgagctacctgagcgacggccccaacgagaagatccaggccgtgatcgacagcggcgtgtgcagaagactggtggagctgctgatgcacaacgactacaaggtggccagccccgccctgagagccgtgggcaacatcgtgaccggcgacgacatccagacccaggtgatcctgaactgcagcgccctgccctgcctgctgcacctgctgagcagccccaaggagagcatcagaaaggaggcctgctggaccatcagcaacatcaccgccggcaacagagcccagatccaggccgtgatcgacgccaacatcttccccgtgctgatcgagatcctgcagaaggccgagttcagaaccagaaaggaggccgcctgggccatcaccaacgccaccagcggcggcacccccgagcagatctag

SEQ ID NO: 10880 - DNA, 582 bp, Artificial Sequence; identical to SEQ ID NO: 9313
  Description of Artificial Sequence: Synthetic coding sequence

SEQ ID NO: 10881 - DNA, 1611 bp, Artificial Sequence
  Description of Artificial Sequence: Synthetic coding sequence
atggagaccatggccagccccggcaaggacaactacagaatgaagagctacaagaacaacgccctgaaccccgaggagatgagaagaagaagagaggaggagggcatccagctgagaaagcagaagagagagcagcagctgttcaagagaagaaacgtggagctgatcaacgaggaggccgccatgttcgacagcctgctgatggacagctacgtgagcagcaccaccggcgagagcgtgatcaccagagagatggtggagatgctgttcagcgacgacagcgacctgcagctggccaccacccagaagttcagaaagctgctgagcaaggagcccagcccccccatcgacgaggtgatcaacacccccagagtggtggacagattcgtggagttcctgaagagaaacgagaactgcaccctgcagttcgaggccgcctgggccctgaccaacatcgccagcggcaccagccagcagaccaagatcgtgatcgaggccggcgccgtgcccatcttcatcgagctgctgaacagcgacttcgaggacgtgcaggagcaggccgtgtgggccctgggcaacatcgccggcgacagcagcgtgtgcagagactacgtgctgaactgcagcatcctgaaccccctgctgaccctgctgaccaagagcaccagactgaccatgaccagaaacgccgtgtgggccctgagcaacctgtgcagaggcaagaaccccccccccgagttcgccaaggtgagcccctgcctgcccgtgctgagcagactgctgttcagcagcgacagcgacctgctggccgacgcctgctgggccctgagctacctgagcgacggccccaacgagaagatccaggccgtgatcgacagcggcgtgtgcagaagactggtggagctgctgatgcacaacgactacaaggtggccagccccgccctgagagccgtgggcaacatcgtgaccggcgacgacatccagacccaggtgatcctgaactgcagcgccctgccctgcctgctgcacctgctgagcagccccaaggagagcatcagaaaggaggcctgctggaccatcagcaacatcaccgccggcaacagagcccagatccaggccgtgatcgacgccaacatcttccccgtgctgatcgagatcctgcagaaggccgagttcagaaccagaaaggaggccgcctgggccatcaccaacgccaccagcggcggcacccccgagcagatcagatacctggtgagcctgggctgcatcaagcccctgtgcgacctgctgaccgtgatggacagcaagatcgtgcaggtggccctgaacggcctggagaacatcctgagactgggcgagcaggagggcaagagaagcggcagcggcgtgaacccctactgcggcctgatcgaggaggcctacggcctggacaagatcgagttcctgcagagccacgagaaccaggagatctaccagaaggccttcgacctgatcgagcactacttcggcgtggaggacgacgacagcagcctggccccccaggtggacgagacccagcagcagttcatcttccagcagcccgaggcccccatggagggcttccagctgtag

SEQ ID NO: 10882 - DNA, 2769 bp, Artificial Sequence
  Description of Artificial Sequence: Synthetic coding sequence
atgatcaccagcgccgccggcatcatcagcctgctggacgaggacgagccccagctgaaggagttcgccctgcacaagctgaacgccgtggtgaacgacttctgggccgagatcagcgagagcgtggacaagatcgaggtgctgtacgaggacgagggcttcagaagcagacagttcgccgccctggtggccagcaaggtgttctaccacctgggcgccttcgaggagagcctgaactacgccctgggcgccggcgacctgttcaacgtgaacgacaacagcgagtacgtggagaccatcatcgccaagtgcatcgaccactacaccaagcagtgcgtggagaacgccgacctgcccgagggcgagaagaagcccatcgaccagagactggagggcatcgtgaacaagatgttccagagatgcctggacgaccacaagtacaagcaggccatcggcatcgccctggagaccagaagactggacgtgttcgagaagaccatcctggagagcaacgacgtgcccggcatgctggcctacagcctgaagctgtgcatgagcctgatgcagaacaagcagttcagaaacaaggtgctgagagtgctggtgaagatctacatgaacctggagaagcccgacttcatcaacgtgtgccagtgcctgatcttcctggacgacccccaggccgtgagcgacatcctggagaagctggtgaaggaggacaacctgctgatggcctaccagatctgcttcgacctgtacgagagcgccagccagcagttcctgagcagcgtgatccagaacctgagaaccgtgggcacccccatcgccagcgtgcccggcagcaccaacaccggcaccgtgcccggcagcgagaaggacagcgacagcatggagaccgaggagaagaccagcagcgccttcgtgggcaagacccccgaggccagccccgagcccaaggaccagaccctgaagatgatcaagatcctgagcggcgagatggccatcgagctgcacctgcagttcctgatcagaaacaacaacaccgacctgatgatcctgaagaacaccaaggacgccgtgagaaacagcgtgtgccacaccgccaccgtgatcgccaacagcttcatgcactgcggcaccaccagcgaccagttcctgagagacaacctggagtggctggccagagccaccaactgggccaagttcaccgccaccgccagcctgggcgtgatccacaagggccacgagaaggaggccctgcagctgatggccacctacctgcccaaggacaccagccccggcagcgcctaccaggagggcggcggcctgtacgccctgggcctgatccacgccaaccacggcggcgacatcatcgactacctgctgaaccagctgaagaacgccagcaacgacatcgtgagacacggcggcagcctgggcctgggcctggccgccatgggcaccgccagacaggacgtgtacgacctgctgaagaccaacctgtaccaggacgacgccgtgaccggcgaggccgccggcctggccctgggcctggtgatgctgggcagcaagaacgcccaggccatcgaggacatggtgggctacgcccaggagacccagcacgagaagatcctgagaggcctggccgtgggcatcgccctggtgatgtacggcagaatggaggaggccgacgccctgatcgagagcctgtgcagagacaaggaccccatcctgagaagaagcggcatgtacaccgtggccatggcctactgcggcagcggcaacaacaaggccatcagaagactgctgcacgtggccgtgagcgacgtgaacgacgacgtgagaagagccgccgtggagagcctgggcttcatcctgttcagaacccccgagcagtgccccagcgtggtgagcctgctgagcgagagctacaacccccacgtgagatacggcgccgccatggccctgggcatctgctgcgccggcaccggcaacaaggaggccatcaacctgctggagcccatgaccaacgaccccgtgaactacgtgagacagggcgccctgatcgccagcgccctgatcatgatccagcagaccgagatcacctgccccaaggtgaaccagttcagacagctgtacagcaaggtgatcaacgacaagcacgacgacgtgatggccaagttcggcgccatcctggcccagggcatcctggacgccggcggccacaacgtgaccatcagcctgcagagcagaaccggccacacccacatgcccagcgtggtgggcgtgctggtgttcacccagttctggttctggttccccctgagccacttcctgagcctggcctacacccccacctgcgtgatcggcctgaacaaggacctgaaggtgagcaccgccgtgctgagcatcaccgccaaggccaagaagaaggagaaggagaaggagaagaaggaggaggagaagatggaggtggacgaggccgagaagaaggaggagaaggagaagaagaaggagcccgagcccaacttccagctgctggacaaccccgccagagtgatgcccgcccagctgaaggtgctgaccatgcccgagacctgcagataccagcccttcaagcccctgagcatcggcggcatcatcatcctgaaggacaccagcgaggacatcgaggagctggtggagcccgtggccgcccacggccccaagatcgaggaggaggagcaggagcccgagccccccgagcccttcgagtacatcgacgactag

SEQ ID NO: 10883 - DNA, 1227 bp, Artificial Sequence
  Description of Artificial Sequence: Synthetic coding sequence
atgcccgaggagcaggccttcagcgtgctggtgaagatcatgttcgactacggcctgagagagctgttcaagcagaacttcgaggacctgcactgcaagttctaccagctggagagactgatgcaggagtacatccccgacctgtacaaccacttcctggacatcagcctggaggcccacatgtacgccagccagtggttcctgaccctgttcaccgccaagttccccctgtacatggtgttccacatcatcgacctgctgctgtgcgagggcatcagcgtgatcttcaacgtggccctgggcctgctgaagaccagcaaggacgacctgctgctgaccgacttcgagggcgccctgaagttcttcagagtgcagctgcccaagagatacagaagcgaggagaacgccaagaagctgatggagctggcctgcaacatgaagatcagccagaagaagctgaagaagtacgagaaggagtaccacaccatgagagagcagcaggcccagcaggaggaccccatcgagagattcgagagagagaacagaagactgcaggaggccaacatgagactggagcaggagaacgacgacctggcccacgagctggtgaccagcaagatcgccctgagaaaggacctggacaacgccgaggagaaggccgacgccctgaacaaggagctgctgatgaccaagcagaagctgatcgacgccgaggaggagaagagaagactggaggaggagagcgcccagctgaaggagatgtgcagaagagagctggacaaggccgagagcgagatcaagaagaacagcagcatcatcggcgactacaagcagatctgcagccagctgagcgagagactggagaagcagcagaccgccaacaaggtggagatcgagaagatcagacagaaggtggacgactgcgagagatgcagagagttcttcaacaaggagggcagagtgaagggcatcagcagcaccaaggaggtgctggacgaggacaccgacgaggagaaggagaccctgaagaaccagctgagagagatggagctggagctggcccagaccaagctgcagctggtggaggccgagtgcaagatccaggacctggagcaccacctgggcctggccctgaacgaggtgcaggccgccaagaagacctggttcaacagaaccctgagcagcatcaagaccgccaccggcgtgcagggcaaggagacctgctag

SEQ ID NO: 10884 - DNA, 3210 bp, Artificial Sequence
  Description of Artificial Sequence: Synthetic coding sequence
atggacgacaaggccagcgtgggcaagatcagcgtgagcagcgacagcgtgagcaccctgaacagcgaggacttcgtgctggtgagcagacagggcgacgagacccccagcaccaacaacggcagcgacgacgagaagaccggcctgaagatcgtgggcaacggcagcgagcagcagctgcagaaggagctggccgacgtgctgatggacccccccatggacgaccagcccggcgagaaggagctggtgaagagaagccagctggacggcgagggcgacggccccctgagcaaccagctgagcgccagcagcaccatcaaccccgtgcccctggtgggcctgcagaagcccgagatgagcctgcccgtgaagcccggccagggcgacagcgaggccagcagccccttcacccccgtggccgacgaggacagcgtggtgttcagcaagctgacctacctgggctgcgccagcgtgaacgcccccagaagcgaggtggaggccctgagaatgatgagcatcctgagaagccagtgccagatcagcctggacgtgaccctgagcgtgcccaacgtgagcgagggcatcgtgagactgctggacccccagaccaacaccgagatcgccaactaccccatctacaagatcctgttctgcgtgagaggccacgacggcacccccgagagcgactgcttcgccttcaccgagagccactacaacgccgagctgttcagaatccacgtgttcagatgcgagatccaggaggccgtgagcagaatcctgtacagcttcgccaccgccttcagaagaagcgccaagcagacccccctgagcgccaccgccgccccccagacccccgacagcgacatcttcaccttcagcgtgagcctggagatcaaggaggacgacggcaagggctacttcagcgccgtgcccaaggacaaggacagacagtgcttcaagctgagacagggcatcgacaagaagatcgtgatctacgtgcagcagaccaccaacaaggagctggccatcgagagatgcttcggcctgctgctgagccccggcaaggacgtgagaaacagcgacatgcacctgctggacctggagagcatgggcaagagcagcgacggcaagagctacgtgatcaccggcagctggaaccccaagagcccccacttccaggtggtgaacgaggagacccccaaggacaaggtgctgttcatgaccaccgccgtggacctggtgatcaccgaggtgcaggagcccgtgagattcctgctggagaccaaggtgagagtgtgcagccccaacgagagactgttctggcccttcagcaagagaagcaccaccgagaacttcttcctgaagctgaagcagatcaagcagagagagagaaagaacaacaccgacaccctgtacgaggtggtgtgcctggagagcgagagcgagagagagagaagaaagaccaccgccagccccagcgtgagactgccccagagcggcagccagagcagcgtgatccccagcccccccgaggacgacgaggaggaggacaacgacgagcccctgctgagcggcagcggcgacgtgagcaaggagtgcgccgagaagatcctggagacctggggcgagctgctgagcaagtggcacctgaacctgaacgtgagacccaagcagctgagcagcctggtgagaaacggcgtgcccgaggccctgagaggcgaggtgtggcagctgctggccggctgccacaacaacgaccacctggtggagaagtacagaatcctgatcaccaaggagagcccccaggacagcgccatcaccagagacatcaacagaaccttccccgcccacgactacttcaaggacaccggcggcgacggccaggacagcctgtacaagatctgcaaggcctacagcgtgtacgacgaggagatcggctactgccagggccagagcttcctggccgccgtgctgctgctgcacatgcccgaggagcaggccttcagcgtgctggtgaagatcatgttcgactacggcctgagagagctgttcaagcagaacttcgaggacctgcactgcaagttctaccagctggagagactgatgcaggagtacatccccgacctgtacaaccacttcctggacatcagcctggaggcccacatgtacgccagccagtggttcctgaccctgttcaccgccaagttccccctgtacatggtgttccacatcatcgacctgctgctgtgcgagggcatcagcgtgatcttcaacgtggccctgggcctgctgaagaccagcaaggacgacctgctgctgaccgacttcgagggcgccctgaagttcttcagagtgcagctgcccaagagatacagaagcgaggagaacgccaagaagctgatggagctggcctgcaacatgaagatcagccagaagaagctgaagaagtacgagaaggagtaccacaccatgagagagcagcaggcccagcaggaggaccccatcgagagattcgagagagagaacagaagactgcaggaggccaacatgagactggagcaggagaacgacgacctggcccacgagctggtgaccagcaagatcgccctgagaaaggacctggacaacgccgaggagaaggccgacgccctgaacaaggagctgctgatgaccaagcagaagctgatcgacgccgaggaggagaagagaagactggaggaggagagcgcccagctgaaggagatgtgcagaagagagctggacaaggccgagagcgagatcaagaagaacagcagcatcatcggcgactacaagcagatctgcagccagctgagcgagagactggagaagcagcagaccgccaacaaggtggagatcgagaagatcagacagaaggtggacgactgcgagagatgcagagagttcttcaacaaggagggcagagtgaagggcatcagcagcaccaaggaggtgctggacgaggacaccgacgaggagaaggagaccctgaagaaccagctgagagagatggagctggagctggcccagaccaagctgcagctggtggaggccgagtgcaagatccaggacctggagcaccacctgggcctggccctgaacgaggtgcaggccgccaagaagacctggttcaacagaaccctgagcagcatcaagaccgccaccggcgtgcagggcaaggagacctgctag

SEQ ID NO: 10885 - DNA, 2808 bp, Artificial Sequence
  Description of Artificial Sequence: Synthetic coding sequence
atgcagagaaagctggtgaccctggtgaactgccagctggtggaggaggagggcagagtgagagccatgagagccgccagaagcctgggcgagagaaccgtgaccgagctgatcctgcagcaccagaacccccagcagctgagcgccaacctgtgggccgccgtgagagccagaggctgccagttcctgggccccgccatgcaggaggaggccctgaagctggtgctgctggccctggaggacggcagcgccctgagcagaaaggtgctggtgctgttcgtggtgcagagactggagcccagattcccccaggccagcaagaccagcatcggccacgtggtgcagctgctgtacagagccagctgcttcaaggtgaccaagagagacgaggacagcagcctgatgcagctgaaggaggagttcagaagctacgaggccctgagaagagagcacgacgcccagatcgtgcacatcgccatggaggccggcctgagaatcagccccgagcagtggagcagcctgctgtacggcgacctggcccacaagagccacatgcagagcatcatcgacaagctgcagagccccgagagcttcgccaagagcgtgcaggagctgaccatcgtgctgcagagaaccggcgaccccgccaacctgaacagactgagaccccacctggagctgctggccaacatcgaccccaaccccgacgccgtgagccccacctgggagcagctggagaacgccatggtggccgtgaagaccgtggtgcacggcctggtggacttcatccagaactacagcagaaagggccacgagaccccccagccccagcccaacagcaagtacaagaccagcatgtgcagagacctgagacagcagggcggctgccccagaggcaccaactgcaccttcgcccacagccaggaggagctggagaagtacagactgagaaacaagaagatcaacgccaccgtgagaaccttccccctgctgaacaaggtgggcgtgaacaacaccgtgaccaccaccgccggcaacgtgatcagcgtgatcggcagcaccgagaccaccggcaagatcgtgcccagcaccaacggcatcagcaacgccgagaacagcgtgagccagctgatcagcagaagcaccgacagcaccctgagagccctggagaccgtgaagaaggtgggcaaggtgggcgccaacggccagaacgccgccggccccagcgccgacagcgtgaccgagaacaagatcggcagcccccccaagacccccgtgagcaacgtggccgccaccagcgccggccccagcaacgtgggcaccgagctgaacagcgtgccccagaagagcagccccttcctgaccagagtgcccgtgtaccccccccacagcgagaacatccagtacttccaggaccccagaacccagatccccttcgaggtgccccagtacccccagaccggctactacccccccccccccaccgtgcccgccggcgtggccccctgcgtgcccagattcgtgagaagcaacaacgtgcccgagagcagcctgccccccgccagcatgccctacgccgaccactacagcaccttcagccccagagacagaatgaacagcagcccctaccagcccccccccccccagccctacggccccgtgccccccgtgcccagcggcatgtacgcccccgtgtacgacagcagaagaatctggagaccccccatgtaccagagagacgacatcatcagaagcaacagcctgccccccatggacgtgatgcacagcagcgtgtaccagaccagcctgagagagagatacaacagcctggacggctactacagcgtggcctgccagccccccagcgagcccagaaccaccgtgcccctgcccagagagccctgcggccacctgaagaccagctgcgaggagcagatcagaagaaagcccgaccagtgggcccagtaccacacccagaaggcccccctggtgagcagcaccctgcccgtggccacccagagccccaccccccccagccccctgttcagcgtggacttcagagccgacttcagcgagagcgtgagcggcaccaagttcgaggaggaccacctgagccactacagcccctggagctgcggcaccatcggcagctgcatcaacgccatcgacagcgagcccaaggacgtgatcgccaacagcaacgccgtgctgatggacctggacagcggcgacgtgaagagaagagtgcacctgttcgagacccagagaagaaccaaggaggaggaccccatcatccccttcagcgacggccccatcatcagcaagtggggcgccatcagcagaagcagcagaaccggctaccacaccaccgaccccgtgcaggccaccgccagccagggcagcgccaccaagcccatcagcgtgagcgactacgtgccctacgtgaacgccgtggacagcagatggagcagctacggcaacgaggccaccagcagcgcccactacgtggagagagacagattcatcgtgaccgacctgagcggccacagaaagcacagcagcaccggcgacctgctgagcctggagctgcagcaggccaagagcaacagcctgctgctgcagagagaggccaacgccctggccatgcagcagaagtggaacagcctggacgagggcagacacctgaccctgaacctgctgagcaaggagatcgagctgagaaacggcgaggtgaagaagctgaacctgagcgccagctgcctgatgtacctgttcagcgccgccgccagctggctgtaccactactag

SEQ ID NO: 10886 - DNA, 1437 bp, Artificial Sequence
  Description of Artificial Sequence: Synthetic coding sequence
atgcccgtgcaggccgcccagtggaccgagttcctgagctgccccatctgctacaacgagttcgacgagaacgtgcacaagcccatcagcctgggctgcagccacaccgtgtgcaagacctgcctgaacaagctgcacagaaaggcctgccccttcgaccagaccgccatcaacaccgacatcgacgtgctgcccgtgaacttcgccctgctgcagctggtgggcgcccaggtgcccgaccaccagagcatcaagctgagcaacctgggcgagaacaagcactacgaggtggccaagaagtgcgtggaggacctggccctgtacctgaagcccctgagcggcggcaagggcgtggccagcctgaaccagagcgccctgagcagacccatgcagagaaagctggtgaccctggtgaactgccagctggtggaggaggagggcagagtgagagccatgagagccgccagaagcctgggcgagagaaccgtgaccgagctgatcctgcagcaccagaacccccagcagctgagcgccaacctgtgggccgccgtgagagccagaggctgccagttcctgggccccgccatgcaggaggaggccctgaagctggtgctgctggccctggaggacggcagcgccctgagcagaaaggtgctggtgctgttcgtggtgcagagactggagcccagattcccccaggccagcaagaccagcatcggccacgtggtgcagctgctgtacagagccagctgcttcaaggtgaccaagagagacgaggacagcagcctgatgcagctgaaggaggagttcagaagctacgaggccctgagaagagagcacgacgcccagatcgtgcacatcgccatggaggccggcctgagaatcagccccgagcagtggagcagcctgctgtacggcgacctggcccacaagagccacatgcagagcatcatcgacaagctgcagagccccgagagcttcgccaagagcgtgcaggagctgaccatcgtgctgcagagaaccggcgaccccgccaacctgaacagactgagaccccacctggagctgctggccaacatcgaccccaaccccgacgccgtgagccccacctgggagcagctggagaacgccatggtggccgtgaagaccgtggtgcacggcctggtggacttcatccagaactacagcagaaagggccacgagaccccccagccccagcccaacagcaagtacaagaccagcatgtgcagagacctgagacagcagggcggctgccccagaggcaccaactgcaccttcgcccacagccaggaggagctggagaagtacagactgagaaacaagaagatcaacgccaccgaggtgctgaagcagcagggcaagctgttccaggtgcagaccgagttccagatgcagaagaccgtgttccccagctag

SEQ ID NO: 10887 - DNA, 3576 bp, Artificial Sequence; identical to SEQ ID NO: 10440
  Description of Artificial Sequence: Synthetic coding sequence

SEQ ID NO: 10888 - DNA, 1569 bp, Artificial Sequence
  Description of Artificial Sequence: Synthetic coding sequence
atggccgccagcgccaagagaaagcaggaggagaagcacctgaagatgctgagagacatgaccggcctgccccacaacagaaagtgcttcgactgcgaccagagaggccccacctacgtgaacatgaccgtgggcagcttcgtgtgcaccagctgcagcggcagcctgagaggcctgaaccccccccacagagtgaagagcatcagcatgaccaccttcacccagcaggagatcgagttcctgcagaagcacggcaacgaggtgtgcaagcagatctggctgggcctgttcgacgacagaagcagcgccatccccgacttcagagacccccagaaggtgaaggagttcctgcaggagaagtacgagaagaagagatggtacgtgccccccgagcaggccaaggtggtggccagcgtgcacgccagcatcagcggcagcagcgccagcagcaccagcagcacccccgaggtgaagcccctgaagagcctgctgggcgacagcgcccccaccctgcacctgaacaagggcacccccagccagagccccgtggtgggcagaagccagggccagcagcaggagaagaagcagttcgacctgctgagcgacctgggcagcgacatcttcgccgcccccgccccccagagcaccgccaccgccaacttcgccaacttcgcccacttcaacagccacgccggcggcagcgccgccagcgtgaacgccaacttcgcccacttcgacaacttccccaagagcagcagcgccgacttcggcaccttcaacaccagccagagccaccagaccgccagcgccgtgagcaaggtgagcaccaacaaggccggcctgcagaccgccgacaagtacgccgccctggccaacctggacaacatcttcagcgccggccagggcggcgaccagggcagcggcttcggcaccaccggcaaggcccccgtgggcagcgtggtgagcgtgcccagccagagcagcgccagcagcgacaagtacgccgccctggccgagctggacagcgtgttcagcagcgccgccaccagcagcaacgcctacaccagcaccagcaacgccagcagcaacgtgttcggcaccgtgcccgtggtggccagcgcccagacccagcccgccagcagcagcgtgcccgcccccttcggcgccacccccagcaccaaccccttcgtggccgccgccggccccagcgtggccagcagcaccaaccccttccagaccaacgccagaggcgccaccgccgccaccttcggcaccgccagcatgagcatgcccaccggcttcggcacccccgccccctacagcctgcccaccagcttcagcggcagcttccagcagcccgccttccccgcccaggccgccttcccccagcagaccgccttcagccagcagcccaacggcgccggcttcgccgccttcggccagaccaagcccgtggtgacccccttcggccaggtggccgccgccggcgtgagcagcaaccccttcatgaccggcgcccccaccggccagttccccaccggcagcagcagcaccaaccccttcctgtag

SEQ ID NO: 10889 - DNA, 1524 bp, Artificial Sequence
  Description of Artificial Sequence: Synthetic coding sequence
atgcaggacgacagcatcgaggccagcaccagcatcagccagctgctgagagagagctacctggccgagaccagacacagaggcaacaacgagagaagcagagccgagcccagcagcaacccctgccacttcggcagccccagcggcgccgccgagggcggcggcggccaggacgacctgcccgacctgagcgccttcctgagccaggaggagctggacgagagcgtgaacctggccagactggccatcaactacgaccccctggagaaggccgacgagacccaggccagaaagagactgagccccgaccagatgaagcacagccccaacctgagcttcgagcccaacttctgccaggacaaccccagaagccccaccagcagcaaggagagcccccaggaggccaagagaccccagtactgcagcgagacccagagcaagaaggtgttcctgaacaaggccgccgacttcatcgaggagctgagcagcctgttcaagagccacagcagcaagagaatcagacccagagcctgcaagaaccacaagagcaagctggagagccagaacaaggtgatgcaggagaacagcagcagcttcagcgacctgagcgagagaagagagagaagcagcgtgcccatccccatccccgccgacaccagagacaacgaggtgaaccacgccctggagcagcaggaggccaagagaagagaggccgagcaggccgccagcgaggccgccggcggcgacaccacccccggcagcagccccagcagcctgtactacgaggagcccctgggccagccccccagattcacccagaagctgagaagcagagaggtgcccgagggcaccagagtgcagctggactgcatcgtggtgggcatcccccccccccaggtgagatggtactgcgagggcaaggagctggagaacagccccgacatccacatcgtgcaggccggcaacctgcacagcctgaccatcgccgaggccttcgaggaggacaccggcagatacagctgcttcgccagcaacatctacggcaccgacagcaccagcgccgagatctacatcgagggcgtgagcagcagcgacagcgagggcgaccccaacaaggaggagatgaacagaatccagaagcccaacgaggtgagcagcccccccaccaccagcgccgtgatcccccccgccgtgccccaggcccagcacctggtggcccagcccagagtggccaccatccagcagtgccagagccccaccaactacctgcagggcctggacggcaagcccatcatcgccgcccccgtgttcaccaagatgctgcagaacctgagcgccagcgagggccagctggtggtgttcgagtgcagagtgaagggcgcccccagccccaaggtggagtggtacagagagggcaccctgatcgaggacagccccgacttcagaatcctgcagaagaagcccagaagcatggccgagcccggcaaggacgacttcaacttcaacctgctggtgtacgagtag

SEQ ID NO: 10890 - DNA, 3150 bp, Artificial Sequence
  Description of Artificial Sequence: Synthetic coding sequence
atgctgtgctggggcaacgccagcttcggccagctgggcctgggcggcatcgacgaggagatcgtgctggagcccagaaagagcgacttcttcatcaacaagagagtgagagacgtgggctgcggcctgagacacaccgtgttcgtgctggacgacggcaccgtgtacacctgcggctgcaacgacctgggccagctgggccacgagaagagcagaaagaagcccgagcaggtggtggccctggacgcccagaacatcgtggccgtgagctgcggcgaggcccacaccctggccctgaacgacaagggccaggtgtacgcctggggcctggacagcgacggccagctgggcctggtgggcagcgaggagtgcatcagagtgcccagaaacatcaagagcctgagcgacatccagatcgtgcaggtggcctgcggctactaccacagcctggccctgagcaaggccagcgaggtgttctgctggggccagaacaagtacggccagctgggcctgggcaccgactgcaagaagcagaccagcccccagctgctgaagagcctgctgggcatccccttcatgcaggtggccgccggcggcgcccacagcttcgtgctgaccctgagcggcgccatcttcggctggggcagaaacaagttcggccagctgggcctgaacgacgagaacgacagatacgtgcccaacctgctgaagagcctgagaagccagaagatcgtgtacatctgctgcggcgaggaccacaccgccgccctgaccaaggagggcggcgtgttcaccttcggcgccggcggctacggccagctgggccacaacagcaccagccacgagatcaaccccagaaaggtgttcgagctgatgggcagcatcgtgaccgagatcgcctgcggcagacagcacaccagcgccttcgtgcccagcagcggcagaatctacagcttcggcctgggcggcaacggccagctgggcaccggcagcaccagcaacagaaagagccccttcaccgtgaagggcaactggtacccctacaacggccagtgcctgcccgacatcgacagcgaggagtacttctgcgtgaagagaatcttcagcggcggcgaccagagcttcagccactacagcagcccccagaactgcggcccccccgacgacttcagatgccccaaccccaccaagcagatctggaccgtgaacgaggccctgatccagaagtggctgagctaccccagcggcagattccccgtggagatcgccaacgagatcgacggcaccttcagcagcagcggctgcctgaacggcagcttcctggccgtgagcaacgacgaccactacagaaccggcaccagattcagcggcgtggacatgaacgccgccagactgctgttccacaagctgatccagcccgaccacccccagatcagccagcaggtggccgccagcctggagaagaacctgatccccaagctgaccagcagcctgcccgacgtggaggccctgagattctacctgaccctgcccgagtgccccctgatgagcgacagcaacaacttcaccaccatcgccatccccttcggcaccgccctggtgaacctggagaaggcccccctgaaggtgctggagaactggtggagcgtgctggagccccccctgttcctgaagatcgtggagctgttcaaggaggtggtggtgcacctgctgaagctgtacaagatcggcatcccccccagcgagagaagaatcttcaacagcttcctgcacaccgccctgaaggtgctggagatcctgcacagagtgaacgagaagatgggccagatcatccagtacgacaagttctacatccacgaggtgcaggagctgatcgacatcagaaacgactacatcaactgggtgcagcagcaggcctacggcatgctggccgacatccccgtgaccatctgcacctaccccttcgtgttcgacgcccaggccaagaccaccctgctgcagaccgacgccgtgctgcagatgcagatggccatcgaccaggcccacagacagaacgtgagcagcctgttcctgcccgtgatcgagagcgtgaacccctgcctgatcctggtggtgagaagagagaacatcgtgggcgacgccatggaggtgctgagaaagaccaagaacatcgactacaagaagcccctgaaggtgatcttcgtgggcgaggacgccgtggacgccggcggcgtgagaaaggagttcttcctgctgatcatgagagagctgctggaccccaagtacggcatgttcagatactacgaggacagcagactgatctggttcagcgacaagaccttcgaggacagcgacctgttccacctgatcggcgtgatctgcggcctggccatctacaactgcaccatcgtggacctgcacttccccctggccctgtacaagaagctgctgaagaagaagcccagcctggacgacctgaaggagctgatgcccgacgtgggcagaagcatgcagcagctgctggactaccccgaggacgacatcgaggagaccttctgcctgaacttcaccatcaccgtggagaacttcggcgccaccgaggtgaaggagctggtgctgaacggcgccgacaccgccgtgaacaagcagaacagacaggagttcgtggacgcctacgtggactacatcttcaacaagagcgtggccagcctgttcgacgccttccacgccggcttccacaaggtgtgcggcggcaaggtgctgctgctgttccagcccaacgagctgcaggccatggtgatcggcaacaccaactacgactggaaggagctggagaagaacaccgagtacaagggcgagtactgggccgagcaccccaccatcaagatcttctgggaggtgttccacgagctgcccctggagaagaagaagcagttcctgctgttcctgaccggcagcgacagaatccccatcctgggcatgaagagcctgaagctggtgatccagagcaccggcggcggcgaggagtacctgcccgtgagccacacctgcttcaacctgctggacctgcccaagtacaccgagaaggagaccctgagaagcaagctgatccaggccatcgaccacaacgagggcttcagcctgatctag

SEQ ID NO: 10891 - DNA, 726 bp, Artificial Sequence; identical to SEQ ID NO: 10281
  Description of Artificial Sequence: Synthetic coding sequence

SEQ ID NO: 10892 - DNA, 870 bp, Artificial Sequence
  Description of Artificial Sequence: Synthetic coding sequence
atgatcatcaactggaaccaggtgagcgtgctgtggaagtgcctgctgaagcagagcgccagctaccaggacagaagacagagctggagaagagccagcatgaaggagaccaacagaagaaagagcctgcaccccatccaccagggcatcaccgagctgagcagaagcatcagcgtggacctggccgagagcaagagactgggctgcctgctgctgagcagcttccagttcagcatccagaagctggagcccttcctgagagacaccaagggcttcagcctggagagcttcagagccaaggccagcagcctgagcgaggagctgaagcacttcgccgacggcctggagaccgacggcaccctgcagaagtgcttcgaggacagcaacggcaaggccagcgacttcagcctggaggccagcgtggccgagatgaaggagtacatcaccaagttcagcctggagagacagacctgggaccagctgctgctgcactaccagcaggaggccaaggagatcctgagcagaggcagcaccgaggccaagatcaccgaggtgaaggtggagcccatgacctacctgggcagcagccagaacgaggtgctgaacaccaagcccgactaccagaagatcctgcagaaccagagcaaggtgttcgactgcatggagctggtgatggacgagctgcagggcagcgtgaagcagctgcaggccttcatggacgagagcacccagtgcttccagaaggtgagcgtgcagctgggcaagagaagcatgcagcagctggaccccagccccgccagaaagctgctgaagctgcagctgcagaacccccccgccatccacggcagcggcagcggcagctgccagtag

SEQ ID NO: 10893 - DNA, 750 bp, Artificial Sequence
  Description of Artificial Sequence: Synthetic coding sequence
atgaccagcgtgaccagaagcgagatcatcgacgagctgagcagaagcatcagcgtggacctggccgagagcaagagactgggctgcctgctgctgagcagcttccagttcagcatccagaagctggagcccttcctgagagacaccaagggcttcagcctggagagcttcagagccaaggccagcagcctgagcgaggagctgaagcacttcgccgacggcctggagaccgacggcaccctgcagaagtgcttcgaggacagcaacggcaaggccagcgacttcagcctggaggccagcgtggccgagatgaaggagtacatcaccaagttcagcctggagagacagacctgggaccagctgctgctgcactaccagcaggaggccaaggagatcctgagcagaggcagcaccgaggccaagatcaccgaggtgaaggtggagcccatgacctacctgggcagcagccagaacgaggtgctgaacaccaagcccgactaccagaagatcctgcagaaccagagcaaggtgttcgactgcatggagctggtgatggacgagctgcagggcagcgtgaagcagctgcaggccttcatggacgagagcacccagtgcttccagaaggtgagcgtgcagctgggcaagagaagcatgcagcagctggaccccagccccgccagaaagctgctgaagctgcagctgcagaacccccccgccatccacggcagcggcagcggcagctgccagtag

SEQ ID NO: 10894 - DNA, 855 bp, Artificial Sequence
  Description of Artificial Sequence: Synthetic coding sequence
atgaccagcgtgaccagaagcgagatcatcgacgagcagagcgccagctaccaggacagaagacagagctggagaagagccagcatgaaggagaccaacagaagaaagagcctgcaccccatccaccagggcatcaccgagctgagcagaagcatcagcgtggacctggccgagagcaagagactgggctgcctgctgctgagcagcttccagttcagcatccagaagctggagcccttcctgagagacaccaagggcttcagcctggagagcttcagagccaaggccagcagcctgagcgaggagctgaagcacttcgccgacggcctggagaccgacggcaccctgcagaagtgcttcgaggacagcaacggcaaggccagcgacttcagcctggaggccagcgtggccgagatgaaggagtacatcaccaagttcagcctggagagacagacctgggaccagctgctgctgcactaccagcaggaggccaaggagatcctgagcagaggcagcaccgaggccaagatcaccgaggtgaaggtggagcccatgacctacctgggcagcagccagaacgaggtgctgaacaccaagcccgactaccagaagatcctgcagaaccagagcaaggtgttcgactgcatggagctggtgatggacgagctgcagggcagcgtgaagcagctgcaggccttcatggacgagagcacccagtgcttccagaaggtgagcgtgcagctgggcaagagaagcatgcagcagctggaccccagccccgccagaaagctgctgaagctgcagctgcagaacccccccgccatccacggcagcggcagcggcagctgccagtag

SEQ ID NO: 10895 - DNA, 1071 bp, Artificial Sequence
  Description of Artificial Sequence: Synthetic coding sequence
atgaccagcgtgaccagaagcgagatcatcgacgagaagggccccgtgatgagcaagacccacgaccaccagctggagagcagcctgagccccgtggaggtgttcgccaagaccagcgccagcctggagatgaaccagggcgtgagcgaggagagaatccacctgggcagcagccccaagaagggcggcaactgcgacctgagccaccaggagagactgcagagcaagagcctgcacctgagcccccaggagcagagcgccagctaccaggacagaagacagagctggagaagagccagcatgaaggagaccaacagaagaaagagcctgcaccccatccaccagggcatcaccgagctgagcagaagcatcagcgtggacctggccgagagcaagagactgggctgcctgctgctgagcagcttccagttcagcatccagaagctggagcccttcctgagagacaccaagggcttcagcctggagagcttcagagccaaggccagcagcctgagcgaggagctgaagcacttcgccgacggcctggagaccgacggcaccctgcagaagtgcttcgaggacagcaacggcaaggccagcgacttcagcctggaggccagcgtggccgagatgaaggagtacatcaccaagttcagcctggagagacagacctgggaccagctgctgctgcactaccagcaggaggccaaggagatcctgagcagaggcagcaccgaggccaagatcaccgaggtgaaggtggagcccatgacctacctgggcagcagccagaacgaggtgctgaacaccaagcccgactaccagaagatcctgcagaaccagagcaaggtgttcgactgcatggagctggtgatggacgagctgcagggcagcgtgaagcagctgcaggccttcatggacgagagcacccagtgcttccagaaggtgagcgtgcagctgggcaagagaagcatgcagcagctggaccccagccccgccagaaagctgctgaagctgcagctgcagaacccccccgccatccacggcagcggcagcggcagctgccagtag

SEQ ID NO: 10896 - DNA, 1071 bp, Artificial Sequence; identical to SEQ ID NO: 10895
  Description of Artificial Sequence: Synthetic coding sequence

SEQ ID NO: 10897 - DNA, 1617 bp, Artificial Sequence
  Description of Artificial Sequence: Synthetic coding sequence
atggccgccgccgccagcgtgaccggcagagtgacctgggccgccagccccatgagaagcctgggcctgggcagaagactgagcctgcccggccccagactggacgccgtgaccgccgccgtgaaccccagcctgagcgaccacggcaacggcctgggcagaggcaccagaggcagcggctgcagcggcggcagcctggtggccgactggggcggcggcgccgccgccgccgccgccgtggccctggccctggcccccgccctgagcaccatgagaagaggcagcagcgagagcgagctggccgccagatgggaggccgaggccgtggccgccgccaaggccgccgccaaggccgaggccgaggccaccgccgagaccgtggccgagcaggtgagagtggacgccggcgccgccggcgagcccgagtgcaaggccggcgaggagcagcccaaggtgctggcccccgcccccgcccagcccagcgccgccgaggagggcaacacccaggtgctgcagagacccccccccaccctgccccccagcaagcccaagcccgtgcagggcctgtgcccccacggcaagcccagagacaagggcagaagctgcaagagaagcagcggccacggcagcggcgagaacggcagccagagacccgtgaccgtggacagcagcaaggccagaaccagcctggacgccctgaagatcagcatcagacagctgaagtggaaggagttccccttcggcagaagactgccctgcgacatctactggcacggcgtgagcttccacgacaacgacatcttcagcggccaggtgaacaagttccccggcatgaccgagatggtgagaaagatcaccctgagcagagccgtgagaaccatgcagaacctgttccccgaggagtacaacttctaccccagaagctggatcctgcccgacgagttccagctgttcgtggcccaggtgcagatggtgaaggacgacgaccccagctggaagcccaccttcatcgtgaagcccgacggcggctgccagggcgacggcatctacctgatcaaggaccccagcgacatcagactggccggcaccctgcagagcagacccgccgtggtgcaggagtacatctgcaagcccctgctgatcgacaagctgaagttcgacatcagactgtacgtgctgctgaagagcctggaccccctggagatctacatcgccaaggacggcctgagcagattctgcaccgagccctaccaggagcccacccccaagaacctgcacagaatcttcatgcacctgaccaactacagcctgaacatccacagcggcaacttcatccacagcgacagcgccagcaccggcagcaagagaaccttcagcagcatcctgtgcagactgagcagcaagggcgtggacatcaagaaggtgtggagcgacatcatcagcgtggtgatcaagaccgtgatcgccctgacccccgagctgaaggtgttctaccagagcgacatccccaccggcagacccggccccacctgcttccaggtgaccatcgccagcagccagcccgccttccccgccctgaccggcctgaagagagccctgtggctgagagtgggctag

SEQ ID NO: 10898 - DNA, 1356 bp, Artificial Sequence
  Description of Artificial Sequence: Synthetic coding sequence
atgaccgagatggtgagaaagatcaccctgagcagagccgtgagaaccatgcagaacctgttccccgaggagtacatctgcaagcccctgctgatcgacaagctgaagttcgacatcagactgtacgtgctgctgaagagcctggaccccctggagatctacatcgccaaggacggcctgagcagattctgcaccgagccctaccaggagcccacccccaagaacctgcacagaatcttcatgcacctgaccaactacagcctgaacatccacagcggcaacttcatccacagcgacagcgccagcaccggcagcaagagaaccttcagcagcatcctgtgcagactgagcagcaagggcgtggacatcaagaaggtgtggagcgacatcatcagcgtggtgatcaagaccgtgatcgccctgacccccgagctgaaggtgttctaccagagcgacatccccaccggcagacccggccccacctgcttccagatcctgggcttcgacatcctgctgatgaagaacctgaagcccatcctgctggaggtgaacgccaaccccagcatgagaatcgagcacgagcacgagctgagccccggcgtgttcgagaacgtgcccagcctggtggacgaggaggtgaaggtggccgtgatcagagacaccctgagactgatggaccccctgaagaagaagagagagaaccagagccagcagctggagaagcccttcgccggcaaggaggacgccctggacggcgagctgaccagcgcccccgactgcaacgccaaccccgaggcccacctgcccagcatctgcctgaagcaggtgttccccaagtacgccaagcagttcaactacctgagactggtggacagaatggccaacctgttcatcagattcctgggcatcaagggcaccatgaagctgggccccaccggcttcagaaccttcatcagaagctgcaagctgagcagcagcagcctgagcatggccgccgtggacatcctgtacatcgacatcaccagaagatggaacagcatgaccctggaccagagagacagcggcatgtgcctgcaggccttcgtggaggccttcttcttcctggcccagagaaagttcaagatgctgcccctgcacgagcaggtggccagcctgatcgacctgtgcgagtaccacctgagcctgctggacgagaagagactggtgtgcggcagaggcgtgcccagcggcggcagacccccccacagaggccccccccaggagcccagccccagcgcccagcccgccggcgacaaccccccccccagaaccagctgcgccaacaagctgagccaccccagacacaccctgagctag

SEQ ID NO: 10899 - DNA, 1644 bp, Artificial Sequence
  Description of Artificial Sequence: Synthetic coding sequence
atgaaggtggtgaagagcgccgagcactacaccgagaccgccctggacgagatcagactgctgaagagcgtgagaaacagcgaccccaacgaccccaacagagagatggtggtgcagctgctggacgacttcaagatcagcggcgtgaacggcacccacatctgcatggtgttcgaggtgctgggccaccacctgctgaagtggatcatcaagagcaactaccagggcctgcccctgccctgcgtgaagaagatcatccagcaggtgctgcagggcctggactacctgcacaccaagtgcagaatcatccacaccgacatcaagcccgagaacatcctgctgagcgtgaacgagcagtacatcagaagactggccgccgaggccaccgagtggcagagaagcggcgcccccccccccagcggcagcgccgtgagcaccgccccccagcccaagcccgccgacaagatgagcaagaacaagaagaagaagctgaagaagaagcagaagagacaggccgagctgctggagaagagaatgcaggagatcgaggagatggagaaggagagcggccccggccagaagagacccaacaagcaggaggagagcgagagccccgtggagagacccctgaaggagaacccccccaacaagatgacccaggagaagctggaggagagcagcaccatcggccaggaccagaccctgatggagagagacaccgagggcggcgccgccgagatcaactgcaacggcgtgatcgaggtgatcaactacacccagaacagcaacaacgagaccctgagacacaaggaggacctgcacaacgccaacgactgcgacgtgcagaacctgaaccaggagagcagcttcctgagcagccagaacggcgacagcagcaccagccaggagaccgacagctgcacccccatcaccagcgaggtgagcgacaccatggtgtgccagagcagcagcaccgtgggccagagcttcagcgagcagcacatcagccagctgcaggagagcatcagagccgagatcccctgcgaggacgagcaggagcaggagcacaacggccccctggacaacaagggcaagagcaccgccggcaacttcctggtgaaccccctggagcccaagaacgccgagaagctgaaggtgaagatcgccgacctgggcaacgcctgctggcacaagcacttcaccgaggacatccagaccagacagtacagaagcctggaggtgctgatcggcagcggctacaacacccccgccgacatctggagcaccgcctgcatggccttcgagctggccaccggcgactacctgttcgagccccacagcggcgaggagtacaccagagacgaggaccacatcgtgcacatcatcgagctgatcggcagaatccccagaagattcagcctgagcggcaagtacagccaggacttcttcagccacagaggcgacctgaagcacatcaccaagctgaagccctggggcctgttcgaggtgctggtggagaagtacgagtggagccaggaggaggccgccggcttcaccgacttcctgctgcccatgctggagctgatccccgagaagagagccaccgccgccgagtgcctgagacacccctggctgaacagctag

SEQ ID NO: 10900 - DNA, 1968 bp, Artificial Sequence
  Description of Artificial Sequence: Synthetic coding sequence
atggagagaaaggtgctggccctgcaggccagaaagaagagaaccaaggccaagaaggacaaggcccagagaaagagcgagacccagcacagaggcagcgccccccacagcgagagcgacctgcccgagcaggaggaggagatcctgggcagcgacgacgacgagcaggaggaccccaacgactactgcaagggcggctaccacctggtgaagatcggcgacctgttcaacggcagataccacgtgatcagaaagctgggctggggccacttcagcaccgtgtggctgagctgggacatccagggcaagaagttcgtggccatgaaggtggtgaagagcgccgagcactacaccgagaccgccctggacgagatcagactgctgaagagcgtgagaaacagcgaccccaacgaccccaacagagagatggtggtgcagctgctggacgacttcaagatcagcggcgtgaacggcacccacatctgcatggtgttcgaggtgctgggccaccacctgctgaagtggatcatcaagagcaactaccagggcctgcccctgccctgcgtgaagaagatcatccagcaggtgctgcagggcctggactacctgcacaccaagtgcagaatcatccacaccgacatcaagcccgagaacatcctgctgagcgtgaacgagcagtacatcagaagactggccgccgaggccaccgagtggcagagaagcggcgcccccccccccagcggcagcgccgtgagcaccgccccccagcccaagcccgccgacaagatgagcaagaacaagaagaagaagctgaagaagaagcagaagagacaggccgagctgctggagaagagaatgcaggagatcgaggagatggagaaggagagcggccccggccagaagagacccaacaagcaggaggagagcgagagccccgtggagagacccctgaaggagaacccccccaacaagatgacccaggagaagctggaggagagcagcaccatcggccaggaccagaccctgatggagagagacaccgagggcggcgccgccgagatcaactgcaacggcgtgatcgaggtgatcaactacacccagaacagcaacaacgagaccctgagacacaaggaggacctgcacaacgccaacgactgcgacgtgcagaacctgaaccaggagagcagcttcctgagcagccagaacggcgacagcagcaccagccaggagaccgacagctgcacccccatcaccagcgaggtgagcgacaccatggtgtgccagagcagcagcaccgtgggccagagcttcagcgagcagcacatcagccagctgcaggagagcatcagagccgagatcccctgcgaggacgagcaggagcaggagcacaacggccccctggacaacaagggcaagagcaccgccggcaacttcctggtgaaccccctggagcccaagaacgccgagaagctgaaggtgaagatcgccgacctgggcaacgcctgctgggtgcacaagcacttcaccgaggacatccagaccagacagtacagaagcctggaggtgctgatcggcagcggctacaacacccccgccgacatctggagcaccgcctgcatggccttcgagctggccaccggcgactacctgttcgagccccacagcggcgaggagtacaccagagacgaggaccacatcgccctgatcatcgagctgctgggcaaggtgcccagaaagctgatcgtggccggcaagtacagcaaggagttcttcaccaagaagggcgacctgaagcacatcaccaagctgaagccctggggcctgttcgaggtgctggtggagaagtacgagtggagccaggaggaggccgccggcttcaccgacttcctgctgcccatgctggagctgatccccgagaagagagccaccgccgccgagtgcctgagacacccctggctgaacagctag

SEQ ID NO: 10901 - DNA, 864 bp, Artificial Sequence
  Description of Artificial Sequence: Synthetic coding sequence
atggccgccagcctgtggatgggcgacctggagccctacatggacgagaacttcatcagcagagccttcgccaccatgggcgagaccgtgatgagcgtgaagatcatcagaaacagactgaccggcatccccgccggctactgcttcgtggagttcgccgacctggccaccgccgagaagtgcctgcacaagatcaacggcaagcccctgcccggcgccacccccgccaagagattcaagctgaactacgccacctacggcaagcagcccgacaacagccccgagtacagcctgttcgtgggcgacctgacccccgacgtggacgacggcatgctgtacgagttcttcgtgaaggtgtaccccagctgcagaggcggcaaggtggtgctggaccagaccggcgtgagcaagggctacggcttcgtgaagttcaccgacgagctggagcagaagagagccctgaccgagtgccagggcgccgtgggcctgggcagcaagcccgtgagactgagcgtggccatccccaaggccagcagagtgaagcccgtggagtacagccagatgtacagctacagctacaaccagtactaccagcagtaccagaactactacgcccagtggggctacgaccagaacaccggcagctacagctacagctacccccagtacggctacacccagagcaccatgcagacctacgaggaggtgggcgacgacgccctggaggaccccatgccccagctggacgtgaccgaggccaacaaggagttcatggagcagagcgaggagctgtacgacgccctgatggactgccactggcagcccctggacaccgtgagcagcgagatccccgccatgatgtag

SEQ ID NO: 10902 - DNA, 438 bp, Artificial Sequence
  Description of Artificial Sequence: Synthetic coding sequence
atggccgagagaaacgaggaccaccacctgcaggtgctgaaggagagcgaggtgctgctgcaggccaagagagccgagctggagaagctgaagagccaggtgaccagccagcagcaggagatggccgtgctggacagacagctgggccacaagaaggaggagctgcacctgctgcagggcagcatggtgcaggccaaggccgacctgcaggaggccctgagactgggcgagaccgaggtgaccgagaagtgcaaccacatcagagaggtgaagagcctgctggaggagctgagcttccagaagggcgagctgaacgtgcagatcagcgagagaaagacccagctgaccctgatcaagcaggagatcgagaaggaggaggagaacctgcaggtggtgctgagacagatgagcaagcacaagaccgccttcctgcagtag

SEQ ID NO: 10903 - DNA, 3024 bp, Artificial Sequence
  Description of Artificial Sequence: Synthetic coding sequence
atgcagcacctgaagagcaagaagagagaggagagatggatgagagccagcaagagacagagcgagaaggagatggaggagctgcaccacaacatcgacgacctgctgcaggagaagaagagcctggagtgcgaggtggaggagctgcacagaaccgtgcagaagagacagcagcagaaggacttcatcgacggcaacgtggagagcctgatgaccgagctggagatcgagaagagcctgaagcaccacgaggacatcgtggacgagatcgagtgcatcgagaagaccctgctgaagagaagaagcgagctgagagaggccgacagactgctggccgaggccgagagcgagctgagctgcaccaaggagaaggtgtgcctgctggtggtgtggggcgtgagcagcgtgtggaccaagaacgccgtggagaagttcaccgacgccaagagaagcctgctgcagaccgagagcgacgccgaggagctggagagaagagcccaggagaccgccgtgaacctggtgaaggccgaccagcagctgagaagcctgcaggccgacgccaaggacctggagcagcacaagatcaagcaggaggagatcctgaaggagatcaacaagatcgtggccgccaaggacagcgacttccagtgcctgagcaagaagaaggagaagctgaccgaggagctgcagaagctgcagaaggacatcgagatggccgagagaaacgaggaccaccacctgcaggtgctgaaggagagcgaggtgctgctgcaggccaagagagccgagctggagaagctgaagagccaggtgaccagccagcagcaggagatggccgtgctggacagacagctgggccacaagaaggaggagctgcacctgctgcagggcagcatggtgcaggccaaggccgacctgcaggaggccctgagactgggcgagaccgaggtgaccgagaagtgcaaccacatcagagaggtgaagagcctgctggaggagctgagcttccagaagggcgagctgaacgtgcagatcagcgagagaaagacccagctgaccctgatcaagcaggagatcgagaaggaggaggagaacctgcaggtggtgctgagacagatgagcaagcacaagaccgagctgaagaacatcctggacatgctgcagctggagaaccacgagctgcagggcctgaagctgcagcacgaccagagagtgagcgagctggagaagacccaggtggccgtgctggaggagaagctggagctggagaacctgcagcagatcagccagcagcagaagggcgagatcgagtggcagaagcagctgctggagagagacaagagagagatcgagagaatgaccgccgagagcagagccctgcagagctgcgtggagtgcctgagcaaggagaaggaggacctgcaggagaagtgcgacatctgggagaagaagctggcccagaccaagagagtgctggccgccgccgaggagaacagcaagatggagcagagcaacctggagaagctggagctgaacgtgagaaagctgcagcaggagctggaccagctgaacagagacaagctgagcctgcacaacgacatcagcgccatgcagcagcagctgcaggagaagagagaggccgtgaacagcctgcaggaggagctggccaacgtgcaggaccacctgaacctggccaagcaggacctgctgcacaccaccaagcaccaggacgtgctgctgagcgagcagaccagactgcagaaggacatcagcgagtgggccaacagattcgaggactgccagaaggaggaggagaccaagcagcagcagctgcaggtgctgcagaacgagatcgaggagaacaagctgaagctggtgcagcaggagatgatgttccagagactgcagaaggagagagagagcgaggagagcaagctggagaccagcaaggtgaccctgaaggagcagcagcaccagctggagaaggagctgaccgaccagaagagcaagctggaccaggtgctgagcaaggtgctggccgccgaggagagagtgagaaccctgcaggaggaggagagatggtgcgagagcctggagaagaccctgagccagaccaagagacagctgagcgagagagagcagcagctggtggagaagagcggcgagctgctggccctgcagaaggaggccgacagcatgagagccgacttcagcctgctgagaaaccagttcctgaccgagagaaagaaggccgagaagcaggtggccagcctgaaggaggccctgaagatccagagaagccagctggagaagaacctgctggagcagaagcaggagaacagctgcatccagaaggagatggccaccatcgagctggtggcccaggacaaccacgagagagccagaagactgatgaaggagctgaaccagatgcagtacgagtacaccgagctgaagaagcagatggccaaccagaaggacctggagagaagacagatggagatcagcgacgccatgagaaccctgaagagcgaggtgaaggacgagatcagaaccagcctgaagaacctgaaccagttcctgcccgagctgcccgccgacctggaggccatcctggagagaaacgagaacctggagggcgagctggagagcctgaaggagaacctgcccttcaccatgaacgagggccccttcgaggagaagctgaacttcagccaggtgcacatcatggacgagcactggagaggcgaggccctgagagagaagctgagacacagagaggacagactgaaggcccagctgagacactgcatgagcaagcaggccgaggtgctgatcaagggcaagagacagaccgagggcaccctgcacagcctgagaagacaggtggacgccctgggcgagctggtgaccagcaccagcgccgacagcgccagcagccccagcctgagccagctggagagcagcctgaccgaggacagccagctgggccagaaccaggagaagaacgccagcgccagatag

SEQ ID NO: 10904 - DNA, 2985 bp, Artificial Sequence
  Description of Artificial Sequence: Synthetic coding sequence
atgaaggcccagaagagcggcaaggagcagcagctggacatcatgaacaagcagtaccagcagctggagagcagactggacgagatcctgagcagaatcgccaaggagaccgaggagatcaaggacctggaggagcagctgaccgagggccagatcgccgccaacgaggccctgaagaaggacctggagggcgtgatcagcggcctgcaggagtacctgggcaccatcaagggccaggccacccaggcccagaacgagtgcagaaagctgagagacgagaaggagaccctgctgcagagactgaccgaggtggagcaggagagagaccagctggagatcgtggccatggacgccgagaacatgagaaaggagctggccgagctggagagcgccctgcaggagcagcacgaggtgaacgccagcctgcagcagacccagggcgacctgagcgcctacgaggccgagctggaggccagactgaacctgagagacgccgaggccaaccagctgaaggaggagctggagaaggtgaccagactgacccagctggagcagagcgccctgcaggccgagctggagaaggagagacaggccctgaagaacgccctgggcaaggcccagttcagcgaggagaaggagcaggagaacagcgagctgcacgccaagctgaagcacctgcaggacgacaacaacctgctgaagcagcagctgaaggacttccagaaccacctgaaccacgtggtggacggcctggtgagacccgaggaggtggccgccagagtggacgagctgagaagaaagctgaagctgggcaccggcgagatgaacatccacagccccagcgacgtgctgggcaagagcctggccgacctgcagaagcagttcagcgagatcctggccagaagcaagtgggagagagacgaggcccaggtgagagagagaaagctgcaggaggagatggccctgcagcaggagaagctggccaccggccaggaggagttcagacaggcctgcgagagagccctggaggccagaatgaacttcgacaagagacagcacgaggccagaatccagcagatggagaacgagatccactacctgcaggagaacctgaagagcatggaggagatccagggcctgaccgacctgcagctgcaggaggccgacgaggagaaggagagaatcctggcccagctgagagagctggagaagaagaagaagctggaggacgccaagagccaggagcaggtgttcggcctggacaaggagctgaagaagctgaagaaggccgtggccaccagcgacaagctggccaccgccgagctgaccatcgccaaggaccagctgaagagcctgcacggcaccgtgatgaagatcaaccaggagagagccgaggagctgcaggaggccgagagattcagcagaaaggccgcccaggccgccagagacctgaccagagccgaggccgagatcgagctgctgcagaacctgctgagacagaagggcgagcagttcagactggagatggagaagaccggcgtgggcaccggcgccaacagccaggtgctggagatcgagaagctgaacgagaccatggagagacagagaaccgagatcgccagactgcagaacgtgctggacctgaccggcagcgacaacaagggcggcttcgagaacgtgctggaggagatcgccgagctgagaagagaggtgagctaccagaacgactacatcagcagcatggccgaccccttcaagagaagaggctactggtacttcatgccccccccccccagcagcaaggtgagcagccacagcagccaggccaccaaggacagcggcgtgggcctgaagtacagcgccagcacccccgtgagaaagcccagacccggccagcaggacggcaaggagggcagccagcccccccccgccagcggctactgggtgtacagccccatcagaagcggcctgcacaagctgttccccagcagagacgccgacagcggcggcgacagccaggaggagagcgagctggacgaccaggaggagccccccttcgtgcccccccccggctacatgatgtacaccgtgctgcccgacggcagccccgtgccccagggcatggccctgtacgccccccccccccccctgcccaacaacagcagacccctgacccccggcaccgtggtgtacggccccccccccgccggcgcccccatggtgtacggcccccccccccccaacttcagcatccccttcatccccatgggcgtgctgcactgcaacgtgcccgagcaccacaacctggagaacgaggtgagcagactggaggacatcatgcagcacctgaagagcaagaagagagaggagagatggatgagagccagcaagagacagagcgagaaggagatggaggagctgcaccacaacatcgacgacctgctgcaggagaagaagagcctggagtgcgaggtggaggagctgcacagaaccgtgcagaagagacagcagcagaaggacttcatcgacggcaacgtggagagcctgatgaccgagctggagatcgagaagagcctgaagcaccacgaggacatcgtggacgagatcgagtgcatcgagaagaccctgctgaagagaagaagcgagctgagagaggccgacagactgctggccgaggccgagagcgagctgagctgcaccaaggagaagaccaagaacgccgtggagaagttcaccgacgccaagagaagcctgctgcagaccgagagcgacgccgaggagctggagagaagagcccaggagaccgccgtgaacctggtgaaggccgaccagcagctgagaagcctgcaggccgacgccaaggacctggagcagcacaagatcaagcaggaggagatcctgaaggagatcaacaagatcgtggccgccaaggacagcgacttccagtgcctgagcaagaagaaggagaagctgaccgaggagtag

SEQ ID NO: 10905 - DNA, 5322 bp, Artificial Sequence
  Description of Artificial Sequence: Synthetic coding sequence
atgaaggcccagaagagcggcaaggagcagcagctggacatcatgaacaagcagtaccagcagctggagagcagactggacgagatcctgagcagaatcgccaaggagaccgaggagatcaaggacctggaggagcagctgaccgagggccagatcgccgccaacgaggccctgaagaaggacctggagggcgtgatcagcggcctgcaggagtacctgggcaccatcaagggccaggccacccaggcccagaacgagtgcagaaagctgagagacgagaaggagaccctgctgcagagactgaccgaggtggagcaggagagagaccagctggagatcgtggccatggacgccgagaacatgagaaaggagctggccgagctggagagcgccctgcaggagcagcacgaggtgaacgccagcctgcagcagacccagggcgacctgagcgcctacgaggccgagctggaggccagactgaacctgagagacgccgaggccaaccagctgaaggaggagctggagaaggtgaccagactgacccagctggagcagagcgccctgcaggccgagctggagaaggagagacaggccctgaagaacgccctgggcaaggcccagttcagcgaggagaaggagcaggagaacagcgagctgcacgccaagctgaagcacctgcaggacgacaacaacctgctgaagcagcagctgaaggacttccagaaccacctgaaccacgtggtggacggcctggtgagacccgaggaggtggccgccagagtggacgagctgagaagaaagctgaagctgggcaccggcgagatgaacatccacagccccagcgacgtgctgggcaagagcctggccgacctgcagaagcagttcagcgagatcctggccagaagcaagtgggagagagacgaggcccaggtgagagagagaaagctgcaggaggagatggccctgcagcaggagaagctggccaccggccaggaggagttcagacaggcctgcgagagagccctggaggccagaatgaacttcgacaagagacagcacgaggccagaatccagcagatggagaacgagatccactacctgcaggagaacctgaagagcatggaggagatccagggcctgaccgacctgcagctgcaggaggccgacgaggagaaggagagaatcctggcccagctgagagagctggagaagaagaagaagctggaggacgccaagagccaggagcaggtgttcggcctggacaaggagctgaagaagctgaagaaggccgtggccaccagcgacaagctggccaccgccgagctgaccatcgccaaggaccagctgaagagcctgcacggcaccgtgatgaagatcaaccaggagagagccgaggagctgcaggaggccgagagattcagcagaaaggccgcccaggccgccagagacctgaccagagccgaggccgagatcgagctgctgcagaacctgctgagacagaagggcgagcagttcagactggagatggagaagaccggcgtgggcaccggcgccaacagccaggtgctggagatcgagaagctgaacgagaccatggagagacagagaaccgagatcgccagactgcagaacgtgctggacctgaccggcagcgacaacaagggcggcttcgagaacgtgctggaggagatcgccgagctgagaagagaggtgagctaccagaacgactacatcagcagcatggccgaccccttcaagagaagaggctactggtacttcatgccccccccccccagcagcaaggtgagcagccacagcagccaggccaccaaggacagcggcgtgggcctgaagtacagcgccagcacccccgtgagaaagcccagacccggccagcaggacggcaaggagggcagccagcccccccccgccagcggctactgggtgtacagccccatcagaagcggcctgcacaagctgttccccagcagagacgccgacagcggcggcgacagccaggaggagagcgagctggacgaccaggaggagccccccttcgtgcccccccccggctacatgatgtacaccgtgctgcccgacggcagccccgtgccccagggcatggccctgtacgccccccccccccccctgcccaacaacagcagacccctgacccccggcaccgtggtgtacggccccccccccgccggcgcccccatggtgtacggcccccccccccccaacttcagcatccccttcatccccatgggcgtgctgcactgcaacgtgcccgagcaccacaacctggagaacgaggtgagcagactggaggacatcatgcagcacctgaagagcaagaagagagaggagagatggatgagagccagcaagagacagagcgagaaggagatggaggagctgcaccacaacatcgacgacctgctgcaggagaagaagagcctggagtgcgaggtggaggagctgcacagaaccgtgcagaagagacagcagcagaaggacttcatcgacggcaacgtggagagcctgatgaccgagctggagatcgagaagagcctgaagcaccacgaggacatcgtggacgagatcgagtgcatcgagaagaccctgctgaagagaagaagcgagctgagagaggccgacagactgctggccgaggccgagagcgagctgagctgcaccaaggagaagaccaagaacgccgtggagaagttcaccgacgccaagagaagcctgctgcagaccgagagcgacgccgaggagctggagagaagagcccaggagaccgccgtgaacctggtgaaggccgaccagcagctgagaagcctgcaggccgacgccaaggacctggagcagcacaagatcaagcaggaggagatcctgaaggagatcaacaagatcgtggccgccaaggacagcgacttccagtgcctgagcaagaagaaggagaagctgaccgaggagctgcagaagctgcagaaggacatcgagatggccgagagaaacgaggaccaccacctgcaggtgctgaaggagagcgaggtgctgctgcaggccaagagagccgagctggagaagctgaagagccaggtgaccagccagcagcaggagatggccgtgctggacagacagctgggccacaagaaggaggagctgcacctgctgcagggcagcatggtgcaggccaaggccgacctgcaggaggccctgagactgggcgagaccgaggtgaccgagaagtgcaaccacatcagagaggtgaagagcctgctggaggagctgagcttccagaagggcgagctgaacgtgcagatcagcgagagaaagacccagctgaccctgatcaagcaggagatcgagaaggaggaggagaacctgcaggtggtgctgagacagatgagcaagcacaagaccgagctgaagaacatcctggacatgctgcagctggagaaccacgagctgcagggcctgaagctgcagcacgaccagagagtgagcgagctggagaagacccaggtggccgtgctggaggagaagctggagctggagaacctgcagcagatcagccagcagcagaagggcgagatcgagtggcagaagcagctgctggagagagacaagagagagatcgagagaatgaccgccgagagcagagccctgcagagctgcgtggagtgcctgagcaaggagaaggaggacctgcaggagaagtgcgacatctgggagaagaagctggcccagaccaagagagtgctggccgccgccgaggagaacagcaagatggagcagagcaacctggagaagctggagctgaacgtgagaaagctgcagcaggagctggaccagctgaacagagacaagctgagcctgcacaacgacatcagcgccatgcagcagcagctgcaggagaagagagaggccgtgaacagcctgcaggaggagctggccaacgtgcaggaccacctgaacctggccaagcaggacctgctgcacaccaccaagcaccaggacgtgctgctgagcgagcagaccagactgcagaaggacatcagcgagtgggccaacagattcgaggactgccagaaggaggaggagaccaagcagcagcagctgcaggtgctgcagaacgagatcgaggagaacaagctgaagctggtgcagcaggagatgatgttccagagactgcagaaggagagagagagcgaggagagcaagctggagaccagcaaggtgaccctgaaggagcagcagcaccagctggagaaggagctgaccgaccagaagagcaagctggaccaggtgctgagcaaggtgctggccgccgaggagagagtgagaaccctgcaggaggaggagagatggtgcgagagcctggagaagaccctgagccagaccaagagacagctgagcgagagagagcagcagctggtggagaagagcggcgagctgctggccctgcagaaggaggccgacagcatgagagccgacttcagcctgctgagaaaccagttcctgaccgagagaaagaaggccgagaagcaggtggccagcctgaaggaggccctgaagatccagagaagccagctggagaagaacctgctggagcagaagcaggagaacagctgcatccagaaggagatggccaccatcgagctggtggcccaggacaaccacgagagagccagaagactgatgaaggagctgaaccagatgcagtacgagtacaccgagctgaagaagcagatggccaaccagaaggacctggagagaagacagatggagatcagcgacgccatgagaaccctgaagagcgaggtgaaggacgagatcagaaccagcctgaagaacctgaaccagttcctgcccgagctgcccgccgacctggaggccatcctggagagaaacgagaacctggagggcgagctggagagcctgaaggagaacctgcccttcaccatgaacgagggccccttcgaggagaagctgaacttcagccaggtgcacatcatggacgagcactggagaggcgaggccctgagagagaagctgagacacagagaggacagactgaaggcccagctgagacactgcatgagcaagcaggccgaggtgctgatcaagggcaagagacagaccgagggcaccctgcacagcctgagaagacaggtggacgccctgggcgagctggtgaccagcaccagcgccgacagcgccagcagccccagcctgagccagctggagagcagcctgaccgaggacagccagctgggccagaaccaggagaagaacgccagcgccagatag

SEQ ID NO: 10906 - DNA, 2487 bp, Artificial Sequence
  Description of Artificial Sequence: Synthetic coding sequence
atggagaagcagaagcaggagatcgccggcaagcagaaggagatcaaggacctgcagatcgccatcgacagcctggacagcaaggaccccaagcacagccacatgaaggcccagaagagcggcaaggagcagcagctggacatcatgaacaagcagtaccagcagctggagagcagactggacgagatcctgagcagaatcgccaaggagaccgaggagatcaaggacctggaggagcagctgaccgagggccagatcgccgccaacgaggccctgaagaaggacctggagggcgtgatcagcggcctgcaggagtacctgggcaccatcaagggccaggccacccaggcccagaacgagtgcagaaagctgagagacgagaaggagaccctgctgcagagactgaccgaggtggagcaggagagagaccagctggagatcgtggccatggacgccgagaacatgagaaaggagctggccgagctggagagcgccctgcaggagcagcacgaggtgaacgccagcctgcagcagacccagggcgacctgagcgcctacgaggccgagctggaggccagactgaacctgagagacgccgaggccaaccagctgaaggaggagctggagaaggtgaccagactgacccagctggagcagagcgccctgcaggccgagctggagaaggagagacaggccctgaagaacgccctgggcaaggcccagttcagcgaggagaaggagcaggagaacagcgagctgcacgccaagctgaagcacctgcaggacgacaacaacctgctgaagcagcagctgaaggacttccagaaccacctgaaccacgtggtggacggcctggtgagacccgaggaggtggccgccagagtggacgagctgagaagaaagctgaagctgggcaccggcgagatgaacatccacagccccagcgacgtgctgggcaagagcctggccgacctgcagaagcagttcagcgagatcctggccagaagcaagtgggagagagacgaggcccaggtgagagagagaaagctgcaggaggagatggccctgcagcaggagaagctggccaccggccaggaggagttcagacaggcctgcgagagagccctggaggccagaatgaacttcgacaagagacagcacgaggccagaatccagcagatggagaacgagatccactacctgcaggagaacctgaagagcatggaggagatccagggcctgaccgacctgcagctgcaggaggccgacgaggagaaggagagaatcctggcccagctgagagagctggagaagaagaagaagctggaggacgccaagagccaggagcaggtgttcggcctggacaaggagctgaagaagctgaagaaggccgtggccaccagcgacaagctggccaccgccgagctgaccatcgccaaggaccagctgaagagcctgcacggcaccgtgatgaagatcaaccaggagagagccgaggagctgcaggaggccgagagattcagcagaaaggccgcccaggccgccagagacctgaccagagccgaggccgagatcgagctgctgcagaacctgctgagacagaagggcgagcagttcagactggagatggagaagaccggcgtgggcaccggcgccaacagccaggtgctggagatcgagaagctgaacgagaccatggagagacagagaaccgagatcgccagactgcagaacgtgctggacctgaccggcagcgacaacaagggcggcttcgagaacgtgctggaggagatcgccgagctgagaagagaggtgagctaccagaacgactacatcagcagcatggccgaccccttcaagagaagaggctactggtacttcatgccccccccccccagcagcaaggtgagcagccacagcagccaggccaccaaggacagcggcgtgggcctgaagtacagcgccagcacccccgtgagaaagcccagacccggccagcaggacggcaaggagggcagccagcccccccccgccagcggctactgggtgtacagccccatcagaagcggcctgcacaagctgttccccagcagagacgccgacagcggcggcgacagccaggaggagagcgagctggacgaccaggaggagccccccttcgtgcccccccccggctacatgatgtacaccgtgctgcccgacggcagccccgtgccccagggcatggccctgtacgccccccccccccccctgcccaacaacagcagacccctgacccccggcaccgtggtgtacggccccccccccgccggcgcccccatggtgtacggcccccccccccccaacttcagcatccccttcatccccatgggcgtgctgcactgcaacgtgcccgagcaccacaacctggtgagcggcaagacctacaacagcctgagcaccctgctgccctgggtgaccgacaaggtgatctacctgatgagctag

SEQ ID NO: 10907 - DNA, 6978 bp, Artificial Sequence; identical to SEQ ID NO: 9286
  Description of Artificial Sequence: Synthetic coding sequence

SEQ ID NO: 10908 - DNA, 1359 bp, Artificial Sequence
  Description of Artificial Sequence: Synthetic coding sequence
atgaagaagggcagccagcagaagatcttcagcaaggccaagatccccagcagcagccacagccccatccccagcagcatgagcaacatgagaagcagaagcctgagccccctgatcggcagcgagaccctgcccttccacagcggcggccagtggtgcgagcaggtggagatcgccgacgagaacaacatgctgctggactaccaggaccacaagggcgccgacagccacgccggcgtgagatacatcaccgaggccctgatcaagaagctgaccaagcaggacaacctggccctgatcaagagcctgaacctgagcctgagcaaggacggcggcaagaagttcaagtacatcgagaacctggagaagtgcgtgaagctggaggtgctgaacctgagctacaacctgatcggcaagatcgagaagctggacaagctgctgaagctgagagagctgaacctgagctacaacaagatcagcaagatcgagggcatcgagaacatgtgcaacctgcagaagctgaacctggccggcaacgagatcgagcacatccccgtgtggctgggcaagaagctgaagagcctgagagtgctgaacctgaagggcaacaagatcagcagcctgcaggacatcagcaagctgaagcccctgcaggacctgatcagcctgatcctggtggagaaccccgtggtgaccctgccccactacctgcagttcaccatcttccacctgagaagcctggagagcctggagggccagcccgtgaccacccaggacagacaggaggccttcgagagattcagcctggaggaggtggagagactggagagagacctggagaagaagatgatcgagaccgaggagctgaagagcaagcagaccagattcctggaggagatcaagaaccaggacaagctgaacaagagcctgaaggaggaggccatgctgcagaagcagagctgcgaggagctgaagagcgacctgaacaccaagaacgagctgctgaagcagaagaccatcgagctgaccagagcctgccagaagcagtacgagctggagcaggagctggccttctacaagatcgacgccaagttcgagcccctgaactactaccccagcgagtacgccgagatcgacaaggcccccgacgagagcccctacatcggcaagagcagatacaagagaaacatgttcgccaccgagagctacatcatcgacagcgcccaggccgtgcagatcaagaagatggagcccgacgagcagctgagaaacgaccacatgaacctgagaggccacacccccctggacacccagctggaggaccacaagctggactaccagaactgcatgatgaagtag

SEQ ID NO: 10909 - DNA, 1053 bp, Artificial Sequence
  Description of Artificial Sequence: Synthetic coding sequence
atgtgctgcgacagcgacttcgtggccagaaacaagagccaggacagcggcatcgccgagatggaggagctgcccgtgccccacaacatcaagatcagcaacatcacctgcgacagcttcaagatcagctgggagatggacagcaagagcaaggacagaatcacccactacttcatcgacctgaacaagaaggagaacaagaacagcaacaagttcaagcacaaggacgtgcccaccaagctggtggccaaggccgtgcccctgcccatgaccgtgagaggccactggttcctgagccccagaaccgagtacaccgtggccgtgcagaccgccagcaagcaggtggacggcgactacgtggtgagcgagtggagcgagatcatcgagttctgcaccgccgactacagcaaggtgcacctgacccagctgctggagaaggccgaggtgatcgccggcagaatgctgaagttcagcgtgttctacagaaaccagcacaaggagtacttcgactacgtgagagagcaccacggcaacgccatgcagcccagcgtgaaggacaacagcggcagccacggcagccccatcagcggcaagctggagggcatcttcttcagctgcagcaccgagttcaacaccggcaagcccccccaggacagcccctacggcagatacagattcgagatcgccgccgagaagctgttcaaccccaacaccaacctgtacttcggcgacttctactgcatgtacaccgcctaccactacgtgatcctggtgatcgcccccgtgggcagccccggcgacgagttctgcaagcagagactgccccagctgaacagcaaggacaacaagttcctgacctgcaccgaggaggacggcgtgctggtgtaccaccacgcccaggacgtgatcctggaggtgatctacaccgaccccgtggacctgagcgtgggcaccgtggccgagatcaccggccaccagctgatgagcctgagcaccgccaacgccaagaaggaccccagctgcaagacctgcaacatcagcgtgggcagatag

SEQ ID NO: 10910 - DNA, 1131 bp, Artificial Sequence
  Description of Artificial Sequence: Synthetic coding sequence
atggaggtgcccagactggaccacgccctgaacagccccaccagcccctgcgaggaggtgatcaagaacctgagcctggaggccatccagctgtgcgacagagacggcaacaagagccaggacagcggcatcgccgagatggaggagctgcccgtgccccacaacatcaagatcagcaacatcacctgcgacagcttcaagatcagctgggagatggacagcaagagcaaggacagaatcacccactacttcatcgacctgaacaagaaggagaacaagaacagcaacaagttcaagcacaaggacgtgcccaccaagctggtggccaaggccgtgcccctgcccatgaccgtgagaggccactggttcctgagccccagaaccgagtacaccgtggccgtgcagaccgccagcaagcaggtggacggcgactacgtggtgagcgagtggagcgagatcatcgagttctgcaccgccgactacagcaaggtgcacctgacccagctgctggagaaggccgaggtgatcgccggcagaatgctgaagttcagcgtgttctacagaaaccagcacaaggagtacttcgactacgtgagagagcaccacggcaacgccatgcagcccagcgtgaaggacaacagcggcagccacggcagccccatcagcggcaagctggagggcatcttcttcagctgcagcaccgagttcaacaccggcaagcccccccaggacagcccctacggcagatacagattcgagatcgccgccgagaagctgttcaaccccaacaccaacctgtacttcggcgacttctactgcatgtacaccgcctaccactacgtgatcctggtgatcgcccccgtgggcagccccggcgacgagttctgcaagcagagactgccccagctgaacagcaaggacaacaagttcctgacctgcaccgaggaggacggcgtgctggtgtaccaccacgcccaggacgtgatcctggaggtgatctacaccgaccccgtggacctgagcgtgggcaccgtggccgagatcaccggccaccagctgatgagcctgagcaccgccaacgccaagaaggaccccagctgcaagacctgcaacatcagcgtgggcagatag

SEQ ID NO: 10911 - DNA, 1263 bp, Artificial Sequence; identical to SEQ ID NO: 9866
  Description of Artificial Sequence: Synthetic coding sequence

SEQ ID NO: 10912 - DNA, 411 bp, Artificial Sequence
  Description of Artificial Sequence: Synthetic coding sequence
gaccccctgagctggctgagcggcccctggggccaggtgcccgccggcatctgcccccccagacacagaggctggtaccacttcagagaccagatcctggccggcagccccgaggccttcttcgtgctgaacgccgacgtgtgcagcgacttccccctgagcgccatgctggaggcccacagaagacagagacaccccttcctgctgctgggcaccaccgccaacagaacccagagcctgaactacggctgcatcgtggagaacccccagacccacgaggtgctgcactacgtggagaagcccagcaccttcatcagcgacatcatcaactgcggcatctacctgttcagccccgaggccctgaagcccctgagagacgtgttccagagaaaccagcaggacggccagtag

SEQ ID NO: 10913 - DNA, 1365 bp, Artificial Sequence
  Description of Artificial Sequence: Synthetic coding sequence
atggagagaaaggacttcgagacctggctggacaacatcagcgtgaccttcctgagcctgaccgacctgcagaagaacgagaccctggaccacctgatcagcctgagcggcgccgtgcagctgagacacctgagcaacaacctggagaccctgctgaagagagacttcctgaagctgctgcccctggagctgagcttctacctgctgaagtggctggacccccagaccctgctgacctgctgcctggtgagcaagcagtggaacaaggtgatcagcgcctgcaccgaggtgtggcagaccgcctgcaagaacctgggctggcagatcgacgacagcgtgcaggacgccctgcactggaagaaggtgtacctgaaggccatcctgagaatgaagcagctggaggaccacgaggccttcgagaccagcagcctgatcggccacagcgccagagtgtacgccctgtactacaaggacggcctgctgtgcaccggcagcgacgacctgagcgccaagctgtgggacgtgagcaccggccagtgcgtgtacggcatccagacccacacctgcgccgccgtgaagttcgacgagcagaagctggtgaccggcagcttcgacaacaccgtggcctgctgggagtggagcagcggcgccagaacccagcacttcagaggccacaccggcgccgtgttcagcgtggactacaacgacgagctggacatcctggtgagcggcagcgccgacttcaccgtgaaggtgtgggccctgagcgccggcacctgcctgaacaccctgaccggccacaccgagtgggtgaccaaggtggtgctgcagaagtgcaaggtgaagagcctgctgcacagccccggcgactacatcctgctgagcgccgacaagtacgagatcaagatctggcccatcggcagagagatcaactgcaagtgcctgaagaccctgagcgtgagcgaggacagaagcatctgcctgcagcccagactgcacttcgacggcaagtacatcgtgtgcagcagcgccctgggcctgtaccagtgggacttcgccagctacgacatcctgagagtgatcaagacccccgagatcgccaacctggccctgctgggcttcggcgacatcttcgccctgctgttcgacaacagatacctgtacatcatggacctgagaaccgagagcctgatcagcagatggcccctgcccgagtacagaaagagcaagagaggcagcagcttcctggccggcgaggccagctggctgaacggcctggacggccacaacgacaccggcctggtgttcgccaccagcatgcccgaccacagcatccacctggtgctgtggaaggagcacggctag

SEQ ID NO: 10914 - DNA, 372 bp, Artificial Sequence
  Description of Artificial Sequence: Synthetic coding sequence
atggaggccgccgagaccgaggccgaggccgccgccctggaggtgctggccgaggtggccggcatcctggagcccgtgggcctgcaggaggaggccgagctgcccgccaagatcctggtggagttcgtggtggacagccagaagaaggacaagctgctgtgcagccagctgcaggtggccgacttcctgcagaacatcctggcccaggagagaccctggtgcgtgctgcagggctgctggagcaccacctgctggagatgcaagttcgccatgaccagctggagaaccgccgcctggagaaagatcctggagaaggccagcgacttcccccacctgcccaccatcatcaccggcaagaccgtgaacagctag

SEQ ID NO: 10915 - DNA, 834 bp, Artificial Sequence
  Description of Artificial Sequence: Synthetic coding sequence
atggaggccgccgagaccgaggccgaggccgccgccctggaggtgctggccgaggtggccggcatcctggagcccgtgggcctgcaggaggaggccgagctgcccgccaagatcctggtggagttcgtggtggacagccagaagaaggacaagctgctgtgcagccagctgcaggtggccgacttcctgcagaacatcctggcccaggaggacaccgccaagggcctggaccccctggccagcgaggacaccagcagacagaaggccatcgccgccaaggagcagtggaaggagctgaaggccacctacagagagcacgtggaggccatcaagatcggcctgaccaaggccctgacccagatggaggaggcccagagaaagagaacccagctgagagaggccttcgagcagctgcaggccaagaagcagatggccatggagaagagaagagccgtgcagaaccagtggcagctgcagcaggagaagcacctgcagcacctggccgaggtgagcgccgaggtgagagagagaaagaccggcacccagcaggagctggacagagtgttccagaagctgggcaacctgaagcagcaggccgagcaggagagagacaagctgcagagataccagaccttcctgcagctgctgtacaccctgcagggcaagctgctgttccccgaggccgaggccgaggccgagaacctgcccgacgacaagccccagcagcccaccagaccccaggagcagagcaccggcgacaccatgggcagagaccccggcgtgagcttcaaggccgtgggcctgcagcccgccggcgacgtgaacctgccctag

SEQ ID NO: 10916 - DNA, 1713 bp, Artificial Sequence
  Description of Artificial Sequence: Synthetic coding sequence
atgagcagcatcggcgagggcatcgacttcagccaggagagacagaagatcagcggcctgagaaccctggagcagagcgtgggcgagtggctggagagcatcggcctgcagcagtacgagagcaagctgctgctgaacggcttcgacgacgtgcacttcctgggcagcaacgtgatggaggagcaggacctgagagacatcggcatcagcgacccccagcacagaagaaagctgctgcaggccgccagaagcctgcccaaggtgaaggccctgggctacgacggcaacagcccccccagcgtgcccagctggctggacagcctgggcctgcaggactacgtgcacagcttcctgagcagcggctacagcagcatcgacaccgtgaagaacctgtgggagctggagctggtgaacgtgctgaaggtgcagctgctgggccacagaaagagaatcatcgccagcctggccgacagaccctacgaggagcccccccagaagccccccagattcagccagctgagatgccaggacctgctgagccagaccagcagccccctgagccagaacgacagctgcaccggcagaagcgccgacctgctgctgccccccggcgacaccggcagaagaagacacgacagcctgcacgaccccgccgcccccagcagagccgagagattcagaatccaggaggagcacagagaggccaagctgaccctgagaccccccagcctggccgccccctacgcccccgtgcagagctggcagcaccagcccgagaagctgatcttcgagagctgcggctacgaggccaactacctgggcagcatgctgatcaaggacctgagaggcaccgagagcacccaggacgcctgcgccaagatgagaaagagcaccgagcacatgaagaagatccccaccatcatcctgagcatcacctacaagggcgtgaagttcatcgacgccagcaacaagaacgtgatcgccgagcacgagatcagaaacatcagctgcgccgcccaggaccccgaggacctgtgcaccttcgcctacatcaccaaggacctgcagaccagccaccactactgccacgtgttcagcaccgtggacgtgaacctgacctacgagatcatcctgaccctgggccaggccttcgaggtggcctaccagctggccctgcaggcccagaagagcagagccaccggcgccagcgccgccgagatgatcgagaccaagagcagcaagcccgtgcccaagcccagagtgggcgtgagaaagagcgccgtgcccctgccccccgacagcagatgctgctactgccacacctgcaccacccacagacccagctacctgcccctgcccagcgtgagccccggcgtgaagctggagccccccgacatggaccaggacgcccagagccacgccagcgtgagctgggtggtggaccccaagcccgacagcaagagaagcctgagcaccaaccacaccagactggagctggtgtgctgcagccagcccgagaacgagctggtgagcaccatcagcggcgacaagcccaagagcttcctggagcccctgctgttcgtgatgcccaccaccgcctacaaccacaactgccccgagtggagaagccagaaggacggcggctgcagcaccagcgagtgcccccaccacctgtgcctggagaagcccggcgtgctgagcctggagatgtag

SEQ ID NO: 10917 - DNA, 1785 bp, Artificial Sequence; identical to SEQ ID NO: 9584
  Description of Artificial Sequence: Synthetic coding sequence

SEQ ID NO: 10918 - DNA, 1785 bp, Artificial Sequence
  Description of Artificial Sequence: Synthetic coding sequence
atggaggccgtgtgcctgggcacctgccccgagcccgaggccagcatgagcaccgccatccccggcctgaagaagggcaacaacgccctgcagagcatcatcctgcagaccctgctggagaaggagaacggccagagaaagtacggcggccccccccccggctgggacgccgccccccccgagagaggctgcgagatcttcatcggcaagctgcccagagacctgttcgaggacgagctgatccccctgtgcgagaagatcggcaagatctacgagatgagaatgatgatggacttcaacggcaacaacagaggctacgccttcgtgaccttcagcaacaaggtggaggccaagaacgccatcaagcagctgaacaactacgagatcagaaacggcagactgctgggcgtgtgcgccagcgtggacaactgcagactgttcgtgggcggcatccccaagaccaagaagagagaggagatcctgagcgagatgaagaaggtgaccgagggcgtggtggacgtgatcgtgtaccccagcgccgccgacaagaccaagaacagaggcttcgccttcgtggagtacgagagccacagagccgccgccatggccagaagaaagctgctgcccggcagaatccagctgtggggccacggcatcgccgtggactgggccgagcccgaggtggaggtggacgaggacaccatgagcagcgtgaagatcctgtacgtgagaaacctgatgctgagcaccagcgaggagatgatcgagaaggagttcaacaacatcaagcccggcgccgtggagagagtgaagaagatcagagactacgccttcgtgcacttcagcaacagagaggacgccgtggaggccatgaaggccctgaacggcaaggtgctggacggcagccccatcgaggtgaccctggccaagcccgtggacaaggacagctacgtgagatacaccagaggcaccggcggcagaggcaccatgctgcagggcgagtacacctacagcctgggccaggtgtacgaccccaccaccacctacctgggcgcccccgtgttctacgccccccagacctacgccgccatccccagcctgcacttccccgccaccaagggccacctgagcaacagagccatcatcagagcccccagcgtgagaggcgccgccggcgtgagaggcctgggcggcagaggctacctggcctacaccggcctgggcagaggctaccaggtgaagggcgacaagagagaggacaagctgtacgacatcctgcccggcatggagctgacccccatgaaccccgtgaccctgaagccccagggcatcaagctggccccccagatcctggaggagatctgccagaagaacaactggggccagcccgtgtaccagctgcacagcgccatcggccaggaccagagacagctgttcctgtacaagatcaccatccccgccctggccagccagaaccccgccatccaccccttcaccccccccaagctgagcgccttcgtggacgaggccaagacctacgccgccgagtacaccctgcagaccctgggcatccccaccgacggcggcgacggcaccatggccaccgccgccgccgccgccaccgccttccccggctacgccgtgcccaacgccaccgcccccgtgagcgccgcccagctgaagcaggccgtgaccctgggccaggacctggccgcctacaccacctacgaggtgtaccccaccttcgccgtgaccgccagaggcgacggctacggcaccttctag

SEQ ID NO: 10919 - DNA, 1761 bp, Artificial Sequence
  Description of Artificial Sequence: Synthetic coding sequence
atggagagcaaccacaagagcggcgacggcctgagcggcacccagaaggaggccgccctgagagccctggtgcagagaaccggctacagcctggtgcaggagaacggccagagaaagtacggcggccccccccccggctgggacgccgccccccccgagagaggctgcgagatcttcatcggcaagctgcccagagacctgttcgaggacgagctgatccccctgtgcgagaagatcggcaagatctacgagatgagaatgatgatggacttcaacggcaacaacagaggctacgccttcgtgaccttcagcaacaaggtggaggccaagaacgccatcaagcagctgaacaactacgagatcagaaacggcagactgctgggcgtgtgcgccagcgtggacaactgcagactgttcgtgggcggcatccccaagaccaagaagagagaggagatcctgagcgagatgaagaaggtgaccgagggcgtggtggacgtgatcgtgtaccccagcgccgccgacaagaccaagaacagaggcttcgccttcgtggagtacgagagccacagagccgccgccatggccagaagaaagctgctgcccggcagaatccagctgtggggccacggcatcgccgtggactgggccgagcccgaggtggaggtggacgaggacaccatgagcagcgtgaagatcctgtacgtgagaaacctgatgctgagcaccagcgaggagatgatcgagaaggagttcaacaacatcaagcccggcgccgtggagagagtgaagaagatcagagactacgccttcgtgcacttcagcaacagagaggacgccgtggaggccatgaaggccctgaacggcaaggtgctggacggcagccccatcgaggtgaccctggccaagcccgtggacaaggacagctacgtgagatacaccagaggcaccggcggcagaggcaccatgctgcagggcgagtacacctacagcctgggccaggtgtacgaccccaccaccacctacctgggcgcccccgtgttctacgccccccagacctacgccgccatccccagcctgcacttccccgccaccaagggccacctgagcaacagagccatcatcagagcccccagcgtgagaggcgccgccggcgtgagaggcctgggcggcagaggctacctggcctacaccggcctgggcagaggctaccaggtgaagggcgacaagagagaggacaagctgtacgacatcctgcccggcatggagctgacccccatgaaccccgtgaccctgaagccccagggcatcaagctggccccccagatcctggaggagatctgccagaagaacaactggggccagcccgtgtaccagctgcacagcgccatcggccaggaccagagacagctgttcctgtacaagatcaccatccccgccctggccagccagaaccccgccatccaccccttcaccccccccaagctgagcgccttcgtggacgaggccaagacctacgccgccgagtacaccctgcagaccctgggcatccccaccgacggcggcgacggcaccatggccaccgccgccgccgccgccaccgccttccccggctacgccgtgcccaacgccaccgcccccgtgagcgccgcccagctgaagcaggccgtgaccctgggccaggacctggccgcctacaccacctacgaggtgtaccccaccttcgccgtgaccgccagaggcgacggctacggcaccttctag

SEQ ID NO: 10920 - DNA, 1761 bp, Artificial Sequence; identical to SEQ ID NO: 10919
  Description of Artificial Sequence: Synthetic coding sequence

SEQ ID NO: 10921 - DNA, 1542 bp, Artificial Sequence
  Description of Artificial Sequence: Synthetic coding sequence
atgcagagaaccttcgcctggctgctggacagagtgcagcacctgggcgcccccgtgaccctgagagccagctacctggagatctacaacgagcaggtgagagacctgctgagcctgggcagccccagacccctgcccgtgagatggaacaagaccagaggcttctacgtggagcagctgagagtggtggagttcggcagcctggaggccctgatggagctgctgcagaccggcctgagcagaagaagaaacagcgcccacaccctgaaccaggccagcagcagaagccacgccctgctgaccctgtacatcagcagacagaccgcccagcagatgcccagcgtggaccccggcgagccccccgtgggcggcaagctgtgcttcgtggacctggccggcagcgagaaggtggccgccaccggcagcagaggcgagctgatgctggaggccaacagcatcaacagaagcctgctggccctgggccactgcatcagcctgctgctggacccccagagaaagcagagccacatccccttcagagacagcaagctgaccaagctgctggccgacagcctgggcggcagaggcgtgaccctgatggtggcctgcgtgagccccagcgcccagtgcctgcccgagaccctgagcaccctgagatacgccagcagagcccagagagtgaccaccagaccccaggcccccaagagccccgtggccaagcagccccagagactggagaccgagatgctgcagctgcaggaggagaacagaagactgcagttccagctggaccagatggactgcaaggccagcggcctgagcggcgccagagtggcctgggcccagagaaacctgtacggcatgctgcaggagttcatgctggagaacgagagactgagaaaggagaagagccagctgcagaacagcagagacctggcccagaacgagcagagaatcctggcccagcaggtgcacgccctggagagaagactgctgagcgcctgctaccaccaccagcagggccccggcctgacccccccctgcccctgcctgatggcccccgcccccccctgccacgccctgccccccctgtacagctgcccctgctgccacatctgccccctgtgcagagtgcccctggcccactgggcctgcctgcccggcgagcaccacctgccccaggtgctggaccccgaggccagcggcggcagaccccccagcgccagaccccccccctgggcccccccctgcagccccggcagcgccaagtgccccagagagagaagccacagcgactggacccagaccagagtgctggccgagatgctgaccgaggaggaggtggtgcccagcgccccccccctgcccgtgagaccccccaagaccagccccggcctgagaggcggcgccggcgtgcccaacctggcccagagactggaggccctgagagaccagatcggcagcagcctgagaagaggcagaagccagcccccctgcagcgagggcgccagaagccccggccaggtgctgcccccccactag

SEQ ID NO: 10922 - DNA, 786 bp, Artificial Sequence
  Description of Artificial Sequence: Synthetic coding sequence
atggtgaagggcgagaagggccccaagggcaagaagatcaccctgaaggtggccagaaactgcatcaagatcaccttcgacggcaagaagagactggacctgagcaagatgggcatcaccaccttccccaagtgcatcctgagactgagcgacatggacgagctggacctgagcagaaacctgatcagaaagatccccgacagcatcagcaagttccagaacctgagatggctggacctgcacagcaactacatcgacaagctgcccgagagcatcggccagatgaccagcctgctgtacctgaacgtgagcaacaacagactgaccagcaacggcctgcccgtggagctgaagcagctgaagaacatcagagccgtgaacctgggcctgaaccacctggacagcgtgcccaccaccctgggcgccctgaaggagctgcacgaggtgggcctgcacgacaacctgctgaacaacatccccgtgagcatcagcaagctgcccaagctgaagaagctgaacatcaagagaaaccccttccccaagcccggcgagagcgagatcttcatcgacagcatcagaagactggagaacctgtacgtggtggaggagaaggacctgtgcgccgcctgcctgagaaagtgccagaacgccagagacaacctgaacagaatcaagaacatggccaccaccacccccagaaagaccatcttccccaacctgatcagccccaacagcatggccaaggacagctgggaggactggagaatcagactgaccagcagctag

SEQ ID NO: 10923 - DNA, 1770 bp, Artificial Sequence
  Description of Artificial Sequence: Synthetic coding sequence
atggccagcagccagagagacatggaggactgggtgcaggccatcagaagagtgatctgggcccccctgggcggcggcaccgccagaagaagccacgcccaccccctggagcccctgccccccggcatcttcggccagagactggaggagaccgtgcaccacgagagaaagtacggccccagactggcccccctgctggtggagcagtgcgtggacttcatcagagagagaggcctgaccgaggagggcctgttcagaatgcccggccaggccaacctggtgagagacctgcaggacagcttcgactgcggcgagaagcccctgttcgacagcaccaccgacgtgcacaccgtggccagcctgctgaagctgtacctgagagagctgcccgagcccgtggtgcccttcgccagatacgaggacttcctgagctgcgcccagctgctgaccaaggacgagggcgagggcaccctggagctggccaagcaggtgagcaacctgccccaggccaactacaacctgctgagatacatctgcaagttcctggacgaggtgcaggcctacagcaacgtgaacaagatgagcgtgcagaacctggccaccgtgttcggccccaacatcctgagaccccaggtggaggaccccgtgaccatcatggagggcaccagcctggtgcagcacctgatgaccgtgctgatcagaaagcacagccagctgttcaccgcccccgtgcccgagggccccaccagccccagaggcggcctgcagtgcgccgtgggctggggcagcgaggaggtgaccagagacagccagggcgagcccggcggccccggcctgcccgcccacagaaccagcagcctggacggcgccgccgtggccgtgctgagcagaaccgcccccaccggccccggcagcagatgcagccccggcaagaaggtgcagaccctgcccagctggaagagcagcttcagacagcccagaagcctgagcggcagccccaagggcggcggcagcagcctggaggtgcccatcatcagcagcggcggcaactggctgatgaacggcctgagcagcctgagaggccacagaagagccagcagcggcgacagactgaaggacagcggcagcgtgcagagactgagcacctacgacaacgtgcccgcccccggcctggtgcccggcatccccagcgtggccagcatggcctggagcggcgccagcagcagcgagagcagcgtgggcggcagcctgagcagctgcaccgcctgcagagccagcgacagcagcgccagaagcagcctgcacaccgactgggccctggagcccagccccctgcccagcagcagcgaggaccccaagagcctggacctggaccacagcatggacgaggccggcgccggcgccagcaacagcgagcccagcgagcccgacagccccaccagagagcacgccagaagaagcgaggccctgcagggcctggtgaccgagctgagagccgagctgtgcagacagagaaccgagtacgagagaagcgtgaagagaatcgaggagggcagcgccgacctgagaaagagaatgagcagactggaggaggagctggaccaggagaagaagaagtacatcatgctggagatcaagctgagaaacagcgagagagccagagaggacgccgagagaagaaaccagctgctgcagagagagatggaggagttcttcagcaccctgggcagcctgaccgtgggcgccaagggcgccagagcccccaagtag

SEQ ID NO: 10924 - DNA, 1209 bp, Artificial Sequence
  Description of Artificial Sequence: Synthetic coding sequence
atgagcgccgagggcgccgagcccggccccggcagcggcagcggccccggccccggccccctgtgccccgagcacggccaggccctgagctggttctgcggcagcgagagaagacccgtgtgcgccgcctgcgccggcctgggcggcagatgcagaggccacagaatcagaagagccgaggagagagccgaggagctgagaaacaagatcgtggaccagtgcgagagactgcagctgcagagcgccgccatcaccaagtacgtggccgacgtgctgcccggcaagaaccagagagccgtgagcatggccagcgccgccagagagctggtgatccagagactgagcctggtgagaagcctgtgcgagagcgaggagcagagactgctggagcaggtgcacggcgaggaggagagagcccaccagagcatcctgacccagagagtgcactgggccgaggccctgcagaagctggacaccatcagaaccggcctggtgggcatgctgacccacctggacgacctgcagctgatccagaaggagcaggagatcttcgagagaaccgaggaggccgagggcatcctggacccccaggagagcgagatgctgaacttcaacgagaagtgcaccagaagccccctgctgacccagctgtgggccaccgccgtgctgggcagcctgagcggcaccgaggacatcagaatcgacgagagaaccgtgagccccttcctgcagctgagcgacgacagaaagaccctgaccttcagcaccaagaagagcaaggcctgcgccgacggccccgagagattcgaccactggcccaacgccctggccgccaccagcttccagaacggcctgcacgcctggatggtgaacgtgcagaacagctgcgcctacaaggtgggcgtggccagcggccacctgcccagaaagggcagcggcagcgactgcagactgggccacaacgccttcagctgggtgttcagcagatacgaccaggagttcagattcagccacaacggccagcacgagcccctgggcctgctgagaggccccgcccagctgggcgtggtgctggacctgcaggtgcaggagctgctgttctacgagcccgccagcggcaccgtgctgtgcgcccaccacgtgagcttccccggccccctgttccccgtgttcgccgtggccgaccagaccatcagcatcgtgagatag

SEQ ID NO: 10925 - DNA, 258 bp, Artificial Sequence
  Description of Artificial Sequence: Synthetic coding sequence
atgctgagaagaaagcccaccagactggagctgaagctggacgacatcgaggagttcgagaacatcagaaaggacctggagaccagaaagaagcagaaggaggacgtggaggtggtgggcggcagcgacggcgagggcgccatcggcctgagcagcgaccccaagagcagagagcagatgatcaacgacagaatcggctacaagccccagcccaagcccaacaacagaagcagccagttcggcagcctggagttctag

SEQ ID NO: 10926 - DNA, 744 bp, Artificial Sequence
  Description of Artificial Sequence: Synthetic coding sequence
atgctgagcgacggctgcggcagcgaggagaagatcagcgtgcccagctgctacggcggcatcggcgcccccgtgagcagacaggtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagcccggcgacagcctggccccccccgaggtggacttcgacagactgctggccagcctgcaggacctgagcgagctggtggtggagggcgacacccaggtgacccccgtgcccggcggcgccagactgagaaccctggagcccatccccctgaagctgtacagaaacggcatcatgatgttcgacggccccttccagcccttctacgaccccagcacccagagatgcctgagagacatcctggacggcttcttccccagcgagctgcagagactgtaccccaacggcgtgcccttcaaggtgtag

SEQ ID NO: 10927 - DNA, 1464 bp, Artificial Sequence; identical to SEQ ID NO: 10432
  Description of Artificial Sequence: Synthetic coding sequence

SEQ ID NO: 10928 - DNA, 1020 bp, Artificial Sequence; identical to SEQ ID NO: 10066
  Description of Artificial Sequence: Synthetic coding sequence

SEQ ID NO: 10929 - DNA, 1563 bp, Artificial Sequence
  Description of Artificial Sequence: Synthetic coding sequence
atgagcagccccctggccagcctgagcaagaccagaaaggtgcccctgcccagcgagcccatgaaccccggcagaagaggcatcagaatctacggcgacgaggacgaggtggacatgctgagcgacggctgcggcagcgaggagaagatcagcgtgcccagctgctacggcggcatcggcgcccccgtgagcagacaggtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagcccggcgacagcctggccccccccgaggtggacttcgacagactgctggccagcctgcaggacctgagcgagctggtggtggagggcgacacccaggtgacccccgtgcccggcggcgccagactgagaaccctggagcccatccccctgaagctgtacagaaacggcatcatgatgttcgacggccccttccagcccttctacgaccccagcacccagagatgcctgagagacatcctggacggcttcttccccagcgagctgcagagactgtaccccaacggcgtgcccttcaaggtgagcgacctgagaaaccaggtgtacctggaggacggcctggaccccttccccggcgagggcagagtggtgggcagacagctgatgcacaaggccctggacagagtggaggagcaccccggcagcagaatgaccgccgagaagttcctgaacagactgcccaagttcgtgatcagacagggcgaggtgatcgacatcagaggccccatcagagacaccctgcagaactgctgccccctgcccgccagaatccaggagatcgtggtggagacccccaccctggccgccgagagagagagaagccaggagagccccaacacccccgccccccccctgagcatgctgagaatcaagagcgagaacggcgagcaggccttcctgctgatgatgcagcccgacaacaccatcggcgacgtgagagccctgctggcccaggccagagtgatggacgccagcgccttcgagatcttcagcaccttcccccccaccctgtaccaggacgacaccctgaccctgcaggccgccggcctggtgcccaaggccgccctgctgctgagagccagaagagcccccaagagcagcctgaagttcagccccggcccctgccccggccccggccccggccccagccccggccccggccccggccccagccccggccccggccccggccccagcccctgccccggccccagccccagcccccagtag

SEQ ID NO: 10930 - DNA, 1563 bp, Artificial Sequence; identical to SEQ ID NO: 10929
  Description of Artificial Sequence: Synthetic coding sequence

SEQ ID NO: 10931 - DNA, 834 bp, Artificial Sequence
  Description of Artificial Sequence: Synthetic coding sequence
atgttcgacggccccttccagcccttctacgaccccagcacccagagatgcctgagagacatcctggacggcttcttccccagcgagctgcagagactgtaccccaacggcgtgcccttcaaggtgagcgacctgagaaaccaggtgtacctggaggacggcctggaccccttccccggcgagggcagagtggtgggcagacagctgatgcacaaggccctggacagagtggaggagcaccccggcagcagaatgaccgccgagaagttcctgaacagactgcccaagttcgtgatcagacagggcgaggtgatcgacatcagaggccccatcagagacaccctgcagaactgctgccccctgcccgccagaatccaggagatcgtggtggagacccccaccctggccgccgagagagagagaagccaggagagccccaacacccccgccccccccctgagcatgctgagaatcaagagcgagaacggcgagcaggccttcctgctgatgatgcagcccgacaacaccatcggcgacgtgagagccctgctggcccaggccagagtgatggacgccagcgccttcgagatcttcagcaccttcccccccaccctgtaccaggacgacaccctgaccctgcaggccgccggcctggtgcccaaggccgccctgctgctgagagccagaagagcccccaagagcagcctgaagttcagccccggcccctgccccggccccggccccggccccagccccggccccggccccggccccagccccggccccggccccggccccagcccctgccccggccccagccccagcccccagtag

SEQ ID NO: 10932 - DNA, 1314 bp, Artificial Sequence
  Description of Artificial Sequence: Synthetic coding sequence
atggccggcggcccccccaaggccctgcccagcaccggcccccacagcctgagagacatgccccaccccctggccggcagcagcagcgaggaggccgtgggcggcgacagcacccccagccccgacctgctgatggccagaagcttcggcgacaaggacctgatcctgcccaacggcggcacccccgccggcaccagcagccccgccagcagcagcagcctgctgaacagactgcagctggacgacgacatcgacggcgagaccagagacctgttcgtgatcgtggacgaccccaagaagcacgtgtgcaccatggagacctacatcacctacagaatcaccaccaagagcaccagagtggagttcgacctgcccgagtacagcgtgagaagaagataccaggacttcgactggctgagaagcaagctggaggagagccagcccacccacctgatcccccccctgcccgagaagttcgtggtgaagggcgtggtggacagattcagcgaggagttcgtggagaccagaagaaaggccctggacaagttcctgaagagaatcaccgaccaccccgtgctgagcttcaacgagcacttcaacatcttcctgaccgccaaggacctgaacgcctacaagaagcagggcatcgccctgctgaccagaatgggcgagagcgtgaagcacgtgaccggcggctacaagctgagaaccagacccctggagttcgccgccatcggcgactacctggacaccttcgccctgaagctgggcaccatcgacagaatcgcccagagaatcatcaaggaggagatcgagtacctggtggagctgagagagtacggccccgtgtacagcacctggagcgccctggagggcgagctggccgagcccctggagggcgtgagcgcctgcatcggcaactgcagcaccgccctggaggagctgaccgacgacatgaccgaggacttcctgcccgtgctgagagagtacatcctgtacagcgacagcatgaagagcgtgctgaagaagagagaccaggtgcaggccgagtacgaggccaagctggaggccgtggccctgagaaaggaggacagacccaaggtgcccgccgacgtggagaagtgccaggacagaatggagtgcttcaacgccgacctgaaggccgacatggagagatggcagaacaacaagagacaggacttcagacagctgctgatgggcatggccgacaagaacatccagtactacgagaagtgcctgatggcctgggagagcatcatccccctgctgcaggagaagcaggaggccaagtag

SEQ ID NO: 10933 - DNA, 1263 bp, Artificial Sequence
  Description of Artificial Sequence: Synthetic coding sequence
atgagcagccccagagacttcagagccgagcccgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgccctacgacagcaccagagtgcccctgggcaagagcaaggactacatcaacgccagctacatcagaatcgtgaactgcggcgaggagtacttctacatcgccacccagggccccctgctgagcaccatcgacgacttctggcagatggtgctggagaacaacagcaacgtgatcgccatgatcaccagagagatcgagggcggcatcatcaagtgctaccactactggcccatcagcctgaagaagcccctggagctgaagcacttcagagtgttcctggagaactaccagatcctgcagtacttcatcatcagaatgttccaggtggtggagaagagcaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 10934 - DNA, 837 bp, Artificial Sequence
  Description of Artificial Sequence: Synthetic coding sequence
atgagcagccccagagacttcagagccgagcccgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatgaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 10935 - DNA, 681 bp, Artificial Sequence
  Description of Artificial Sequence: Synthetic coding sequence
atgagcagccccagagacttcagagccgagcccgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgcccttccagcaccacggctacagcggccccaacgagagaaccaccttctggcacggcagcaacgagggcgccgtgagcctgctgctgagatactgcgcctag

SEQ ID NO: 10936 - DNA, 681 bp, Artificial Sequence
  Description of Artificial Sequence: Synthetic coding sequence
atgcaccagacctgcgtgagactggagagagaggccagcgccagacccagccccggccccgtgctgccccccagacccctgcccagccacaccgagctgcagatcagagagggccccaagagaaccatcagagccgccgccgagggcgccccctgcgtgggcagagtgagatgcgcccccggcaacagaggcggcagagagggcgccagcggcgtgagaggcggcgtggcccaggtgccccccagactgcccgccccccccatcggccccgagagagacgacctggccggcggcgccggcagaaagcccctgcccagcaccgccgccgccagcagccccggcagcgccgccgccgccaccgccgccctgtgcccccccgccagactgagcacccccagcatgagcggcctgagagtgtacagcaccagcgtgaccggcagcagagagatcaagagccagcagagcgaggtgaccagaatcctggacggcaagagaatccagtaccagctggtggacatcagccaggacaacgccctgagagacgagatgagagccctggccggcaaccccaaggccacccccccccagatcgtgaacggcgaccagtactgcggcgactacgagctgttcgtggaggccgtggagcagaacaccctgcaggagttcctgaagctggcctag

SEQ ID NO: 10937 - DNA, 1518 bp, Artificial Sequence
  Description of Artificial Sequence: Synthetic coding sequence
atggaccccggcaacgagaacagcgccaccgaggccgccgccatcatcgacctggaccccgacttcgagccccagagcagacccagaagctgcacctggcccctgcccagacccgagatcgccaaccagcccagcgagccccccgaggtggagcccgacctgggcgagaaggtgcacaccgagggcagaagcgagcccatcctgctgcccagcagactgcccgagcccgccggcggcccccagcccggcatcctgggcgccgtgaccggccccagaaagggcggcagcagaagaaacgcctggggcaaccagagctacgccgagctgatcagccaggccatcgagagcgcccccgagaagagactgaccctggcccagatctacgagtggatggtgagaaccgtgccctacttcaaggacaagggcgacagcaacagcagcgccggctggaagaacagcatcagacacaacctgagcctgcacagcaagttcatcaaggtgcacaacgaggccaccggcaagagcagctggtggatgctgaaccccgagggcggcaagagcggcaaggcccccagaagaagagccgccagcatggacagcagcagcaagctgctgagaggcagaagcaaggcccccaagaagaagcccagcgtgctgcccgccccccccgagggcgccacccccaccagccccgtgggccacttcgccaagtggagcggcagcccctgcagcagaaacagagaggaggccgacatgtggaccaccttcagacccagaagcagcagcaacgccagcagcgtgagcaccagactgagccccctgagacccgagagcgaggtgctggccgaggagatccccgccagcgtgagcagctacgccggcggcgtgccccccaccctgaacgagggcctggagctgctggacggcctgaacctgaccagcagccacagcctgctgagcagaagcggcctgagcggcttcagcctgcagcaccccggcgtgaccggccccctgcacacctacagcagcagcctgttcagccccgccgagggccccctgagcgccggcgagggctgcttcagcagcagccaggccctggaggccctgctgaccagcgacaccccccccccccccgccgacgtgctgatgacccaggtggaccccatcctgagccaggcccccaccctgctgctgctgggcggcctgcccagcagcagcaagctggccaccggcgtgggcctgtgccccaagcccctggaggcccccggccccagcagcctggtgcccaccctgagcatgatcgcccccccccccgtgatggccagcgcccccatccccaaggccctgggcacccccgtgctgaccccccccaccgaggccgccagccaggacagaatgccccaggacctggacctggacatgtacatggagaacctggagtgcgacatggacaacatcatcagcgacctgatggacgagggcgagggcctggacttcaacttcgagcccgacccctag

SEQ ID NO: 10938 - DNA, 1062 bp, Artificial Sequence
  Description of Artificial Sequence: Synthetic coding sequence
atggactacaagagcagcctgatccaggacggcaaccccatggagaacctggagaagcagctgatctgccccatctgcctggagatgttcaccaagcccgtggtgatcctgccctgccagcacaacctgtgcagaaagtgcgccaacgacatcttccaggccgccaacccctactggaccagcagaggcagcagcgtgagcatgagcggcggcagattcagatgccccacctgcagacacgaggtgatcatggacagacacggcgtgtacggcctgcagagaaacctgctggtggagaacatcatcgacatctacaagcaggagtgcagcagcagacccctgcagaagggcagccaccccatgtgcaaggagcacgaggacgagaagatcaacatctactgcctgacctgcgaggtgcccacctgcagcatgtgcaaggtgttcggcatccacaaggcctgcgaggtggcccccctgcagagcgtgttccagggccagaagaccgagctgaacaactgcatcagcatgctggtggccggcaacgacagagtgcagaccatcatcacccagctggaggacagcagaagagtgaccaaggagaacagccaccaggtgaaggaggagctgagccagaagttcgacaccctgtacgccatcctggacgagaagaagagcgagctgctgcagagaatcacccaggagcaggagaagaagctgagcttcatcgaggccctgatccagcagtaccaggagcagctggacaagagcaccaagctggtggagaccgccatccagagcctggacgagcccggcggcgccaccttcctgctgaccgccaagcagctgatcaagagcatcgtggaggccagcaagggctgccagctgggcaagaccgagcagggcttcgagaacatggacttcttcaccctggacctggagcacatcgccgacgccctgagagccatcgacttcggcaccgacgaggaggaggaggagttcatcgaggaggaggaccaggaggaggaggagagcaccgagggcaaggaggagggccaccagtag

SEQ ID NO: 10939 - DNA, 1179 bp, Artificial Sequence
  Description of Artificial Sequence: Synthetic coding sequence
atgggcgtgaaccagagcgtgggcttcccccccgtgaccggcccccacctggtgggctgcggcgacgtgatggagggccagaacctgcagggcagcttcttcagactgttctacccctgccagaaggccgaggagaccatggagcagcccctgtggatccccagatacgagtactgcaccggcctggccgagtacctgcagttcaacaagagatgcggcggcctgctgttcaacctggccgtgggcagctgcagactgcccgtgagctggaacggccccttcaagaccaaggacagcggctaccccctgatcatcttcagccacggcctgggcgccttcagaaccctgtacagcgccttctgcatggagctggccagcagaggcttcgtggtggccgtgcccgagcacagagacagaagcgccgccaccacctacttctgcaagcaggcccccgaggagaaccagcccaccaacgagagcctgcaggaggagtggatccccttcagaagagtggaggagggcgagaaggagttccacgtgagaaacccccaggtgcaccagagagtgagcgagtgcctgagagtgctgaagatcctgcaggaggtgaccgccggccagaccgtgttcaacatcctgcccggcggcctggacctgatgaccctgaagggcaacatcgacatgagcagagtggccgtgatgggccacagcttcggcggcgccaccgccatcctggccctggccaaggagacccagttcagatgcgccgtggccctggacgcctggatgttccccctggagagagacttctaccccaaggccagaggccccgtgttcttcatcaacaccgagaagttccagaccatggagagcgtgaacctgatgaagaagatctgcgcccagcacgagcagagcagaatcatcaccgtgctgggcagcgtgcacagaagccagaccgacttcgccttcgtgaccggcaacctgatcggcaagttcttcagcaccgagaccagaggcagcctggacccctacgagggccaggaggtgatggtgagagccatgctggccttcctgcagaagcacctggacctgaaggaggactacaaccagtggaacaacctgatcgagggcatcggccccagcctgacccccggcgccccccaccacctgagcagcctgtag

SEQ ID NO: 10940 - DNA, 1179 bp, Artificial Sequence; identical to SEQ ID NO: 10939
  Description of Artificial Sequence: Synthetic coding sequence

SEQ ID NO: 10941 - DNA, 213 bp, Artificial Sequence
  Description of Artificial Sequence: Synthetic coding sequence
atggtgagaaccaagacctggaccctgaagaagcacttcgtgggctaccccaccaacagcgacttcgagctgaagaccgccgagctgccccccctgaagaacggcgaggtgctgctggaggccctgttcctgaccgtggacccctacatgagagtggccgccaagagactgaaggagggcgacaccatgatgggccagcaggtggccaagtag

SEQ ID NO: 10942 - DNA, 213 bp, Artificial Sequence; identical to SEQ ID NO: 10941
  Description of Artificial Sequence: Synthetic coding sequence

SEQ ID NO: 10943 - DNA, 534 bp, Artificial Sequence; identical to SEQ ID NO: 9284
  Description of Artificial Sequence: Synthetic coding sequence

SEQ ID NO: 10944 - DNA, 1263 bp, Artificial Sequence; identical to SEQ ID NO: 10933
  Description of Artificial Sequence: Synthetic coding sequence

SEQ ID NO: 10945 - DNA, 837 bp, Artificial Sequence; identical to SEQ ID NO: 10934
  Description of Artificial Sequence: Synthetic coding sequence

SEQ ID NO: 10946 - DNA, 681 bp, Artificial Sequence; identical to SEQ ID NO: 10935
  Description of Artificial Sequence: Synthetic coding sequence

SEQ ID NO: 10947 - DNA, 789 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagcagacccaccggcagacccagaagaagcagaagccacagcgacaacgacagattcaagcacagaaacagaagcttcagcagaagcaagagcaacagcagaagcagaagcaagagccagcccaagaaggagatgaaggccaagagcagaagcagaagcgccagccacaccaagaccagaggcaccagcaagaccgacagcaagacccactacaagagcggcagcagatacgagaaggagagcagaaagaaggagccccccagaagcaagagccagagcagaagccagagcagaagcagaagcaagagcagaagcagaagctggaccagccccaagagcagcggccactag

SEQ ID NO: 10948 - DNA, 522 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaacagcagacccaccggcagacccagaagaagcagaagccacagcgacaacgacagccaggtgagcaagaagaagaacgagagatag

SEQ ID NO: 10949 - DNA, 669 bp, Artificial Sequence
  Description of Artificial Sequence: Synthetic coding sequence
atgagcgccttcggccacgacgaggcctggatggaggccggcggcttcggcctggaggccgccgagagaaccgagtaccagagcctgtgcaagagcaagctgctgttcctgggcgagcagagcgtgggcaagaccagcatcatcagcagattcatgtacaacagcttcggctgcgcctgccaggccaccgtgggcatcgacttcctgagcaagaccatgtacctggaggaccagatcgtgcagctgcagctgtgggacaccgccggccaggagagattccacagcctgatccccagctacatcagagacagcaccatcgccgtggtggtgtacgacatcaccaacatcaacagcttcaaggagaccgacaagtgggtggagcacgtgagagccgagagaggcgacgacgtggtgatcatgctgctgggcaacaagatcgacctggacaacaagagacaggtgaccgccgagcagggcgaggagaagagcagaaacctgaacgtgatgttcatcgagaccagcgccaagaccggctacaacgtgaagaagctgttcagaagagtggccagcgccctgctgagcaccagaaccagccccccccccaaggagggcaccgtggagatcgagctggagagcttcgaggagagcggcaacagaagctactgctag

SEQ ID NO: 10950 - DNA, 348 bp, Artificial Sequence
  Description of Artificial Sequence: Synthetic coding sequence
atggtgcagatcatcaaggacaccaacgagttcaagaccttcctgaccgccgccggccacaagctggccgtggtgcagttcagcagcaagagatgcggcccctgcaagagaatgttccccgtgttccacgccatgagcgtgaagtaccagaacgtgttcttcgccaacgtggacgtgaacaacagccccgagctggccgagacctgccacatcaagaccatccccaccttccagatgttcaagaagagccagaaggtgaccctgttcagcagaatcaagagaatcatctgctgctacagaagcggcttcatgagcaacctgtgcctggccgacgacggcaacgagtag

SEQ ID NO: 10951 - DNA, 384 bp, Artificial Sequence
  Description of Artificial Sequence: Synthetic coding sequence
atggtgcagatcatcaaggacaccaacgagttcaagaccttcctgaccgccgccggccacaagctggccgtggtgcagttcagcagcaagagatgcggcccctgcaagagaatgttccccgtgttccacgccatgagcgtgaagtaccagaacgtgttcttcgccaacgtggacgtgaacaacagccccgagctggccgagacctgccacatcaagaccatccccaccttccagatgttcaagaagagccagaaggtgaccctgttcagcagaatcaagagaatcatctgctgctacagaagcggcttcatgagcaacctgatcttcgagttctgcggcgccgacgccaagaagctggaggccaagacccaggagctgatgtag

SEQ ID NO: 10952 - DNA, 1767 bp, Artificial Sequence
  Description of Artificial Sequence: Synthetic coding sequence
atgcacagaagcgcccccagccagaccaccaagagaagcagaagccccttcagcaccaccagaagaagctgggacgacagcgagagcagcggcaccaacctgaacatcgacaacgaggactacagcagatacccccccagagagtacagagccagcggcagcagaagaggcatggcctacggccacatcgacagctacggcgccgacgacagcgaggaggagggcgccggccccgtggagagaccccccgtgagaggcaagaccggcaagttcaaggacgacaagctgtacgaccccgagaagggcgccagaagcctggccggcccccccccccacttcagcagcttcagcagagacgtgagagaggagagagacaagctggaccccgtgcccgccgccagatgcagcgccagcagagccgacttcctgccccagagcagcgtggccagccagagcagcagcgagggcaagctggccaccaagggcgacagcagcgagagagagagaagagagcagaacctgcccgccagacccagcagagcccccgtgagcatctgcggcggcggcgagaacaccagcaagagcgccgaggagcccgtggtgagacccaagatcagaaacctggccagccccaactgcgtgaagcccaagatcttcttcgacaccgacgacgacgacgacatgccccacagcaccagcagatggagagacaccgccaacgacaacgagggccacagcgacggcctggccagaagaggcagaggcgagagcagcagcggctaccccgagcccaagtaccccgaggacaagagagaggccagaagcgaccaggtgaagcccgagaaggtgcccagaagaagaagaaccatggccgaccccgacttctggacccacagcgacgactactacaagtactgcgacgaggacagcgacagcgacaaggagtggatcgccgccctgagaagaaagtacagaagcagagagcagaccctgagcagcagcggcgagagctgggagaccctgcccggcaaggaggagagagagcccccccaggccaaggtgagcgccagcaccggcaccagccccggccccggcgccagcgccagcgccggcgccggcgccggcgccagcgccggcagcaacggcagcaactacctggaggaggtgagagagcccagcctgcaggaggagcaggccagcctggaggagggcgagatcccctggctgcagtaccacgagaacgacagcagcagcgagggcgacaacgacagcggccacgagctgatgcagcccggcgtgttcatgctggacggcaacaacaacctggaggacgacagcagcgtgagcgaggacctggaggtggactggagcctgttcgacggcttcgccgacggcctgggcgtggccgaggccatcagctacgtggacccccagttcctgacctacatggccctggaggagagactggcccaggccatggagaccgccctggcccacctggagagcctggccgtggacgtggaggtggccaacccccccgccagcaaggagagcatcgacgccctgcccgagatcctggtgaccgaggaccacggcgccgtgggccaggagatgtgctgccccatctgctgcagcgagtacgtgaagggcgaggtggccaccgagctgccctgccaccactacttccacaagccctgcgtgagcatctggctgcagaagagcggcacctgccccgtgtgcagatgcatgttccccccccccctgtag

SEQ ID NO: 10953 - DNA, 612 bp, Artificial Sequence
  Description of Artificial Sequence: Synthetic coding sequence
atgcccgagcagttcagcgtggccgagttcctggccgtgaccgccgaggacctgagcagccccgccggcgccgccgccttcgccgccaagatgcccagatacagaggcgccgccctggccagagaggagatcctggagggcgaccaggccatcctgcagagaatcaagaaggccgtgagagccatccacagcagcggcctgggccacgtggagaacgaggagcagtacagagaggccgtggagagcctgggcaacagccacctgagccagaacagccacgagctgagcaccggcttcctgaacctggccgtgttcaccagagaggtggccgccctgttcaagaacctgatccagaacctgaacaacatcgtgagcttccccctggacagcctgatgaagggccagctgagagacggcagacaggacagcaagaagcagctggagaaggcctggaaggactacgaggccaagatggccaagctggagaaggagagagacagagccagagtgaccggcggcatccccgcctggaacctgggcatccccgccaagccccaccccaccctgaagagagccagcgagagcccccaggccccccccgaccccgcctag

SEQ ID NO: 10954 - DNA, 1932 bp, Artificial Sequence; identical to SEQ ID NO: 10563
  Description of Artificial Sequence: Synthetic coding sequence

SEQ ID NO: 10955 - DNA, 1368 bp, Artificial Sequence
  Description of Artificial Sequence: Synthetic coding sequence
atgggccaggagagcagcaagcccgtgtggcccaaccccaccggcggctaccagagcaacaccggcagaagatacggcagaagacacgcctacgtgagcttcagaccccccaccagccagagagagagaatcgccagccagagaaagaccaacagcgaggtgcccatgcacagaagcgcccccagccagaccaccaagagaagcagaagccccttcagcaccaccagaagaagctgggacgacagcgagagcagcggcaccaacctgaacatcgacaacgaggactacagcagcaccagcagatggagagacaccgccaacgacaacgagggccacagcgacggcctggccagaagaggcagaggcgagagcagcagcggctaccccgagcccaagtaccccgaggacaagagagaggccagaagcgaccaggtgaagcccgagaaggtgcccagaagaagaagaaccatggccgaccccgacttctggacccacagcgacgactactacaagtactgcgacgaggacagcgacagcgacaaggagtggatcgccgccctgagaagaaagtacagaagcagagagcagaccctgagcagcagcggcgagagctgggagaccctgcccggcaaggaggagagagagcccccccaggccaaggtgagcgccagcaccggcaccagccccggccccggcgccagcgccagcgccggcgccggcgccggcgccagcgccggcagcaacggcagcaactacctggaggaggtgagagagcccagcctgcaggaggagcaggccagcctggaggagggcgagatcccctggctgcagtaccacgagaacgacagcagcagcgagggcgacaacgacagcggccacgagctgatgcagcccggcgtgttcatgctggacggcaacaacaacctggaggacgacagcagcgtgagcgaggacctggaggtggactggagcctgttcgacggcttcgccgacggcctgggcgtggccgaggccatcagctacgtggacccccagttcctgacctacatggccctggaggagagactggcccaggccatggagaccgccctggcccacctggagagcctggccgtggacgtggaggtggccaacccccccgccagcaaggagagcatcgacgccctgcccgagatcctggtgaccgaggaccacggcgccgtgggccaggagatgtgctgccccatctgctgcagcgagtacgtgaagggcgaggtggccaccgagctgccctgccaccactacttccacaagccctgcgtgagcatctggctgcagaagagcggcacctgccccgtgtgcagatgcatgttccccccccccctgtag

SEQ ID NO: 10956 - DNA, 390 bp, Artificial Sequence
  Description of Artificial Sequence: Synthetic coding sequence
atggccgagctgatccagaagaagctgcagggcgaggtggagaagtaccagcagctgcagaaggacctgagcaagagcatgagcggcagacagaagctggaggcccagctgaccgagaacaacatcgtgaaggaggagctggccctgctggacggcagcaacgtggtgttcaagctgctgggccccgtgctggtgaagcaggagctgggcgaggccagagccaccgtgggcaagagactggactacatcaccgccgagatcaagagatacgagagccagctgagagacctggagagacagagcgagcagcagagagagaccctggcccagctgcagcaggagttccagagagcccaggccgccaaggccggcgcccccggcaaggcctag

SEQ ID NO: 10957 - DNA, 390 bp, Artificial Sequence; identical to SEQ ID NO: 10956
  Description of Artificial Sequence: Synthetic coding sequence

SEQ ID NO: 10958 - DNA, 390 bp, Artificial Sequence; identical to SEQ ID NO: 10956
  Description of Artificial Sequence: Synthetic coding sequence

SEQ ID NO: 10959 - DNA, 1512 bp, Artificial Sequence
  Description of Artificial Sequence: Synthetic coding sequence
atgaagtgcgagcactgcaccagaaaggagtgcagcaagaagaccaagaccgacgaccaggagaacgtgagcgccgacgcccccagccccgcccaggagaacggcgagaagggcgagttccacaagctggccgacgccaagatcttcctgagcgactgcctggcctgcgacagctgcatgaccgccgaggagggcgtgcagctgagccagcagaacgccaaggacttcttcagagtgctgaacctgaacaagaagtgcgacaccagcaagcacaaggtgctggtggtgagcgtgtgcccccagagcctgccctacttcgccgccaagttcaacctgagcgtgaccgacgccagcagaagactgtgcggcttcctgaagagcctgggcgtgcactacgtgttcgacaccaccatcgccgccgacttcagcatcctggagagccagaaggagttcgtgagaagatacagacagcacagcgaggaggagagaaccctgcccatgctgaccagcgcctgccccggctgggtgagatacgccgagagagtgctgggcagacccatcaccgcccacctgtgcaccgccaagagcccccagcaggtgatgggcagcctggtgaaggactacttcgccagacagcagaacctgagccccgagaagatcttccacgtgatcgtggccccctgctacgacaagaagctggaggccctgcaggagagcctgccccccgccctgcacggcagcagaggcgccgactgcgtgctgaccagcggcaaggtgctgatcagctggtggtgcacccccgtgatcaccgccacccaggaggccgccgccagagagagcctggagcccggcagacagagactgcagagagacaagatcgcccccctggacagcagcctgggcggcggcggcgagatcgcccagatcatggagcagggcgacctgagcgtgagagacgccgccgtggacaccctgttcggcgacctgaaggaggacaaggtgaccagacacgacggcgccagcagcgacggccacctggcccacatcttcagacacgccgccaaggagctgttcaacgaggacgtggaggaggtgacctacagagccctgagaaacaaggacttccaggaggtgaccctggagaagaacggcgaggtggtgctgagattcgccgccgcctacggcttcagaaacatccagaacatgatcctgaagctgaagaagggcaagttccccttccacttcgtggaggtgctggcctgcgccggcggctgcctgaacggcagaggccaggcccagacccccgacggccacgccgacaaggccctgctgagacagatggagggcatctacgccgacatccccgtgagaagacccgagagcagcgcccacgtgcaggagctgtaccaggagtggctggagggcatcaacagccccaaggccagagaggtgctgcacaccacctaccagagccaggagagaggcacccacagcctggacatcaagtggtag

SEQ ID NO: 10960 - DNA, 348 bp, Artificial Sequence
  Description of Artificial Sequence: Synthetic coding sequence
atggccaccgagcccgaggccgccgagcccgtggtgcccagcctggtggacagatacttcaccagatggtacaagcccgacgtgaagggcaagttctgcgaggaccactgcatcctgcagcacagcaacagaatctgcgtgatcaccctggccgagagccaccccgtgctgcagagcggcaagaccatcaagagcatcagctaccagatcagcaccaactgcagcagactgcagaacaaggtgagcggcaagttcaagagaagaatcatctacctggagaaggtggaggacgtgatcaagagaaagatgatgcccctgagcctgggcctgcacctgccccacagctag

SEQ ID NO: 10961 - DNA, 1566 bp, Artificial Sequence
  Description of Artificial Sequence: Synthetic coding sequence
atgaacgtgagcctgagccagaagaccgtgaagatccacagactgttccccatgctggccttcagcgagccctacgagttcgtgagcctggagtggctgcagaagtggctggacgagagcacccccaccaagcccatcgacaaccacgcctgcctgtgcagccacgacaagctgcaccccgacaagatcagcatcatgaagagaatcagcgagtacgccgccgacatcttctacagcagatacggcggcggccccagactgaccgtgaaggccctgtgcaaggagtgcgtggtggagagatgcagaatcctgagactgaagaaccagctgaacgaggactacaagaccgtgaacaacctgctgaaggccgccgtgaagggcgacggcttctgggtgggcaagagcagcctgagaagctggagacagctggccctggagcagctggacgagcaggacggcgacgccgagcagagcaacggcaagatgaacggcagcaccctgaacaaggacgagagcaaggaggagagaaaggaggaggaggagctgaacttcaacgaggacatcctgtgcccccacggcgagctgtgcatcagcgagaacgagagaagactggtgagcaaggaggcctggagcaagctgcagcagtacttccccaaggcccccgagttccccagctacaaggagtgctgcagccagtgcaagatcctggagagagagggcgaggagaacgaggccctgcacaagatgatcgccaacgagcagaagaccagcctgcccaacctgttccaggacaagaacagaccctgcctgagcaactggcccgaggacaccgacgtgctgtacatcgtgagccagttcttcgtggaggagtggagaaagttcgtgagaaagcccaccagatgcagccccgtgagcagcgtgggcaacagcgccctgctgtgcccccacggcggcctgatgttcaccttcgccagcatgaccaaggaggacagcaagctgatcgccctgatctggcccagcgagtggcagatgatccagaagctgttcgtggtggaccacgtgatcaagatcaccagaatcgaggtgggcgacgtgaaccccagcgagacccagtacatcagcgagcccaagctgtgccccgagtgcagagagggcctgctgtgccagcagcagagagacctgagagagtacacccaggccaccatctacgtgcacaaggtggtggacaacaagaaggtgatgaaggacagcgcccccgagctgaacgtgagcagcagcgagaccgaggaggacaaggaggaggccaagcccgacggcgagaaggaccccgacttcaaccagatcatgcacgccttcagcgtggcccccttcgaccagaacctgagcatcgacggcaagatcctgagcgacgactgcgccaccctgggcaccctgggcgtgatccccgagagcgtgatcctgctgaaggccgacgagcccatcgccgactacgccgccatggacgacgtgatgcaggtgtgcatgcccgaggagggcttcaagggcaccggcctgctgggccactag

SEQ ID NO: 10962 - DNA, 984 bp, Artificial Sequence
  Description of Artificial Sequence: Synthetic coding sequence
atgaccgccgtgggcgccgagagactgaccagcgtgagagcctggctgagctgctgcggcgcctgcgtgtgcgtgttcctgttcctgtgcctgtgcgtgttccccctgagagtgcacgtgcacgtgtggggcggcgagtgcagagtggacatcgccgtgttcgtgagcaagcacatgatcgtggccctgatgcacgtgaccggcgccgccggcctgctgagactgtgcgtgagagcctgcgtgtgcatgagagtgtgcgccaccgcccacatgtacagagtggacaagagcttcaccagcagaagaagcgtgtggagaagcgacggccagaaccagcacttcccccaggccctggacctgagcagagtgaacctggtgcccagctacacccccagcctgtaccccaagaacaccgacctgttcgagatgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggtgtggctggacctgggcaccgcccactag

SEQ ID NO: 10963 - DNA, 2079 bp, Artificial Sequence
  Description of Artificial Sequence: Synthetic coding sequence
atgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagcagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgctgatccccggcaagagcgccagcagattcggcagaagaggcagcgccatcggcatcggcaccgtggaggaggtggtggtgagaggcgccgccggcagcggcggctgcctgcacgccctgttcagcgccagaagccaggacggcggccacatcggcgacgtggcccccctgccccccggccaggcccccggcagagccggctggagcggcggcagcagcgacggcacccagcacctgctgtggggcctgagcctgatcgtgcccggcaagagccccaccagaaagaagagcggccccttcggcagcagaagaagcagcgccatcggcatcgagaacatccaggaggtgcaggagaagagagagagcccccccgccggccagaagacccccgacagcggccacgtgagccaggagcccaagagcgagaacagcagcacccagagcagccccgagatgcccaccaccaagaacagagccgagaccgccgcccagagagccgaggccctgaagctgcccctgctggtgcagtgccagcagctgagacagagaggcggcggcgacggcggctgcggcagaagaggccacagacccggcgagagagtgatcctgagaaacaccccccaggccggcctgctgcacctgtag

SEQ ID NO: 10964 - DNA, 2085 bp, Artificial Sequence
  Description of Artificial Sequence: Synthetic coding sequence
atggcccagctgagacccgccgtgccccccggcagacccagaagaggcagcctgcccgccggcgccagctggcagaacaccgacctgttcgagatgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagcagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgatcgtgcccggcaagagccccaccagaaagaagagcggccccttcggcagcagaagaagcagcgccatcggcatcgagaacatccaggaggtgcaggagaagagagagagcccccccgccggccagaagacccccgacagcggccacgtgagccaggagcccaagagcgagaacagcagcacccagagcagccccgagatgcccaccaccaagaacagagccgagaccgccgcccagagagccgaggccctgaaggacttcagcagaagcagcagcagcgccagcagcttcgccagcgtggtggaggagaccgagggcgtggacggcgaggacaccggcctggagagcgtgagcagcagcggcaccccccacaagagagacagcttcatctacagcacctggctggaggacagcgtgagcaccaccagcggcggcagcagccccggccccagcagaagcccccaccccgacgccggcaagctgggcgaccccgcctgccccgagatcaagatccagctggaggccagcgagcagcacatgccccagctgggctgctag

SEQ ID NO: 10965 - DNA, 2082 bp, Artificial Sequence
  Description of Artificial Sequence: Synthetic coding sequence
atggcccagctgagacccgccgtgccccccggcagacccagaagaggcagcctgcccgccggcgccagctggcagaacaccgacctgttcgagatgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgatcgtgcccggcaagagccccaccagaaagaagagcggccccttcggcagcagaagaagcagcgccatcggcatcgagaacatccaggaggtgcaggagaagagagagagcccccccgccggccagaagacccccgacagcggccacgtgagccaggagcccaagagcgagaacagcagcacccagagcagccccgagatgcccaccaccaagaacagagccgagaccgccgcccagagagccgaggccctgaaggacttcagcagaagcagcagcagcgccagcagcttcgccagcgtggtggaggagaccgagggcgtggacggcgaggacaccggcctggagagcgtgagcagcagcggcaccccccacaagagagacagcttcatctacagcacctggctggaggacagcgtgagcaccaccagcggcggcagcagccccggccccagcagaagcccccaccccgacgccggcaagctgggcgaccccgcctgccccgagatcaagatccagctggaggccagcgagcagcacatgccccagctgggctgctag

SEQ ID NO: 10966 - DNA, 1992 bp, Artificial Sequence
  Description of Artificial Sequence: Synthetic coding sequence
atgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagcagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgatcgtgcccggcaagagccccaccagaaagaagagcggccccttcggcagcagaagaagcagcgccatcggcatcgagaacatccaggaggtgcaggagaagagagagagcccccccgccggccagaagacccccgacagcggccacgtgagccaggagcccaagagcgagaacagcagcacccagagcagccccgagatgcccaccaccaagaacagagccgagaccgccgcccagagagccgaggccctgaaggacttcagcagaagcagcagcagcgccagcagcttcgccagcgtggtggaggagaccgagggcgtggacggcgaggacaccggcctggagagcgtgagcagcagcggcaccccccacaagagagacagcttcatctacagcacctggctggaggacagcgtgagcaccaccagcggcggcagcagccccggccccagcagaagcccccaccccgacgccggcaagctgggcgaccccgcctgccccgagatcaagatccagctggaggccagcgagcagcacatgccccagctgggctgctag

SEQ ID NO: 10967 - DNA, 744 bp, Artificial Sequence
  Description of Artificial Sequence: Synthetic coding sequence
atgctggtgctgagaagcgccctgaccagagccctggccagcagaaccctggccccccagatgtgcagcagcttcgccaccggccccagacagtacgacggcatcttctacgagttcagaagctactacctgaagcccagcaagatgaacgagttcctggagaacttcgagaagaacgcccacctgagaaccgcccacagcgagctggtgggctactggagcgtggagttcggcggcagaatgaacaccgtgttccacatctggaagtacgacaacttcgcccacagaaccgaggtgagaaaggccctggccaaggacaaggagtggcaggagcagttcctgatccccaacctggccctgatcgacaagcaggagagcgagatcacctacctggtgccctggtgcaagctggagaagccccccaaggagggcgtgtacgagctggccaccttccagatgaagcccggcggccccgccctgtggggcgacgccttcaagagagccgtgcacgcccacgtgaacctgggctacaccaagctggtgggcgtgttccacaccgagtacggcgccctgaacagagtgcacgtgctgtggtggaacgagagcgccgacagcagagccgccggcagacacaagagccacgaggaccccagagtggtggccgccgtgagagagagcgtgaactacctggtgagccagcagaacatgctgctgatccccaccagcttcagccccctgaagtag

SEQ ID NO: 10968 - DNA, 3594 bp, Artificial Sequence; identical to SEQ ID NO: 9615
  Description of Artificial Sequence: Synthetic coding sequence

SEQ ID NO: 10969 - DNA, 3594 bp, Artificial Sequence; identical to SEQ ID NO: 9615
  Description of Artificial Sequence: Synthetic coding sequence

SEQ ID NO: 10970 - DNA, 1047 bp, Artificial Sequence
  Description of Artificial Sequence: Synthetic coding sequence
atgagcctgcccagattccagagagtgaacttcggcccctacgacaactacatccccgtgagcgagctgagcaagaagagctggaaccagcagcacttcgccctgctgttccccaagccccagagacccggcaccaagagaagaagcaagcccagccagatcagagacaacaccgtgagcatcatcgacgaggagcagctgagaggcgacagaagacagcccctgtggatgtacagaagcctgatgagaatcagcgagagacccagcgtgtacctggccgccagaagacagcccctgaagcccaccagaaccgtggaggtggacagcaaggccgccgagatcggcaagaagggcgaggacaagaccacccagaaggacaccaccgacagcgagagcgagctgaagcagggcaagaaggacagcaagaagggcaaggacatcgagaagggcaaggaggagaagctggacgccaagaaggacagcaagaagggcaagaaggacgccgagaagggcaaggacagcgccaccgagagcgaggacgagaagggcggcgccaagaaggacaacaagaaggacaagaaggacagcaacaagggcaaggacagcgccaccgagagcgagggcgagaagggcggcaccgagaaggacagcaagaagggcaagaaggacagcaagaagggcaaggacagcgccatcgagctgcaggccgtgaaggccgacgagaagaaggacgaggacggcaagaaggacgccaacaagggcgacgagagcaaggacgccaagaaggacgccaaggagatcaagaagggcaagaaggacaagaagaagcccagcagcaccgacagcgacagcaaggacgacgtgaagaaggagagcaagaaggacgccaccaaggacgccaagaaggtggccaagaaggacaccgagaaggagagcgccgacagcaagaaggacgccaagaagaacgccaagaaggacgccaagaaggacgccaagaagaacgccaagaaggacgagaagaaggacgccaagaagaagggcaagtag

SEQ ID NO: 10971 - DNA, 1515 bp, Artificial Sequence
  Description of Artificial Sequence: Synthetic coding sequence
atgaacagccagccccagaccagaagccccttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagcagctgcccagccaggtgcccgagcacagccccgtggtgtacggcaccgtggagagcgcccacctggccgccagcacccccgtgaccgccgccagcgaccagaagcaggaggagaagcccaagcccgaccccgtgctgaagagccccagccccgtgctgagactggtgctgagcggcgagaagaaggagcaggagggccagaccagcgagaccaccgccatcgtgagcatcgccgagctgcccctgccccccagccccaccaccgtgagcagcgtggccagaagcaccatcgccgcccccaccagcagcgccctgagcagccagcccatcttcaccaccgccatcgacgacagatgcgagctgagcagccccagagaggacaccatccccatccccagcctgaccagctgcaccgagaccagcgaccccctgcccaccaacgagaacgacgacgacatctgcaagaagccctgcagcgtggcccccaacgacatccccctggtgagcagcaccaacctgatcaacgagatcaacggcgtgagcgagaagctgagcgccaccgagagcatcgtggagatcgtgaagcaggaggtgctgcccctgaccctggagctggagatcctggagaacccccccgaggagatgaagctggagtgcatccccgcccccatcacccccagcaccgtgcccagcttcccccccaccccccccaccccccccgccagccccccccacacccccgtgatcgtgcccgccgccgccaccaccgtgagcagccccagcgccgccatcaccgtgcagagagtgctggaggaggacgagagcatcagaacctgcctgagcgaggacgccaaggagatccagaacaagatcgaggtggaggccgacggccagaccgaggagatcctggacagccagaacctgaacagcagaagaagccccgtgcccgagaccagcaacgagtgctag

SEQ ID NO: 10972 - DNA, 744 bp, Artificial Sequence
  Description of Artificial Sequence: Synthetic coding sequence
atgctgaagttcctggtgtggttcctgcagtggtgcgtgtgcgtgctggtgcagcccgccaaggagctgctgcactgcctgaagatgcagatgagaatcagcaagtacaccaagtgcctgcaggcccagatcgccatcaccgtgcccaagacctggaagaagcccaaggacagaaccagaaccaccgaggagatgctggaggccgagctggagctgaaggccgaggaggagctgagcatcgacaaggtgctggagagcgagcaggacaagatgagccagggcttccaccccgagagagaccccagcgacctgaagaaggtgaaggccgtggaggagaacggcgaggaggccgagcccgtgagaaacggcgccgagagcgtgagcgagggcgagggcatcgacgccaacagcggcagcaccgacagcagcggcgacggcgtgaccttccccttcaagcccgagagctggaagcccaccgacaccgagggcaagaagcagtacgacagagagttcctgctggacttccagttcatgcccgcctgcatccagaagcccgagggcctgccccccatcagcgacgtggtgctggacaagatcaaccagcccaagctgcccatgagaaccctggaccccagaatcctgcccagaggccccgacttcacccccgccttcgccgacttcggcagacagacccccggcggcagaggcgtgcccgtgagcgccagcagcctgcagctgacctag

SEQ ID NO: 10973 - DNA, 3918 bp, Artificial Sequence
  Description of Artificial Sequence: Synthetic coding sequence
atgaacagccagccccagaccagaagccccttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagcagctgcccagccaggtgcccgagcacagccccgtggtgtacggcaccgtggagagcgcccacctggccgccagcacccccgtgaccgccgccagcgaccagaagcaggcccagatcgccatcaccgtgcccaagacctggaagaagcccaaggacagaaccagaaccaccgaggagatgctggaggccgagctggagctgaaggccgaggaggagctgagcatcgacaaggtgctggagagcgagcaggacaagatgagccagggcttccaccccgagagagaccccagcgacctgaagaaggtgaaggccgtggaggagaacggcgaggaggccgagcccgtgagaaacggcgccgagagcgtgagcgagggcgagggcatcgacgccaacagcggcagcaccgacagcagcggcgacggcgtgaccttccccttcaagcccgagagctggaagcccaccgacaccgagggcaagaagcagtacgacagagagttcctgctggacttccagttcatgcccgcctgcatccagaagcccgagggcctgccccccatcagcgacgtggtgctggacaagatcaaccagcccaagctgcccatgagaaccctggaccccagaatcctgcccagaggccccgacttcacccccgccttcgccgacttcggcagacagacccccggcggcagaggcgtgcccctgctgaacgtgggcagcagaagaagccagcccggccagagaagagagcccagaaagatcatcaccgtgagcgtgaaggaggacgtgcacctgaagaaggccgagaacgcctggaagcccagccagaagagagacagccaggccgacgaccccgagaacatcaagacccaggagctgttcagaaaggtgagaagcatcctgaacaagctgaccccccagatgttcaaccagctgatgaagcaggtgagcggcctgaccgtggacaccgaggagagactgaagggcgtgatcgacctggtgttcgagaaggccatcgacgagcccagcttcagcgtggcctacgccaacatgtgcagatgcctggtgaccctgaaggtgcccatggccgacaagcccggcaacaccgtgaacttcagaaagctgctgctgaacagatgccagaaggagttcgagaaggacaaggccgacgacgacgtgttcgagaagaagcagaaggagctggaggccgccagcgcccccgaggagagaaccagactgcacgacgagctggaggaggccaaggacaaggccagaagaagaagcatcggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcgtgaaggagagaaagaccagcagcagaatcagattcatgctgcaggacgtgatcgacctgagactgtgcaactgggtgagcagaagagccgaccagggccccaagaccatcgagcagatccacaaggaggccaagatcgaggagcaggaggagcagagaaaggtgcagcagctgatgaccaaggagaagagaagacccggcgtgcagagagtggacgagggcggctggaacaccgtgcagggcgccaagaacagcagagtgctggaccccagcaagttcctgaagatcaccaagcccaccatcgacgagaagatccagctggtgcccaaggcccagctgggcagctggggcaagggcagcagcggcggcgccaaggccagcgagaccgacgccctgagaagcagcgccagcagcctgaacagattcagcgccctgcagccccccgcccccagcggcagcacccccagcacccccgtggagttcgacagcagaagaaccctgaccagcagaggcagcatgggcagagagaagaacgacaagcccctgcccagcgccaccgccagacccaacaccttcatgagaggcggcagcagcaaggacctgctggacaaccagagccaggaggagcagagaagagagatgctggagaccgtgaagcagctgaccggcggcgtggacgtggagagaaacagcaccgaggccgagagaaacaagaccagagagagcgccaagcccgagatcagcgccatgagcgcccacgacaaggccgccctgagcgaggaggagctggagagaaagagcaagagcatcatcgacgagttcctgcacatcaacgacttcaaggaggccatgcagtgcgtggaggagctgaacgcccagggcctgctgcacgtgttcgtgagagtgggcgtggagagcaccctggagagaagccagatcaccagagaccacatgggccagctgctgtaccagctggtgcagagcgagaagctgagcaagcaggacttcttcaagggcttcagcgagaccctggagctggccgacgacatggccatcgacatcccccacatctggctgtacctggccgagctggtgacccccatgctgaaggagggcggcatcagcatgagagagctgaccatcgagttcagcaagcccctgctgcccgtgggcagagccggcgtgctgctgagcgagatcctgcacctgctgtgcaagcagatgagccacaagaaggtgggcgccctgtggagagaggccgacctgagctggaaggacttcctgcccgagggcgaggacgtgcacaacttcctgctggagcagaagctggacttcatcgagagcgacagcccctgcagcagcgaggccctgagcaagaaggagctgagcgccgaggagctgtacaagagactggagaagctgatcatcgaggacaaggccaacgacgagcagatcttcgactgggtggaggccaacctggacgagatccagatgagcagccccaccttcctgagagccctgatgaccgccgtgtgcaaggccgccatcatcgccgacagcagcaccttcagagtggacaccgccgtgatcaagcagagagtgcccatcctgctgaagtacctggacagcgacaccgagaaggagctgcaggccctgtacgccctgcaggccagcatcgtgaagctggaccagcccgccaacctgctgagaatgttcttcgactgcctgtacgacgaggaggtgatcagcgaggacgccttctacaagtgggagagcagcaaggaccccgccgagcagaacggcaagggcgtggccctgaagagcgtgaccgccttcttcacctggctgagagaggccgaggaggagagcgaggacaactag

SEQ ID NO: 10974 - DNA, 4776 bp, Artificial Sequence
  Description of Artificial Sequence: Synthetic coding sequence
atgaacagccagccccagaccagaagccccggcggcttcagacccatccagttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagctgcccagccaggtgcccgagcacagccccgtggtgtacggcaccgtggagagcgcccacctggccgccagcacccccgtgaccgccgccagcgaccagaagcaggaggagaagcccaagcccgaccccgtgctgaagagccccagccccgtgctgagactggtgctgagcggcgagaagaaggagcaggagggccagaccagcgagaccaccgccatcgtgagcatcgccgagctgcccctgccccccagccccaccaccgtgagcagcgtggccagaagcaccatcgccgcccccaccagcagcgccctgagcagccagcccatcttcaccaccgccatcgacgacagatgcgagctgagcagccccagagaggacaccatccccatccccagcctgaccagctgcaccgagaccagcgaccccctgcccaccaacgagaacgacgacgacatctgcaagaagccctgcagcgtggcccccaacgacatccccctggtgagcagcaccaacctgatcaacgagatcaacggcgtgagcgagaagctgagcgccaccgagagcatcgtggagatcgtgaagcaggaggtgctgcccctgaccctggagctggagatcctggagaacccccccgaggagatgaagctggagtgcatccccgcccccatcacccccagcaccgtgcccagcttcccccccaccccccccaccccccccgccagccccccccacacccccgtgatcgtgcccgccgccgccaccaccgtgagcagccccagcgccgccatcaccgtgcagagagtgctggaggaggacgagagcatcagaacctgcctgagcgaggacgccaaggagatccagaacaagatcgaggtggaggccgacggccagaccgaggagatcctggacagccagaacctgaacagcagaagaagccccgtgcccgcccagatcgccatcaccgtgcccaagacctggaagaagcccaaggacagaaccagaaccaccgaggagatgctggaggccgagctggagctgaaggccgaggaggagctgagcatcgacaaggtgctggagagcgagcaggacaagatgagccagggcttccaccccgagagagaccccagcgacctgaagaaggtgaaggccgtggaggagaacggcgaggaggccgagcccgtgagaaacggcgccgagagcgtgagcgagggcgagggcatcgacgccaacagcggcagcaccgacagcagcggcgacggcgtgaccttccccttcaagcccgagagctggaagcccaccgacaccgagggcaagaagcagtacgacagagagttcctgctggacttccagttcatgcccgcctgcatccagaagcccgagggcctgccccccatcagcgacgtggtgctggacaagatcaaccagcccaagctgcccatgagaaccctggaccccagaatcctgcccagaggccccgacttcacccccgccttcgccgacttcggcagacagacccccggcggcagaggcgtgcccctgctgaacgtgggcagcagaagaagccagcccggccagagaagagagcccagaaagatcatcaccgtgagcgtgaaggaggacgtgcacctgaagaaggccgagaacgcctggaagcccagccagaagagagacagccaggccgacgaccccgagaacatcaagacccaggagctgttcagaaaggtgagaagcatcctgaacaagctgaccccccagatgttcaaccagctgatgaagcaggtgagcggcctgaccgtggacaccgaggagagactgaagggcgtgatcgacctggtgttcgagaaggccatcgacgagcccagcttcagcgtggcctacgccaacatgtgcagatgcctggtgaccctgaaggtgcccatggccgacaagcccggcaacaccgtgaacttcagaaagctgctgctgaacagatgccagaaggagttcgagaaggacaaggccgacgacgacgtgttcgagaagaagcagaaggagctggaggccgccagcgcccccgaggagagaaccagactgcacgacgagctggaggaggccaaggacaaggccagaagaagaagcatcggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcgtgaaggagagaaagaccagcagcagaatcagattcatgctgcaggacgtgatcgacctgagactgtgcaactgggtgagcagaagagccgaccagggccccaagaccatcgagcagatccacaaggaggccaagatcgaggagcaggaggagcagagaaaggtgcagcagctgatgaccaaggagaagagaagacccggcgtgcagagagtggacgagggcggctggaacaccgtgcagggcgccaagaacagcagagtgctggaccccagcaagttcctgaagatcaccaagcccaccatcgacgagaagatccagctggtgcccaaggcccagctgggcagctggggcaagggcagcagcggcggcgccaaggccagcgagaccgacgccctgagaagcagcgccagcagcctgaacagattcagcgccctgcagccccccgcccccagcggcagcacccccagcacccccgtggagttcgacagcagaagaaccctgaccagcagaggcagcatgggcagagagaagaacgacaagcccctgcccagcgccaccgccagacccaacaccttcatgagaggcggcagcagcaaggacctgctggacaaccagagccaggaggagcagagaagagagatgctggagaccgtgaagcagctgaccggcggcgtggacgtggagagaaacagcaccgaggccgagagaaacaagaccagagagagcgccaagcccgagatcagcgccatgagcgcccacgacaaggccgccctgagcgaggaggagctggagagaaagagcaagagcatcatcgacgagttcctgcacatcaacgacttcaaggaggccatgcagtgcgtggaggagctgaacgcccagggcctgctgcacgtgttcgtgagagtgggcgtggagagcaccctggagagaagccagatcaccagagaccacatgggccagctgctgtaccagctggtgcagagcgagaagctgagcaagcaggacttcttcaagggcttcagcgagaccctggagctggccgacgacatggccatcgacatcccccacatctggctgtacctggccgagctggtgacccccatgctgaaggagggcggcatcagcatgagagagctgaccatcgagttcagcaagcccctgctgcccgtgggcagagccggcgtgctgctgagcgagatcctgcacctgctgtgcaagcagatgagccacaagaaggtgggcgccctgtggagagaggccgacctgagctggaaggacttcctgcccgagggcgaggacgtgcacaacttcctgctggagcagaagctggacttcatcgagagcgacagcccctgcagcagcgaggccctgagcaagaaggagctgagcgccgaggagctgtacaagagactggagaagctgatcatcgaggacaaggccaacgacgagcagatcttcgactgggtggaggccaacctggacgagatccagatgagcagccccaccttcctgagagccctgatgaccgccgtgtgcaaggccgccatcatcgccgacagcagcaccttcagagtggacaccgccgtgatcaagcagagagtgcccatcctgctgaagtacctggacagcgacaccgagaaggagctgcaggccctgtacgccctgcaggccagcatcgtgaagctggaccagcccgccaacctgctgagaatgttcttcgactgcctgtacgacgaggaggtgatcagcgaggacgccttctacaagtgggagagcagcaaggaccccgccgagcagaacggcaagggcgtggccctgaagagcgtgaccgccttcttcacctggctgagagaggccgaggaggagagcgaggacaactag

SEQ ID NO: 10975 - DNA, 1002 bp, Artificial Sequence
  Description of Artificial Sequence: Synthetic coding sequence
atgagcggcgacgagatgatcttcgaccccaccatgagcaagaagaagaagaagaagaagaagcccttcatgctggacgaggagggcgacacccagaccgaggagacccagcccagcgagaccaaggaggtggagcccgagcccaccgaggacaaggacctggaggccgacgaggaggacaccagaaagaaggacgccagcgacgacctggacgacctgaacttcttcaaccagaagaagaagaagaagaagaccaagaagatcttcgacatcgacgaggccgaggagggcgtgaaggacctgaagatcgagagcgacgtgcaggagcccaccgagcccgaggacgacctggacatcatgctgggcaacaagaagaagaagaagaagaacgtgaagttccccgacgaggacgagatcctggagaaggacgaggccctggaggacgaggacaacaagaaggacgacggcatcagcttcagcaaccagaccggccccgcctgggccggcagcgagagagactacacctacgaggagctgctgaacagagtgttcaacatcatgagagagaagaaccccgacatggtggccggcgagaagagaaagttcgtgatgaagcccccccaggtggtgagagtgggcaccaagaagaccagcttcgtgaacttcaccgacatctgcaagctgctgcacagacagcccaagcacctgctggccttcctgctggccgagctgggcaccagcggcagcatcgacggcaacaaccagctggtgatcaagggcagattccagcagaagcagatcgagaacgtgctgagaagatacatcaaggagtacgtgacctgccacacctgcagaagccccgacaccatcctgcagaaggacaccagactgtacttcctgcagtgcgagacctgccacagcagatgcagcgtggccagcatcaagaccggcttccaggccgtgaccggcaagagagcccagctgagagccaaggccaactag

SEQ ID NO: 10976 - DNA, 2619 bp, Artificial Sequence
  Description of Artificial Sequence: Synthetic coding sequence
atgggcgagggcggcctgccccccgccttccagctgctgctgagagcctgcgaccagggcgacaccgagaccgccagaagactgctggagcccggcgccgccgagcccgccgagagaggcgccgagcccgaggccggcgccgagcccgccggcgccgaggtggccggccccggcgccgccgccgccggcgccgtgggcgcccccgtgcccgtggactgcagcgacgaggccggcaacaccgccctgcagttcgccgccgccggcggccacgagcccctggtgagattcctgctgagaagaggcgccagcgtgaacagcagaaaccactacggctggagcgccctgatgcaggccgccagattcggccacgtgagcgtggcccacctgctgctggaccacggcgccgacgtgaacgcccagaacagactgggcgccagcgtgctgaccgtggccagcagaggcggccacctgggcgtggtgaagctgctgctggaggccggcgccttcgtggaccaccaccaccccagcggcgagcagctgggcctgggcggcagcagagacgagcccctggacatcaccgccctgatggccgccatccagcacggccacgaggccgtggtgagactgctgatggagtggggcgccgaccccaaccacgccgccagaaccgtgggctggagccccctgatgctggccgccctgaccggcagactgggcgtggcccagcagctggtggagaagggcgccaaccccgaccacctgagcgtgctggagaagaccgccttcgaggtggccctggactgcaagcacagagacctggtggactacctggaccccctgaccaccgtgagacccaagaccgacgaggagaagagaagacccgacatcttccacgccctgaagatgggcaacttccagctggtgaaggagatcgccgacgaggaccccagccacgtgaacctggtgaacggcgacggcgccacccccctgatgctggccgccgtgaccggccagctggccctggtgcagctgctggtggagagacacgccgacgtggacaagcaggacagcgtgcacggctggaccgccctgatgcaggccacctaccacggcaacaaggagatcgtgaagtacctgctgaaccagggcgccgacgtgaccctgagagccaagaacggctacaccgccttcgacctggtgatgctgctgaacgaccccgacaccgagctggtgagactgctggccagcgtgtgcatgcaggtgaacaaggacaagggcagacccagccaccagccccccctgccccacagcaaggtgagacagccctggagcatccccgtgctgcccgacgacaagggcggcctgaagagctggtggaacagaatgagcaacagattcagaaagctgaagctgatgcagaccctgcccagaggcctgagcagcaaccagcccctgcccttcagcgacgagcccgagcccgccctggacagcaccatgagagccgccccccaggacaagaccagcagaagcgccctgcccgacgccgcccccgtgaccaaggacaacggccccggcagcaccagaggcgagaaggaggacaccctgctgaccaccatgctgagaaacggcgcccccctgaccagactgcccagcgacaagctgaaggccgtgatcccccccttcctgccccccagcagcttcgagctgtggagcagcgacagaagcagaaccagacacaacggcaaggccgaccccatgaagaccgccctgccccagagagccagcagaggccaccccgtgggcggcggcggcaccgacaccacccccgtgagacccgtgaagttccccagcctgcccagaagccccgccagcagcgccaacagcggcaacttcaaccacagcccccacagcagcggcggcagcagcggcgtgggcgtgagcagacacggcggcgagctgctgaacagaagcggcggcagcatcgacaacgtgctgagccagatcgccgcccagagaaagaaggccgccggcctgctggagcagaagcccagccacagaagcagccccgtgggccccgcccccggcagcagccccagcgagctgcccgccagccccgccggcggcagcgcccccgtgggcaagcagaagctggagaccagcaagagaccccccagcggcaccagcaccaccagcaagagcaccagccccaccctgacccccagccccagccccaagggccacaccgccgagagcagcgtgagcagcagcagcagccacagacagagcaagagcagcggcggcagcagcagcggcaccatcaccgacgaggacgagctgaccggcatcctgaagaagctgagcctggagaagtaccagcccatcttcgaggagcaggaggtggacatggaggccttcctgaccctgaccgacggcgacctgaaggagctgggcatcaagaccgacggcagcagacagcagatcctggccgccatcagcgagctgaacgccggcaagggcagagagagacagatcctgcaggagaccatccacaacttccacagcagcttcgagagcagcgccagcaacaccagagcccccggcaacagcccctgcgcctag

SEQ ID NO: 10977 - DNA, 483 bp, Artificial Sequence
  Description of Artificial Sequence: Synthetic coding sequence
atggaggccgagagaccccaggaggaggaggacggcgagcagggccccccccaggacgaggagggctggcccccccccaacagcaccaccagaccctggagaagcgccccccccagcccccccccccccggcaccagacacaccgccctgggccccagaagcgccagcctgctgagcctgcagaccgagctgctgctggacctggtggccgaggcccagagcagaagactggaggagcagagagccaccttctacaccccccagaaccccagcagcctggcccccgcccccctgagacccctggaggacagagagcagctgtacagcaccatcctgagccaccagtgccagagaatggaggcccagagaagcgagccccccctgccccccggcggccaggagctgctggagctgctgctgagagtgcagggcggcggcagaatggaggagcagagaagcagaccccccacccacacctgctag

SEQ ID NO: 10978 - DNA, 483 bp, Artificial Sequence; identical to SEQ ID NO: 10977
  Description of Artificial Sequence: Synthetic coding sequence

SEQ ID NO: 10979 - DNA, 2790 bp, Artificial Sequence
  Description of Artificial Sequence: Synthetic coding sequence
atgcagggcctgcccgacccccccagccagagaggcatcatccccagagccttcgagcacgtgttcgagagcgtgcagtgcgccgagaacaccaagttcctggtgagagccagctacctggagatctacaacgaggacgtgagagacctgctgggcgccgacaccaagcagaagctggagctgaaggagcaccccgagaagggcgtgtacgtgaagggcctgagcatgcacaccgtgcacagcgtggcccagtgcgagcacatcatggagaccggctggaagaacagaagcgtgggctacaccctgatgaacaaggacagcagcagaagccacagcatcttcaccatcagcatcgagatgagcgccgtggacgagagaggcaaggaccacctgagagccggcaagctgaacctggtggacctggccggcagcgagagacagagcaagaccggcgccaccggcgagagactgaaggaggccaccaagatcaacctgagcctgagcgccctgggcaacgtgatcagcgccctggtggacggcagatgcaagcacgtgccctacagagacagcaagctgaccagactgctgcaggacagcctgggcggcaacaccaagaccctgatggtggcctgcctgagccccgccgacaacaactacgacgagaccctgagcaccctgagatacgccaacagagccaagaacatcagaaacaagcccagaatcaacgaggaccccaaggacgccctgctgagagagtaccaggaggagatcaagaagctgaaggccatcctgacccagcagatgagccccagcagcctgagcgccctgctgagcagacaggtgccccccgaccccgtgcaggtggaggagaagctgctgccccagcccgtgatccagcacgacgtggaggccgagaagcagctgatcagagaggagtacgaggagagactggccagactgaaggccgactacaaggccgagcaggagagcagagccagactggaggaggacatcaccgccatgagaaacagctacgacgtgagactgagcaccctggaggagaacctgagaaaggagaccgaggccgtgctgcaggtgggcgtgctgtacaaggccgaggtgatgagcagagccgagttcgccagcagcgccgagtacccccccgccttccagtacgagaccgtggtgaagcccaaggtgttcagcaccaccgacaccctgcccagcgacgacgtgagcaagacccaggtgagcagcagattcgccgagctgcccaaggtggagcccagcaagagcgagatcagcctgggcagcagcgagagcagcagcctggaggagaccagcgtgagcgaggccttccccggccccgaggagcccagcaacgtggaggtgagcatgcccaccgaggagagcagaagcagatacttcctggacgagtgcctgggccaggaggccgccggccacctgctgggcgagcagaactacctgccccaggaggagccccaggaggtgcccctgcagggcctgctgggcctgcaggaccccttcgccgaggtggaggccaagctggccagactgagcagcaccgtggccagaaccgacgccccccaggccgacgtgcccaaggtgcccgtgcaggtgcccgcccccaccgacctgctggagcccagcgacgccagacccgaggccgaggccgccgacgacttcccccccagacccgaggtggacctggccagcgaggtggccctggaggtggtgagaaccgccgagcccggcgtgtggctggaggcccaggcccccgtggccctggtggcccagcccgagcccctgcccgccaccgccggcgtgaagagagagagcgtgggcatggaggtggccgtgctgaccgacgaccccctgcccgtggtggaccagcagcaggtgctggccagactgcagctgctggagcagcaggtggtgggcggcgagcaggccaagaacaaggacctgaaggagaagcacaagagaagaaagagatacgccgacgagagaagaaagcagctggtggccgccctgcagaacagcgacgaggacagcggcgactgggtgctgctgaacgtgtacgacagcatccaggaggaggtgagagccaagagcaagctgctggagaagatgcagagaaagctgagagccgccgaggtggagatcaaggacctgcagagcgagttccagctggagaagatcgactacctggccaccatcagaagacaggagagagacagcatgctgctgcagcagctgctggagcaggtgcagcccctgatcagaagagactgcaactacagcaacctggagaagatcctgagagagagctgctgggacgaggacaacggcttctggaagatcccccaccccgtgatcaccaagaccagcctgcccgtggccgtgagcaccggcccccagaacaagcccgccagaaagaccagcgccgccgacaacggcgagcccaacatggaggacgacagatacagactgatgctgagcagaagcaacagcgagaacatcgccagcaactacttcagaagcaagagagccagccagatcctgagcaccgacgccagaaagagcctgacccaccacaacagcccccccggcctgagctgccccctgagcaacaacagcgccatcccccccacccaggcccccgagatgccccagcccagacccttcagactggagagcctggacatccccttcaccaaggccaagagaaagaagagcaagagcaacttcggcagcgagcccctgtag

SEQ ID NO: 10980 - DNA, 426 bp, Artificial Sequence
  Description of Artificial Sequence: Synthetic coding sequence
atgaacaagcacgtgctgaagatccagaaggagctggaggaggccaaggagaagctggccagacagcacaagagaagaagcgacgacgacgacagaagcagcgacagaaaggacggcgtgctggaggagcagatcgagagactgcaggagaaggtggagagcgcccagagcgagcagaagaacctgttcctggtgatcttccagagattcatcatgatcctgaccgagcacctggtgagatgcgagaccgacggcaccagcgtgctgaccccctggtacaagaactgcatcgagagactgcagcagatcttcctgcaggtgtgcggcgagctgagactgggcaacaacaccatcctgagccacaaggacttcagcctgaagaagatcctggtgaagttcgtgagaagactgtacagcacctgctag

SEQ ID NO: 10981 - DNA, 2373 bp, Artificial Sequence
  Description of Artificial Sequence: Synthetic coding sequence
atgagcagaagaagacacagcgacgagaacgacggcggccagccccacaagagaagaaagaccagcgacgccaacgagaccgaggaccacctggagagcctgatctgcaaggtgggcgagaagagcgcctgcagcctggagagcaacctggagggcctggccggcgtgctggaggccgacctgcccaactacaagagcaagatcctgagactgctgtgcaccgtggccagactgctgcccgagaagctgaccatctacaccaccctggtgggcctgctgaacgccagaaactacaacttcggcggcgagttcgtggaggccatgatcagacagctgaaggagagcctgaaggccaacaactacaacgaggccgtgtacctggtgagattcctgagcgacctggtgaactgccacgtgatcgccgcccccagcatggtggccatgttcgagaacttcgtgagcgtgacccaggaggaggacgtgccccaggtgagaagagactggtacgtgtacgccttcctgagcagcctgccctgggtgggcaaggagctgtacgagaagaaggacgccgagatggacagaatcttcgccaacaccgagagctacctgaagagaagacagaagacccacgtgcccatgctgcaggtgtggaccgccgacaagccccacccccaggaggagtacctggactgcctgtgggcccagatccagaagctgaagaaggacagatggcaggagagacacatcctgagaccctacctggccttcgacagcatcctgtgcgaggccctgcagcacaacctgccccccttcaccccccccccccacaccgaggacagcgtgtaccccatgcccagagtgatcttcagaatgttcgactacaccgacgaccccgagggccccgtgatgcccggcagccacagcgtggagagattcgtgatcgaggagaacctgcactgcatcatcaagagccactggaaggagagaaagacctgcgccgcccagctggtgagctaccccggcaagaacaagatccccctgaactaccacatcgtggaggtgatcttcgccgagctgttccagctgcccgcccccccccacatcgacgtgatgtacaccaccctgctgatcgagctgtgcaagctgcagcccggcagcctgccccaggtgctggcccaggccaccgagatgctgtacatgagactggacaccatgaacaccacctgcgtggacagattcatcaactggttcagccaccacctgagcaacttccagttcagatggagctgggaggactggagcgactgcctgagccaggaccccgagagccccaagcccaagttcgtgagagaggtgctggagaagtgcatgagactgagctaccaccagagaatcctggacatcgtgccccccaccttcagcgccctgtgccccgccaaccccacctgcatctacaagtacggcgacgagagcagcaacagcctgcccggccacagcgtggccctgtgcctggccgtggccttcaagagcaaggccaccaacgacgagatcttcagcatcctgaaggacgtgcccaaccccaaccaggacgacgacgacgacgagggcttcagcttcaaccccctgaagatcgaggtgttcgtgcagaccctgctgcacctggccgccaagagcttcagccacagcttcagcgccctggccaagttccacgaggtgttcaagaccctggccgagagcgacgagggcaagctgcacgtgctgagagtgatgttcgaggtgtggagaaaccacccccagatgatcgccgtgctggtggacaagatgatcagaacccagatcgtggactgcgccgccgtggccaactggatcttcagcagcgagctgagcagagacttcaccagactgttcgtgtgggagatcctgcacagcaccatcagaaagatgaacaagcacgtgctgaagatccagaaggagctggaggaggccaaggagaagctggccagacagcacaagagaagaagcgacgacgacgacagaagcagcgacagaaaggacggcgtgctggaggagcagatcgagagactgcaggagaaggtggagagcgcccagagcgagcagaagaacctgttcctggtgatcttccagagattcatcatgatcctgaccgagcacctggtgagatgcgagaccgacggcaccagcgtgctgaccccctggtacaagaactgcatcgagagactgcagcagatcttcctgcagcaccaccagatcatccagcagtacatggtgaccctggagaacctgctgttcaccgccgagctggacccccacatcctggccgtgttccagcagttctgcgccctgcaggcctag

SEQ ID NO: 10982 - DNA, 699 bp, Artificial Sequence
  Description of Artificial Sequence: Synthetic coding sequence
atgagccaggtgctgagcatcctgggcatgcacaccctgatgagcaaccagcagtactaccaggccctgagcagcagcagcatcatgaacaaggagggcctgaacagcgtgatcaagcccacccagtacaagcccgtgcccgacgaggagcccaacagcaccgacgtggaggagaccctggagagaatcaagaacaacgaccccaagctggaggaggtgaacctgaacaacatcagaaacatccccatccccaccctgaaggcctacgccgaggccctgaaggagaacagctacgtgaagaagttcagcatcgtgggcaccagaagcaacgaccccgtggcctacgccctggccgagatgctgaaggagaacaaggtgctgaagaccctgaacgtggagagcaacttcatcagcggcgccggcatcctgagactggtggaggccctgccctacaacaccagcctggtggagatgaagatcgacaaccagagccagcccctgggcaacaaggtggagatggagatcgtgagcatgctggagaagaacgccaccctgctgaagttcggctaccacttcacccagcagggccccagactgagagccagcaacgccatgatgaacaacaacgacctggtgagaaagagaagactggccgacctgaccggccccatcatccccaagtgcagaagcggcgtgtag

SEQ ID NO: 10983 - DNA, 2403 bp, Artificial Sequence
  Description of Artificial Sequence: Synthetic coding sequence
atgagcagcctgggcgccagcttcgtgcagatcaagttcgacgacctgcagttcttcgagaactgcggcggcggcagcttcggcagcgtgtacagagccaagtggatcagccaggacaaggaggtggccgtgaagaagctgctgaagatcgagaaggaggccgagatcctgagcgtgctgagccacagaaacatcatccagttctacggcgtgatcctggagccccccaactacggcatcgtgaccgagtacgccagcctgggcagcctgtacgactacatcaacagcaacagaagcgaggagatggacatggaccacatcatgacctgggccaccgacgtggccaagggcatgcactacctgcacatggaggcccccgtgaaggtgatccacagagacctgaagagcagaaacgtggtgatcgccgccgacggcgtgctgaagatctgcgacttcggcgccagcagattccacaaccacaccacccacatgagcctggtgggcaccttcccctggatggcccccgaggtgatccagagcctgcccgtgagcgagacctgcgacacctacagctacggcgtggtgctgtgggagatgctgaccagagaggtgcccttcaagggcctggagggcctgcaggtggcctggctggtggtggagaagaacgagagactgaccatccccagcagctgccccagaagcttcgccgagctgctgcaccagtgctgggaggccgacgccaagaagagacccagcttcaagcagatcatcagcatcctggagagcatgagcaacgacaccagcctgcccgacaagtgcaacagcttcctgcacaacaaggccgagtggagatgcgagatcgaggccaccctggagagactgaagaagctggagagagacctgagcttcaaggagcaggagctgaaggagagagagagaagactgaagatgtgggagcagaagctgaccgagcagagcaacacccccctgctgcccagcttcgagatcggcgcctggaccgaggacgacgtgtactgctgggtgcagcagctggtgagaaagggcgacagcagcgccgagatgagcgtgtacgccagcctgttcaaggagaacaacatcaccggcaagagactgctgctgctggaggaggaggacctgaaggacatgggcatcgtgagcaagggccacatcatccacttcaagagcgccatcgagaagctgacccacgactacatcaacctgttccacttcccccccctgatcaaggacagcggcggcgagcccgaggagaacgaggagaagatcgtgaacctggagctggtgttcggcttccacctgaagcccggcaccggcccccaggactgcaagtggaagatgtacatggagatggacggcgacgagatcgccatcacctacatcaaggacgtgaccttcaacaccaacctgcccgacgccgagatcctgaagatgaccaagccccccttcgtgatggagaagtggatcgtgggcatcgccaagagccagaccgtggagtgcaccgtgacctacgagagcgacgtgagaacccccaagagcaccaagcacgtgcacagcatccagtggagcagaaccaagccccaggacgaggtgaaggccgtgcagctggccatccagaccctgttcaccaacagcgacggcaaccccggcagcagaagcgacagcagcgccgactgccagtggctggacaccctgagaatgagacagatcgccagcaacaccagcctgcagagaagccagagcaaccccatcctgggcagccccttcttcagccacttcgacggccaggacagctacgccgccgccgtgagaagaccccaggtgcccatcaagtaccagcagatcacccccgtgaaccagagcagaagcagcagccccacccagtacggcctgaccaagaacttcagcagcctgcacctgaacagcagagacagcggcttcagcagcggcaacaccgacaccagcagcgagagaggcagatacagcgacagaagcagaaacaagtacggcagaggcagcatcagcctgaacagcagccccagaggcagatacagcggcaagagccagcacagcacccccagcagaggcagataccccggcaagttctacagagtgagccagagcgccctgaacccccaccagagccccgacttcaagagaagccccagagacctgcaccagcccaacaccatccccggcatgcccctgcaccccgagaccgacagcagagccagcgaggaggacagcaaggtgagcgagggcggctggaccaaggtggagtacagaaagaagccccacagacccagccccgccaagaccaacaaggagagagccagaggcgaccacagaggctggagaaacttctag

SEQ ID NO: 10984 - DNA, 1071 bp, Artificial Sequence
  Description of Artificial Sequence: Synthetic coding sequence
atgagaagattcctgagacccggccacgaccccgtgagagagagactgaagagagacctgttccagttcaacaagaccgtggagcacggcttcccccaccagcccagcgccctgggctacagccccagcctgagaatcctggccatcggcaccagaagcggcgccatcaagctgtacggcgcccccggcgtggagttcatgggcctgcaccaggagaacaacgccgtgacccagatccacctgctgcccggccagtgccagctggtgaccctgctggacgacaacagcctgcacctgtggagcctgaaggtgaagggcggcgccagcgagctgcaggaggacgagagcttcaccctgagaggcccccccggcgccgcccccagcgccacccagatcaccgtggtgctgccccacagcagctgcgagctgctgtacctgggcaccgagagcggcaacgtgttcgtggtgcagctgcccgccttcagagccctggaggacagaaccatcagcagcgacgccgtgctgcagagactgcccgaggaggccagacacagaagagtgttcgagatggtggaggccctgcaggagcaccccagagaccccaaccagatcctgatcggctacagcagaggcctggtggtgatctgggacctgcagggcagcagagtgctgtaccacttcctgagcagccagcagctggagaacatctggtggcagagagacggcagactgctggtgagctgccacagcgacggcagctactgccagtggcccgtgagcagcgaggcccagcagcccgagcccctgagaagcctggtgccctacggccccttcccctgcaaggccatcaccagaatcctgtggctgaccaccagacagggcctgcccttcaccatcttccagggcggcatgcccagagccagctacggcgacagacactgcatcagcgtgatccacgacggccagcagaccgccttcgacttcaccagcagagtgatcggcttcaccgtgctgaccgaggccgaccccgccgccagcagaagagccagcggcgtgggcgcccagggctag

SEQ ID NO: 10985 - DNA, 2526 bp, Artificial Sequence
  Description of Artificial Sequence: Synthetic coding sequence
atgggcgccagagccgccggcaccagcagcggcggcggccccagaccctgcctggccagaggcctgagcgccagccccttccccgccaagcagcagcacccccaggccggcgccagccccgccgagctgcagcagagagcctactacagagccagacaggacgccgccagccagcccggcctgggcttcctgatcagccccagcagctgcagcagctggggccccggcagcttcaccagaagctgcggctaccccaccctgtgcagcagctggatcagcaagagagagcccggcgagctgagcggcgtgtggaccagcgcctggagaacccacgccgccttcaccggcagccaggacctgtgcctgtacaagggcctgggcagcatctacgaggacaagaccgccctgagcctgctgggcctgggcgaggagaccaacgaggaggacgaggaggagagcgacaaccagagcgtgcacagcagcagcgagcccctgagaaacctgcacctggacatcggcgccctgggcggcgacttcgagtacgaggagagcctgagaaccagccagcccgaggagaagaaggacgtgagcctggacagcgacgccgccggcccccccaccccctgcaagcccagcagccccggcgccgacagcagcctgagcagcgccgtgggcaagggcagacagggcagcggcgccagacccggcctgcccgagaaggaggagaacgagaagagcgagcccaagatctgcagaaacctggtgacccccaaggccgaccccaccggcagcgagcccgccaaggccagcgagaaggaggcccccgaggacaccgtggacgccggcgaggagggcagcagaagagaggaggccgccaaggagcccaagaagaaggccagcgccctggaggagggcagcagcgacgccagccaggagctggagatcagcgagcacatgaaggagccccagctgagcgacagcatcgccagcgaccccaagagcttccacggcctggacttcggcttcagaagcagaatcagcgagcacctgctggacgtggacgtgctgagccccgtgctgggcggcgcctgcagacaggcccagcagcccctgggcatcgaggacaaggacgacagccagagcagccaggacgagctgcagagcaagcagagcaagggcctggaggagagataccacagactgagcccccccctgccccacgaggagagagcccagagcccccccagaagcctggccaccgaggaggagcccccccagggccccgagggccagcccgagtggaaggaggccgaggagctgggcgaggacagcgccgccagcctgagcctgcagctgagcctgcagagaagaagcaccgagcccgtggccccccccgagcagctgagcgaggccgccctgaaggccatggaggaggccgtggcccaggtgctggagcaggaccagagacacctgctggagagcaagcaggagaagatgcagcagctgagagagaagctgtgccaggaggaggaggaggagatcctgagactgcaccagcagaaggagcagagcctgagcagcctgagagagagactgcagaaggccatcgaggaggaggaggccagaatgagagaggaggagagccagagactgagctggctgagagcccaggtgcagagcagcacccaggccgacgaggaccagatcagagccgagcaggaggccagcctgcagaagctgagagaggagctggagagccagcagaaggccgagagagccagcctggagcagaagaacagacagatgctggagcagctgaaggaggagatcgaggccagcgagaagagcgagcaggccgccctgaacgccgccaaggagaaggccctgcagcagctgagagagcagctggagggcgagagaaaggaggccgtggccaccctggagaaggagcacagcgccgagctggagagactgtgcagcagcctggaggccaagcacagagaggtggtgagcagcctgcagaagaagatccaggaggcccagcagaaggaggaggcccagctgcagaagtgcctgggccaggtggagcacagagtgcaccagaagagctaccacgtggccggctacgagcacgagctgagcagcctgctgagagagaagagacaggaggtggagggcgagcacgagagaagactggacaagatgaaggaggagcaccagcaggtgatggccaaggccagagagcagtacgaggccgaggagagaaagcagagagccgagctgctgggccacctgaccggcgagctggagagactgcagagagcccacgagagagagctggagaccgtgagacaggagcagcacaagagactggaggacctgagaagaagacacagagagcaggagagaaagctgcaggacctggagctggacctggagaccagagccaaggacgtgaaggccagactggccctgctggaggtgcaggtgagagacctgcaggagagcctgaccagcgagagctag

SEQ ID NO: 10986 - DNA, 1053 bp, Artificial Sequence
  Description of Artificial Sequence: Synthetic coding sequence
atgatcagaggcttcgaggcccccatggccgagaaccccccccccccccccccccccgtgatcttctgccacgacagccccaagagagtgctggtgagcgtgatcagaaccacccccatcaagcccacctgcggcggcggcggcgagcccgagccccccccccccctgatccccaccagccccggcttcagcgacttcatggtgtacccctggagatggggcgagaacgcccacaacgtgaccctgagccccggcgccgccggcgccgccgccagcgccgccctgcccgccgccgccgccgccgagcacagcggcctgagaggcagaggcgcccccccccccgccgccagcgccagcgccgccgccagcggcggcgaggacgaggaggaggccagcagccccgacagcggccacctgaaggacggcatcagaagaggcagacccagagccgacaccgtgagagacctgatcaacgagggcgagcacagcagcagcagaatcagatgcaacatctgcaacagagtgttccccagagagaagagcctgcaggcccacaagagaacccacaccggcgagagaccctacctgtgcgactaccccgactgcggcaaggccttcgtgcagagcggccagctgaagacccaccagagactgcacaccggcgagaagcccttcgtgtgcagcgagaacggctgcctgagcagattcacccacgccaacagacactgccccaagcacccctacgccagactgaagagagaggagcccaccgacaccctgagcaagcaccaggccgccgacaacaaggccgccgccgagtggctggccagatactgggagatgagagagcagagaacccccaccctgaagggcaagctggtgcagaaggccgaccaggagcagcaggaccccctggagtacctgcagagcgacgaggaggacgacgagaagagaggcgcccagagaagactgcaggagcagagagagagactgcacggcgccctggccctgatcgagctggccaacctgaccggcgcccccctgagacagtag

SEQ ID NO: 10987 - DNA, 1137 bp, Artificial Sequence
  Description of Artificial Sequence: Synthetic coding sequence
atgaacatgatctggagaaacagcatcagctgcctgagactgggcaaggtgccccacagataccagagcggctaccaccccgtggcccccctgggcagcagaatcctgaccgaccccgccaaggtgttcgagcacaacatgtgggaccacatgcagtggagcaaggaggaggaggccgccgccagaaagaaggtgaaggagaacagcgccgtgagagtgctgctggaggagcaggtgaagtacgagagagaggccagcaagtactgggacaccttctacaagatccacaagaacaagttcttcaaggacagaaactggctgctgagagagttccccgagatcctgcccgtggaccagaagcccgaggagaaggccagagagagcagctgggaccacgtgaagaccagcgccaccaacagattcagcagaatgcactgccccaccgtgcccgacgagaagaaccactacgagaagagcagcggcagcagcgagggccagagcaagaccgagagcgacttcagcaacctggacagcgagaagcacaagaagggccccatggagaccggcctgttccccggcagcaacgccaccttcagaatcctggaggtgggctgcggcgccggcaacagcgtgttccccatcctgaacaccctggagaacagccccgagagcttcctgtactgctgcgacttcgccagcggcgccgtggagctggtgaagagccacagcagctacagagccacccagtgcttcgccttcgtgcacgacgtgtgcgacgacggcctgccctaccccttccccgacggcatcctggacgtgatcctgctggtgttcgtgctgagcagcatccaccccgacagaatgcagggcgtggtgaacagactgagcaagctgctgaagcccggcggcatgctgctgttcagagactacggcagatacgacaagacccagctgagattcaagaagggccactgcctgagcgagaacttctacgtgagaggcgacggcaccagagcctacttcttcaccaagggcgaggtgcacagcatgttctgcaaggccagcctggacgagaagcagaacctggtggacagaagactgcaggtgaacagaaagaagcaggtgaagatgcactag

SEQ ID NO: 10988 - DNA, 1797 bp, Artificial Sequence
  Description of Artificial Sequence: Synthetic coding sequence
atgggcctgagagccagcagacccagcaagctgacctggaagaagtgggccaccaccgccgccagcaacagctgcagcagaagcgtgagcagctgcagaagatgcaccggcggcagactgatgaaggagccctggagaagacccagcagcagcatctgctacaccagcagaagcagcaccatcaagttcagcagcaacaagttcaagaccctgagcgtgctgctgagccacctgcacctgttcagactgcacgtgaagatcagccagcccagcctgcccatcagcagcagaggcgccgccagcagcagccagttccagggcctgcccagcagaagcgccatcttccagcagcagcccgagaactgcagcagcccccccaacgtggccctgacctgcctgggcatgcagcagcccgcccagagccagcaggtgaccatccaggtgcaggagcccgtggacatgctgagcaacatgcccggcaccgccgccggcagcagcggcagaggcatcagcatcagccccagcgccggccagatgcagatgcagcacagaaccaacctgatggccaccctgagctacggccacagacccctgagcaagcagctgagcgccgacagcgccgaggcccacagcgcccaccagcagcccccccactacaccaccagcgccctgcagcaggccctgctgagccccaccccccccgactacaccagacaccagcaggtgccccacatcctgcagggcctgctgagccccagacacagcctgaccggccacagcgacatcagactgccccccaccgagttcgcccagctgatcaagagacagcagcagcagagacagcagcagcagcagcagcagcagcagcaggagtaccaggagctgttcagacacatgaaccagggcgacgccggcagcctggcccccagcctgggcggccagagcatgaccgagagacaggccctgagctaccagaacgccgacagctaccaccaccacaccagcccccagcacctgctgcagatcagagcccaggagtgcgtgagccaggccagcagccccacccccccccacggctacgcccaccagcccgccctgatgcacagcgagagcatggaggaggactgcagctgcgagggcgccaaggacggcttccaggacagcaagagcagcagcaccctgaccaagggctgccacgacagccccctgctgctgagcaccggcggccccggcgaccccgagagcctgctgggcaccgtgagccacgcccaggagctgggcatccacccctacggccaccagcccaccgccgccttcagcaagaacaaggtgcccagcagagagcccgtgatcggcaactgcatggacagaagcagccccggccaggccgtggagctgcccgaccacaacggcctgggctaccccgccagacccagcgtgcacgagcaccacagacccagagccctgcagagacaccacaccatccagaacagcgacgacgcctacgtgcagctggacaacctgcccggcatgagcctggtggccggcaaggccctgagcagcgccagaatgagcgacgccgtgctgagccagagcagcctgatgggcagccagcagttccaggacggcgagaacgaggagtgcggcgccagcctgggcggccacgagcaccccgacctgagcgacggcagccagcacctgaacagcagctgctaccccagcacctgcatcaccgacatcctgctgagctacaagcaccccgaggtgagcttcagcatggagcaggccggcgtgtag

SEQ ID NO: 10989 - DNA, 3966 bp, Artificial Sequence
  Description of Artificial Sequence: Synthetic coding sequence
atggccgccgccgccgccagcggcgccggcggcgccgccggcgccggcaccggcggcgccggccccgccggcagactgctgcccccccccgcccccggcagccccgccgcccccgccgccgtgagccccgccgccggccagcccagaccccccgcccccgccagcagaggccccatgcccgccagaatcggctactacgagatcgacagaaccatcggcaagggcaacttcgccgtggtgaagagagccacccacctggtgaccaaggccaaggtggccatcaagatcatcgacaagacccagctggacgaggagaacctgaagaagatcttcagagaggtgcagatcatgaagatgctgtgccacccccacatcatcagactgtaccaggtgatggagaccgagagaatgatctacctggtgaccgagtacgccagcggcggcgagatcttcgaccacctggtggcccacggcagaatggccgagaaggaggccagaagaaagttcaagcagatcgtgaccgccgtgtacttctgccactgcagaaacatcgtgcacagagacctgaaggccgagaacctgctgctggacgccaacctgaacatcaagatcgccgacttcggcttcagcaacctgttcacccccggccagctgctgaagacctggtgcggcagccccccctacgccgcccccgagctgttcgagggcaaggagtacgacggccccaaggtggacatctggagcctgggcgtggtgctgtacgtgctggtgtgcggcgccctgcccttcgacggcagcaccctgcagaacctgagagccagagtgctgagcggcaagttcagaatccccttcttcatgagcaccgagtgcgagcacctgatcagacacatgctggtgctggaccccaacaagagactgagcatggagcagatctgcaagcacaagtggatgaagctgggcgacgccgaccccaacttcgacagactgatcgccgagtgccagcagctgaaggaggagagacaggtggaccccctgaacgaggacgtgctgctggccatggaggacatgggcctggacaaggagcagaccctgcagagcctgagaagcgacgcctacgaccactacagcgccatctacagcctgctgtgcgacagacacaagagacacaagaccctgagactgggcgccctgcccagcatgcccagagccctggccttccaggcccccgtgaacatccaggccgagcaggccggcaccgccatgaacatcagcgtgccccaggtgcagctgatcaaccccgagaaccagatcgtggagcccgacggcaccctgaacctggacagcgacgagggcgaggagcccagccccgaggccctggtgagatacctgagcatgagaagacacaccgtgggcgtggccgaccccagaaccgaggtgatggaggacctgcagaagctgctgcccggcttccccggcgtgaacccccaggcccccttcctgcaggtggcccccaacgtgaacttcatgcacaacctgctgcccatgcagaacctgcagcccaccggccagctggagtacaaggagcagagcctgctgcagccccccaccctgcagctgctgaacggcatgggccccctgggcagaagagccagcgacggcggcgccaacatccagctgcacgcccagcagctgctgaagagacccagaggccccagccccctggtgaccatgacccccgccgtgcccgccgtgacccccgtggacgaggagagcagcgacggcgagcccgaccaggaggccgtgcagagcagcacctacaaggacagcaacaccctgcacctgcccaccgagagattcagccccgtgagaagattcagcgacggcgccgccagcatccaggccttcaaggcccacctggagaagatgggcaacaacagcagcatcaagcagctgcagcaggagtgcgagcagctgcagaagatgtacggcggccagatcgacgagagaaccctggagaagacccagcagcagcacatgctgtaccagcaggagcagcaccaccagatcctgcagcagcagatccaggacagcatctgccccccccagcccagcccccccctgcaggccgcctgcgagaaccagcccgccctgctgacccaccagctgcagagactgagaatccagcccagcagccccccccccaaccaccccaacaaccacctgttcagacagcccagcaacagccccccccccatgagcagcgccatgatccagccccacggcgccgccagcagcagccagttccagggcctgcccagcagaagcgccatcttccagcagcagcccgagaactgcagcagcccccccaacgtggccctgacctgcctgggcatgcagcagcccgcccagagccagcaggtgaccatccaggtgcaggagcccgtggacatgctgagcaacatgcccggcaccgccgccggcagcagcggcagaggcatcagcatcagccccagcgccggccagatgcagatgcagcacagaaccaacctgatggccaccctgagctacggccacagacccctgagcaagcagctgagcgccgacagcgccgaggcccacagcctgaacgtgaacagattcagccccgccaactacgaccaggcccacctgcacccccacctgttcagcgaccagagcagaggcagccccagcagctacagccccagcaccggcgtgggcttcagccccacccaggccctgaaggtgccccccctggaccagttccccaccttcccccccagcgcccaccagcagcccccccactacaccaccagcgccctgcagcaggccctgctgagccccaccccccccgactacaccagacaccagcaggtgccccacatcctgcagggcctgctgagccccagacacagcctgaccggccacagcgacatcagactgccccccaccgagttcgcccagctgatcaagagacagcagcagcagagacagcagcagcagcagcagcagcagcagcaggagtaccaggagctgttcagacacatgaaccagggcgacgccggcagcctggcccccagcctgggcggccagagcatgaccgagagacaggccctgagctaccagaacgccgacagctaccaccaccacaccagcccccagcacctgctgcagatcagagcccaggagtgcgtgagccaggccagcagccccacccccccccacggctacgcccaccagcccgccctgatgcacagcgagagcatggaggaggactgcagctgcgagggcgccaaggacggcttccaggacagcaagagcagcagcaccctgaccaagggctgccacgacagccccctgctgctgagcaccggcggccccggcgaccccgagagcctgctgggcaccgtgagccacgcccaggagctgggcatccacccctacggccaccagcccaccgccgccttcagcaagaacaaggtgcccagcagagagcccgtgatcggcaactgcatggacagaagcagccccggccaggccgtggagctgcccgaccacaacggcctgggctaccccgccagacccagcgtgcacgagcaccacagacccagagccctgcagagacaccacaccatccagaacagcgacgacgcctacgtgcagctggacaacctgcccggcatgagcctggtggccggcaaggccctgagcagcgccagaatgagcgacgccgtgctgagccagagcagcctgatgggcagccagcagttccaggacggcgagaacgaggagtgcggcgccagcctgggcggccacgagcaccccgacctgagcgacggcagccagcacctgaacagcagctgctaccccagcacctgcatcaccgacatcctgctgagctacaagcaccccgaggtgagcttcagcatggagcaggccggcgtgtag

SEQ ID NO: 10990 - DNA, 1569 bp, Artificial Sequence
  Description of Artificial Sequence: Synthetic coding sequence
atgcccagaaagaaggccgccgccgccgcctgggaggagcccagcagcggcaacggcaccgccagagccggccccagaaagagaggcggccccgccggcagaaagagagagagacccgagagatgcagcagcagcagcggcggcggcagcagcggcgacgaggacggcctggagctggacggcgcccccggcggcggcaagagagccgccagacccgccaccgccggcaaggccggcggcgccgccgtggtgatcaccgagcccgagcacaccaaggagagagtgaagctggagggcagcaagtgcaagggccagctgctgatcttcggcgccaccaactgggacctgatcggcagaaaggaggtgcccaagcagcaggccgcctacagaaacctgggccagaacctgtggggcccccacagatacggctgcctggccggcgtgagagtgagaaccgtggtgagcggcagctgcgccgcccacagcctgctgatcaccaccgagggcaagctgtggagctggggcagaaacgagaagggccagctgggccacggcgacaccaagagagtggaggcccccagactgatcgagggcctgagccacgaggtgatcgtgagcgccgcctgcggcagaaaccacaccctggccctgaccgagaccggcagcgtgttcgccttcggcgagaacaagatgggccagctgggcctgggcaaccagaccgacgccgtgcccagccccgcccagatcatgtacaacggccagcccatcaccaagatggcctgcggcgccgagttcagcatgatcatggactgcaagggcaacctgtacagcttcggctgccccgagtacggccagctgggccacaacagcgacggcaagttcatcgccagagcccagagaatcgagtacgactgcgagctggtgcccagaagagtggccatcttcatcgagaagaccaaggacggccagatcctgcccgtgcccaacgtggtggtgagagacgtggcctgcggcgccaaccacaccctggtgctggacagccagaagagagtgttcagctggggcttcggcggctacggcagactgggccacgccgagcagaaggacgagatggtgcccagactggtgaagctgttcgacttccccggcagaggcgccagccagatctacgccggctacacctgcagcttcgccgtgagcgaggtgggcggcctgttcttctggggcgccaccaacaccagcagagagagcaccatgtaccccaaggccgtgcaggacctgtgcggctggagaatcagaagcctggcctgcggcaagagcagcatcatcgtggccgccgacgagagcaccatcagctggggccccagccccaccttcggcgagctgggctacggcgaccacaagcccaagagcagcaccgccgcccaggaggtgaagaccctggacggcatcttcagcgagcaggtggccatgggctacagccacagcctggtgatcgccagagacgagagcgagaccgagaaggagaagatcaagaagctgcccgagtacaaccccagaaccctgtag

SEQ ID NO: 10991 - DNA, 1569 bp, Artificial Sequence; identical to SEQ ID NO: 10990
  Description of Artificial Sequence: Synthetic coding sequence

SEQ ID NO: 10992 - DNA, 552 bp, Artificial Sequence
  Description of Artificial Sequence: Synthetic coding sequence
atgaccgaccagacctactgcgacagactggtgcaggacacccccttcctgaccggccacggcagactgagcgagcagcaggtggacagaatcatcctgcagctgaacagatactacccccagatcctgaccaacaaggaggccgagaagttcagaaaccccaaggccagcctgagagtgagactgtgcgacctgctgagccacctgcagagaagcggcgagagagactgccaggagttctacagagccctgtacatccacgcccagcccctgcacagcagactgcccagcagacacgccctgcagaacagcgactgcaccgagctggacagcggcagccagagcggcgagctgagcaacagaggccccatgagcttcctggccggcctgggcctggccgtgggcctggccctgctgctgtactgctacccccccgaccccaagggcctgcccggcaccagaagagtgctgggcttcagccccgtgatcatcgacagacacgtgagcagatacctgctggccttcctggccgacgacctgggcggcctgtag

SEQ ID NO: 10993 - DNA, 492 bp, Artificial Sequence
  Description of Artificial Sequence: Synthetic coding sequence
atgctggacctgctggacatcgagggcctgtaccccctgtacaacagagtggagagatacctggaggagttccccgaggagagaaagaccctgcagatcgacggcccctacgacgaggccttctaccagaagctgctggacctgagcaccgaggacgacggcaccgtggccttcgccctgaccaaggtgcagcagtacagagtggccatgaccgccaaggactgcagcatcatgatcgccctgagcccctgcctgcaggacgccagcagcgaccagagacccgtggtgcccagcagcagaagcagattcgccttcagcgtgagcgtgctggacctggacctgaagccctacgagagcatcccccaccagtacaagctggacggcaagatcgtgaactactacagcaagaccgtgagagccaaggacaacgccgtgatgagcaccagattcaaggagagcgaggactgcaccctggtgctgcacaaggtgtag

SEQ ID NO: 10994 - DNA, 777 bp, Artificial Sequence
  Description of Artificial Sequence: Synthetic coding sequence
atggccagaccccccgtgcccggcagcgtggtggtgcccaactggcacgagagcgccgagggcaaggagtacctggcctgcatcctgagaaagaacagaagaagagtgttcggcctgctggagagacccgtgctgctgccccccgtgagcatcgacaccgccagctacaagatcttcgtgagcggcaagagcggcgtgggcaagaccgccctggtggccaagctggccggcctggaggtgcccgtggtgcaccacgagaccaccggcatccagaccaccgtggtgttctggcccgccaagctgcaggccagcagcagagtggtgatgttcagattcgagttctgggactgcggcgagagcgccctgaagaagttcgaccacatgctgctggcctgcatggagaacaccgacgccttcctgttcctgttcagcttcaccgacagagccagcttcgaggacctgcccggccagctggccagaatcgccggcgaggcccccggcgtggtgagaatggtgatcggcagcaagttcgaccagtacatgcacaccgacgtgcccgagagagacctgaccgccttcagacaggcctgggagctgcccctgctgagagtgaagagcgtgcccggcagaagactggccgacggcagaaccctggacggcagagccggcctggccgacgtggcccacatcctgaacggcctggccgagcagctgtggcaccaggaccaggtggccgccggcctgctgcccaacccccccgagagcgcccccgagtag

SEQ ID NO: 10995 - DNA, 333 bp, Artificial Sequence
  Description of Artificial Sequence: Synthetic coding sequence
atggccgacaaggtgctgaaggagaagagaaagcagttcatcagaagcgtgggcgagggcaccatcaacggcctgctgggcgagctgctggagaccagagtgctgagccaggaggagatcgagatcgtgaagtgcgagaacgccaccgtgatggacaaggccagagccctgctggacagcgtgatcagaaagggcgcccccgcctgccagatctgcatcacctacatctgcgaggaggacagccacctggccggcaccctgggcctgagcgccggccccaccagcggcaaccacctgaccacccaggacagccagatcgtgctgcccagctag

SEQ ID NO: 10996 - DNA, 924 bp, Artificial Sequence
  Description of Artificial Sequence: Synthetic coding sequence
atggagcccagcagcctggagctgcccgccgacaccgtgcagagaatcgccgccgagctgaagtgccaccccaccgacgagagagtggccctgcacctggacgaggaggacaagctgagacacttcagagagtgcttctacatccccaagatccaggacctgccccccgtggacctgagcctggtgaacaaggacgagaacgccatctacttcctgggcaacagcctgggcctgcagcccaagatggtgaagacctacctggaggaggagctggacaagtgggccaagatcgccgcctacggccacgaggtgggcaagagaccctggatcaccggcgacgagagcatcgtgggcctgatgaaggacatcgtgggcgccaacgagaaggagatcgccctgatgaacgccctgaccgtgaacctgcacctgctgatgctgagcttcttcaagcccacccccaagagatacaagatcctgctggaggccaaggccttccccagcgaccactacgccatcgagagccagctgcagctgcacggcctgaacatcgaggagagcatgagaatgatcaagcccagagagggcgaggagaccctgagaatcgaggacatcctggaggtgatcgagaaggagggcgacagcatcgccgtgatcctgttcagcggcgtgcacttctacaccggccagcacttcaacatccccgccatcaccaaggccggccaggccaagggctgctacgtgggcttcgacctggcccacgccgtgggcaacgtggagctgtacctgcacgactggggcgtggacttcgcctgctggtgcagctacaagtacctgaacgccggcgccggcggcatcgccggcgccttcatccacgagaagcacgcccacaccatcaagcccgccagaagcgagttcttcaactag

SEQ ID NO: 10997 - DNA, 3060 bp, Artificial Sequence
  Description of Artificial Sequence: Synthetic coding sequence
atggagcccggcgaggtgaaggacagaatcctggagaacatcagcctgagcgtgaagaagctgcagagctacttcgccgcctgcgaggacgagatccccgccatcagaaaccacgacaaggtgctgcagagactgtgcgagcacctggaccacgccctgctgtacggcctgcaggacctgagcagcggctactgggtgctggtggtgcacttcaccagaagagaggccatcaagcagatcgaggtgctgcagcacgtggccaccaacctgggcagaagcagagcctggctgtacctggccctgaacgagaacagcctggagagctacctgagactgttccaggagaacctgggcctgctgcacaagtactacgtgaagaacgccctggtgtgcagccacgaccacctgaccctgttcctgaccctggtgagcggcctggagttcatcagattcgagctggacctggacgccccctacctggacctggccccctacatgcccgactactacaagccccagtacctgctggacttcgaggacagactgcccagcagcgtgcacggcagcgacagcctgagcctgaacagcttcaacagcgtgaccagcaccaacctggagtgggacgacagcgccatcgcccccagcagcgaggactacgacttcggcgacgtgttccccgccgtgcccagcgtgcccagcaccgactgggaggacggcgacctgaccgacaccgtgagcggccccagaagcaccgccagcgacctgaccagcagcaaggccagcaccagaagccccacccagagacagaaccccttcaacgaggagcccgccgagaccgtgagcagcagcgacaccacccccgtgcacaccaccagccaggagaaggaggaggcccaggccctggacccccccgacgcctgcaccgagctggaggtgatcagagtgaccaagaagaagaagatcggcaagaagaagaagagcagaagcgacgaggaggccagccccctgcaccccgcctgcagccagaagaagtgcgccaagcagggcgacggcgacagcagaaacggcagccccagcctgggcagagacagccccgacaccatgctggccagcccccaggaggagggcgagggccccagcagcaccaccgagagcagcgagagaagcgagcccggcctgctgatccccgagatgaaggacaccagcatggagagactgggccagcccctgagcaaggtgatcgaccagctgaacggccagctggaccccagcacctggtgcagcagagccgagccccccgaccagagcttcagaaccggcagccccggcgacgcccccgagagaccccccctgtgcgacttcagcgagggcctgagcgcccccatggacttctacagattcaccgtggagagccccagcaccgtgaccagcggcggcggccaccacgaccccgccggcctgggccagcccctgcacgtgcccagcagccccgaggccgccggccaggaggaggagggcggcggcggcgagggccagacccccagacccctggaggacaccaccagagaggcccaggagctggaggcccagctgagcctggtgagagagggccccgtgagcgagcccgagcccggcacccaggaggtgctgtgccagctgaagagagaccagcccagcccctgcctgagcagcgccgaggacagcggcgtggacgagggccagggcagccccagcgagatggtgcacagcagcgagttcagagtggacaacaaccacctgctgctgctgatgatccacgtgttcagagagaacgaggagcagctgttcaagatgatcagaatgagcaccggccacatggagggcaacctgcagctgctgtacgtgctgctgaccgactgctacgtgtacctgctgagaaagggcgccaccgagaagccctacctggtggaggaggccgtgagctacaacgagctggactacgtgagcgtgggcctggaccagcagaccgtgaagctggtgtgcaccaacagaagaaagcagttcctgctggacaccgccgacgtggccctggccgagttcttcctggccagcctgaagagcgccatgatcaagggctgcagagagcccccctaccccagcatcctgaccgacgccaccatggagaagctggccctggccaagttcgtggcccaggagagcaagtgcgaggccagcgccgtgaccgtgagattctacggcctggtgcactgggaggaccccaccgacgagagcctgggccccaccccctgccactgcagcccccccgagggcaccatcaccaaggagggcatgctgcactacaaggccggcaccagctacctgggcaaggagcactggaagacctgcttcgtggtgctgagcaacggcatcctgtaccagtaccccgacagaaccgacgtgatccccctgctgagcgtgaacatgggcggcgagcagtgcggcggctgcagaagagccaacaccaccgacagaccccacgccttccaggtgatcctgagcgacagaccctgcctggagctgagcgccgagagcgaggccgagatggccgagtggatgcagcacctgtgccaggccgtgagcaagggcgtgatcccccagggcgtggcccccagcccctgcatcccctgctgcctggtgctgaccgacgacagactgttcacctgccacgaggactgccagaccagcttcttcagaagcctgggcaccgccaagctgggcgacatcagcgccgtgagcaccgagcccggcaaggagtactgcgtgctggagttcagccaggacagccagcagctgctgcccccctgggtgatctacctgagctgcaccagcgagctggacagactgctgagcgccctgaacagcggctggaagaccatctaccaggtggacctgccccacaccgccatccaggaggccagcaacaagaagaagttcgaggacgccctgagcctgatccacagcgcctggcagagaagcgacagcctgtgcagaggcagagccagcagagacccctggtgctag

SEQ ID NO: 10998 - DNA, 318 bp, Artificial Sequence
  Description of Artificial Sequence: Synthetic coding sequence
atgaagcccttcgaggacgccctgaagaaccagcccctgggccccgtgctgagcaaggccgccagcgtggagtgcatcagccccgtgagccccagagcccccgacgccaagatgctggaggagctgcaggccgagacctggtaccagggcgagatgagcagaaaggaggccgagggcctgctggagaaggacggcgacttcctggtgagaaagagcaccaccaaccccggcagcttcgtgctgaccggcatgcacaacggccaggccaagcacctgctgctggtggaccccgagggcaccagaagcaacagctactag

SEQ ID NO: 10999 - DNA, 318 bp, Artificial Sequence; identical to SEQ ID NO: 10998
  Description of Artificial Sequence: Synthetic coding sequence

SEQ ID NO: 11000 - DNA, 1785 bp, Artificial Sequence
  Description of Artificial Sequence: Synthetic coding sequence
atgctgcccagaaccaagtacaacagattcagaaacgacagcgtgaccagcgtggacgacctgctgcacagcctgagcgtgagcggcggcggcggcaaggtgagcgccgccagagccacccccgccgccgccccctacctggtgagcggcgaggccctgagaaaggcccccgacgacggccccggcagcctgggccacctgctgcacaaggtgagccacctgaagctgagcagcagcggcctgagaggcctgagcagcgccgccagagagagagccggcgccagactgagcggcagctgcagcgcccccagcctggccgcccccgacggcagcgcccccagcgcccccagagcccccgccatgagcgccgccagaaagggcagacccggcgacgagcccctgcccagaccccccagaggcgccccccacgccagcgaccaggtgctgggccccggcgtgacctacgtggtgaagtacctgggctgcatcgaggtgctgagaagcatgagaagcctggacttcagcaccagaacccagatcaccagagaggccatcagcagagtgtgcgaggccgtgcccggcgccaagggcgccttcaagaagagaaagccccccagcaagatgctgagcagcatcctgggcaagagcaacctgcagttcgccggcatgagcatcagcctgaccatcagcaccgccagcctgaacctgagaacccccgacagcaagcagatcatcgccaaccaccacatgagaagcatcagcttcgccagcggcggcgaccccgacaccaccgactacgtggcctacgtggccaaggaccccgtgaacagaagagcctgccacatcctggagtgctgcgacggcctggcccaggacgtgatcggcagcatcggccaggccttcgagctgagattcaagcagtacctgcagtgccccaccaagatccccgccctgcacgacagaatgcagagcctggacgagccctggaccgaggaggagggcgacggcagcgaccacccctactacaacagcatccccagcaagatgcccccccccggcggcttcctggacaccagactgaagcccagaccccacgcccccgacaccgcccagttcgccggcaaggagcagacctactaccagggcagacacctgggcgacaccttcggcgaggactggcagcagacccccctgagacagggcagcagcgacatctacagcacccccgagggcaagctgcacgtggcccccaccggcgaggcccccacctacgtgaacacccagcagatccccccccaggcctggcccgccgccgtgagcagcgccgagagcagccccagaaaggacctgttcgacatgaagcccttcgaggacgccctgaagaaccagcccctgggccccgtgctgagcaaggccgccagcgtggagtgcatcagccccgtgagccccagagcccccgacgccaagatgctggaggagctgcaggccgagacctggtaccagggcgagatgagcagaaaggaggccgagggcctgctggagaaggacggcgacttcctggtgagaaagagcaccaccaaccccggcagcttcgtgctgaccggcatgcacaacggccaggccaagcacctgctgctggtggaccccgagggcaccatcagaaccaaggacagagtgttcgacagcatcagccacctgatcaaccaccacctggagagcagcctgcccatcgtgagcgccggcagcgagctgtgcctgcagcagcccgtggagagaaagcagtag

SEQ ID NO: 11001 - DNA, 693 bp, Artificial Sequence
  Description of Artificial Sequence: Synthetic coding sequence
atgaacaccctgatggacgtgctgagacacagacccggctgggtggaggtgaaggacgagggcgagtgggacttctactggtgcgacgtgagctggctgagagagaacttcgaccacacctacatggacgagcacgtgagaatcagccacttcagaaaccactacgagctgaccagaaagaactacatggtgaagaacctgaagagattcagaaagcagctggagagagaggccggcaagctggaggccgccaagtgcgacttcttccccaagaccttcgagatgccctgcgagtaccacctgttcgtggaggagttcagaaagaaccccggcatcacctggatcatgaagcccgacaccagaagcagcgacgaccagaaggacgacatccccgtggagaactacgtggcccagagatacatcgagaacccctacctgatcggcggcagaaagttcgacctgagagtgtacgtgctggtgatgagctacatccccctgagagcctggctgtacagagacggcttcgccagattcagcaacaccagattcaccctgaacagcatcgacgaccagtacgtgcacctgaccaacgtggccgtgcagaagaccagccccgactaccaccccaagaaggtggcccccggcggccagtgcgtgcccatcaccgacagccagcagcccggcagactgtag

SEQ ID NO: 11002 - DNA, 1068 bp, Artificial Sequence
  Description of Artificial Sequence: Synthetic coding sequence
atgaacaccctgatggacgtgctgagacacagacccggctgggtggaggtgaaggacgagggcgagtgggacttctactggtgcgacgtgagctggctgagagagaacttcgaccacacctacatggacgagcacgtgagaatcagccacttcagaaaccactacgagctgaccagaaagaactacatggtgaagaacctgaagagattcagaaagcagctggagagagaggccggcaagctggaggccgccaagtgcgacttcttccccaagaccttcgagatgccctgcgagtaccacctgttcgtggaggagttcagaaagaaccccggcatcacctggatcatgaagcccgacaccagaagcagcgacgaccagaaggacgacatccccgtggagaactacgtggcccagagatacatcgagaacccctacctgatcggcggcagaaagttcgacctgagagtgtacgtgctggtgatgagctacatccccctgagagcctggctgtacagagacggcttcgccagattcagcaacaccagattcaccctgaacagcatcgacgaccagtacgtgcacctgaccaacgtggccgtgcagaagaccagccccgactaccaccccaagaagggctgcaagtggaccctgcagagattcagacagtacctggccagcaagcacggccccgaggccgtggagaccctgttcagagacatcgacaacatcttcgtgaagagcctgcagagcgtgcagaaggtgatcatcagcgacaagcactgcttcgagctgtacggctacgacatcctgatcgaccaggacctgaagccctggctgctggaggtgaacgccagccccagcctgaccgccagcagccaggaggactacgagctgaagacctgcctgctggaggacaccctgcacgtggtggacatggaggccagactgagacagagaagcgaggagaccaccgaggccgccctgctgctgcccagcagcagcgaggagagcttccagctgatccccagctgccaggaggagatcagcctgagcagaccctgcgtgtag

SEQ ID NO: 11003 - DNA, 840 bp, Artificial Sequence
  Description of Artificial Sequence: Synthetic coding sequence
atgagcagacccaagaaccagaactacaagggccacggcctgagcaagggcaaggagagagagcagagagccagcatcagattcaagaccaccctgatgaacaccctgatggacgtgctgagacacagacccggctgggtggaggtgaaggacgagggcgagtgggacttctactggtgcgacgtgagctggctgagagagaacttcgaccacacctacatggacgagcacgtgagaatcagccacttcagaaaccactacgagctgaccagaaagaactacatggtgaagaacctgaagagattcagaaagcagctggagagagaggccggcaagctggaggccgccaagtgcgacttcttccccaagaccttcgagatgccctgcgagtaccacctgttcgtggaggagttcagaaagaaccccggcatcacctggatcatgaagcccgtggccagaagccagggcaagggcatcttcctgttcagaagactgaaggacatcgtggactggagaaaggacaccagaagcagcgacgaccagaaggacgacatccccgtggagaactacgtggcccagagatacatcgagaacccctacctgatcggcggcagaaagttcgacctgagagtgtacgtgctggtgatgagcatgttcaccagccccacctggctgtgcaagaagcacctgcccaccaccacccagagaagagccgccagcggcagatgcagcgccagcggcagcacctggagacccaacaccggccccagacagtggagacacagcagcggcaccagcaccaccagcctgagcaaggcctgcagagtgtgcagaagatag

SEQ ID NO: 11004 - DNA, 1116 bp, Artificial Sequence
  Description of Artificial Sequence: Synthetic coding sequence
atgagcagacccaagaaccagaactacaagggccacggcctgagcaagggcaaggagagagagcagagagccagcatcagattcaagaccaccctgatgaacaccctgatggacgtgctgagacacagacccggctgggtggaggtgaaggacgagggcgagtgggacttctactggtgcgacgtgagctggctgagagagaacctggagagagaggccggcaagctggaggccgccaagtgcgacttcttccccaagaccttcgagatgccctgcgagtaccacctgttcgtggaggagttcagaaagaaccccggcatcacctggatcatgaagcccgtggccagaagccagggcaagggcatcttcctgttcagaagactgaaggacatcgtggactggagaaaggacaccagaagcagcgacgaccagaaggacgacatccccgtggagaactacgtggcccagagatacatcgagaacccctacctgatcggcggcagaaagttcgacctgagagtgtacgtgctggtgatgagctacatccccctgagagcctggctgtacagagacggcttcgccagattcagcaacaccagattcaccctgaacagcatcgacgaccagtacgtgcacctgaccaacgtggccgtgcagaagaccagccccgactaccaccccaagaagctgcaccccaccgtgggccccctgtgcatccacagccccgagaacggcagcctgagcgtgaccccctggccctgggacgcccacatgggctgcaagtggaccctgcagagattcagacagtacctggccagcaagcacggccccgaggccgtggagaccctgttcagagacatcgacaacatcttcgtgaagagcctgcagagcgtgcagaaggtgatcatcagcgacaagcactgcttcgagctgtacggctacgacatcctgatcgaccaggacctgaagccctggctgctggaggtgaacgccagccccagcctgaccgccagcagccaggaggactacgagctgaagacctgcctgctggaggacaccctgcacgtggtggacatggaggccagcttcagccccatcatccccgccgaggtgtag

SEQ ID NO: 11005 - DNA, 1320 bp, Artificial Sequence
  Description of Artificial Sequence: Synthetic coding sequence
atggtgcccagcagagaggccctgctgggccccggcaccaccgccatcagatgccccaagaagctgcagaaccagaactacaagggccacggcctgagcaagggcaaggagagagagcagagagccagcatcagattcaagaccaccctgatgaacaccctgatggacgtgctgagacacagacccggctgggtggaggtgaaggacgagggcgagtgggacttctactggtgcgacgtgagctggctgagagagaacttcgaccacacctacatggacgagcacgtgagaatcagccacttcagaaaccactacgagctgaccagaaagaactacatggtgaagaacctgaagagattcagaaagcagctggagagagaggccggcaagctggaggccgccaagtgcgacttcttccccaagaccttcgagatgccctgcgagtaccacctgttcgtggaggagttcagaaagaaccccggcatcacctggatcatgaagcccgtggccagaagccagggcaagggcatcttcctgttcagaagactgaaggacatcgtggactggagaaaggacaccagaagcagcgacgaccagaaggacgacatccccgtggagaactacgtggcccagagatacatcgagaacccctacctgatcggcggcagaaagttcgacctgagagtgtacgtgctggtgatgagcgtgttcgccgagtgcctgctgtggagcggccacagaagacaggacgtgcacctgaccaacgtggccgtgcagaagaccagccccgactaccaccccaagaagggctgcaagtggaccctgcagagattcagacagtacctggccagcaagcacggccccgaggccgtggagaccctgttcagagacatcgacaacatcttcgtgaagagcctgcagagcgtgcagaaggtgatcatcagcgacaagcactgcttcgagctgtacggctacgacatcctgatcgaccaggacctgaagccctggctgctggaggtgaacgccagccccagcctgaccgccagcagccaggaggactacgagctgaagacctgcctgctggaggacaccctgcacgtggtggacatggaggccagactgaccggcagagagaagagagtgggcggcttcgacctgatgtggaacgacggccccgtgagcagagaggagggcgcccccgacctgagcggcatgggcaacttcgtgaccaacacccacctgggctgcgtgaacgacagaaagaagcagctgagacagctgttctgcagcctgcaggtgcagaagaaggccagcagctag

SEQ ID NO: 11006 - DNA, 501 bp, Artificial Sequence
  Description of Artificial Sequence: Synthetic coding sequence
atgaaggagatgctggccaaggacctggaggagagccagggcggcaagagcagcgaggtgctgagcgccaccgagctgagagtgcagctggcccagaaggagcaggagctggccagagccaaggaggccctgcaggccatgaaggccgacagaaagagactgaagggcgagaagaccgacctggtgagccagatgcagcagctgtacgccaccctggagagcagagaggagcagctgagagacttcatcagaaactacgagcagcacagaaaggagagcgaggacgccgtgaaggccctggccaaggagaaggacctgctggagagagagaagtgggagctgagaagacaggccaaggaggccaccgaccacgccaccgccctgagaagccagctggacctgaaggacaacagaatgaaggagctggaggccgagctggccatggccaagcagagcctggccaccctgaccaaggacgtgcccaagagacacagcctgtag

SEQ ID NO: 11007 - DNA, 2328 bp, Artificial Sequence
  Description of Artificial Sequence: Synthetic coding sequence
atgatggaggacaacaagcagctggccctgagaatcgacggcgccgtgcagagcgccagccaggaggtgaccaacctgagagccgagctgaccgccaccaacagaagactggccgagctgagcggcggcggcggccccggccccggccccggcgccgccgccagcgccagcgccgccggcgacagcgccgccaccaacatggagaacccccagctgggcgcccaggtgctgctgagagaggaggtgagcagactgcaggaggaggtgcacctgctgagacagatgaaggagatgctggccaaggacctggaggagagccagggcggcaagagcagcgaggtgctgagcgccaccgagctgagagtgcagctggcccagaaggagcaggagctggccagagccaaggaggccctgcaggccatgaaggccgacagaaagagactgaagggcgagaagaccgacctggtgagccagatgcagcagctgtacgccaccctggagagcagagaggagcagctgagagacttcatcagaaactacgagcagcacagaaaggagagcgaggacgccgtgaaggccctggccaaggagaaggacctgctggagagagagaagtgggagctgagaagacaggccaaggaggccaccgaccacgccaccgccctgagaagccagctggacctgaaggacaacagaatgaaggagctggaggccgagctggccatggccaagcagagcctggccaccctgaccaaggacgtgcccaagagacacagcctggccatgcccggcgagaccgtgctgaacggcaaccaggagtgggtggtgcaggccgacctgcccctgaccgccgccatcagacagagccagcagaccctgtaccacagccaccccccccaccccgccgacagacaggccgtgagagtgagcccctgccacagcagacagcccagcgtgatcagcgacgccagcgccgccgagggcgacagaagcagcacccccagcgacatcaacagccccagacacagaacccacagcctgtgcaacggcgacagccccggccccgtgcagaagaacctgcacaaccccatcgtgcagagcctggaggacctggaggaccagaagagaaagaagaagaaggagaagatgggcttcggcagcatcagcagagtgttcgccagaggcaagcagagaaagagcctggaccccggcctgttcgacgacagcgacagccagtgcagccccaccagacagagcctgagcctgagcgagggcgaggagcagatggacagactgcagcaggtggagctggtgagaaccacccccatgagccactggaaggccggcaccgtgcaggcctggctggaggtggtgatggccatgcccatgtacgtgaaggcctgcaccgagaacgtgaagagcggcaaggtgctgctgagcctgagcgacgaggacctgcagctgggcctgggcgtgtgcagcagcctgcacagaagaaagctgagactggccatcgaggactacagagacgccgaggccggcagaagcctgagcaaggccgccgagctggaccaccactgggtggccaaggcctggctgaacgacatcggcctgagccagtacagccaggccttccagaaccacctggtggacggcagaatgctgaacagcctgatgaagagagacctggagaagcacctgaacgtgagcaagaagttccaccaggtgagcatcctgctgggcatcgagctgctgtaccaggtgaacttcagcagagaggccctgcaggagagaagagccagatgcgagacccagaacatcgaccccgtggtgtggaccaaccagagagtgctgaagtgggtgagagacatcgacctgaaggagtacgccgacaacctgaccaacagcggcgtgcacggcgccgtgctggtgctggagcccaccttcaacgccgaggccatggccaccgccctgggcatccccagcggcaagcacatcctgagaagacacctggccgaggagatgagcgccgtgttccaccccgccaacagcaccggcatcagagaggccgagagattcggcaccccccccggcagagccagcagcgtgaccagagccggcaaggaggagaacagcagcggcctgaagtacaaggccggcagactgcccctgggcaagatcggcagaggcttcagcagcaaggaccccgacttccacgacgactacggcagcctgcagaacgaggactgcggcgacgacgacccccagagcagactggagcagtgcagactggagggctacaacagcctggaggtgaccaacgtgtag

SEQ ID NO: 11008 - DNA, 861 bp, Artificial Sequence
  Description of Artificial Sequence: Synthetic coding sequence
atgtacagcctggacagaatcttcgccggcttcagaaccagaagccagatgctgctgggccacatcgaggagcaggacaaggtgctgcactgccagttcagcgacaacagcgacgacgaggagagcgagggccaggagaagagcggcaccagatgcagaagcagaagctggatccagaagcccgacagcgtgtgcagcctggtggagctgagcgacacccaggacgagacccagaagagcgacctggagaacgaggacctgaagatcgactgcctgcaggagagccaggagctgaacctgcagaagctgaagaacagcgagagaatcctgaccgaggccaagcagaagatgagagagctgaccatcaacatcaagatgaaggaggacctgatcaaggagctgatcaagaccggcaacgacgccaagagcgtgagcaagcagtacagcctgaaggtgaccaagctggagcacgacgccgagcaggccaaggtggagctgatcgagacccagaagcagctgcaggagctggagaacaaggacctgagcgacgtggccatgaaggtgaagctgcagaaggagttcagaaagaagatggacgccgccaagctgagagtgcaggtgctgcagaagaagcagcaggacagcaagaagctggccagcctgagcatccagaacgagaagagagccaacgagctggagcagagcgtggaccacatgaagtaccagaagatccagctgcagagaaagctgagagaggagaacgagaagagaaagcagctggacgccgtgatcaagagagaccagcagaagatcaaggtgatcctgagctacatccccgccaagtacaacatgaagtgctag

SEQ ID NO: 11009 - DNA, 1662 bp, Artificial Sequence
  Description of Artificial Sequence: Synthetic coding sequence
atgaacaagaacaccagcaccgtggtgagccccagcctgctggagaaggaccccgccttccagatgatcaccatcgccaaggagaccggcctgggcctgaaggtgctgggcggcatcaacagaaacgagggccccctggtgtacatccaggagatcatccccggcggcgactgctacaaggacggcagactgaagcccggcgaccagctggtgagcgtgaacaaggagagcatgatcggcgtgagcttcgaggaggccaagagcatcatcaccggcgccaagctgagactggagagcgcctgggagatcgccttcatcagacagaagagcgacaacatccagcccgagaacctgagctgcaccagcctgatcgaggccagcggcgagtacggcccccaggccagcaccctgagcctgttcagcagcccccccgagatcctgatccccaagaccagcagcacccccaagaccaacaacgacatcctgagcagctgcgagatcaagaccggctacaacaagaccgtgcagatccccatcaccagcgagaacagcaccgtgggcctgagcaacaccgacgtggccagcgcctggaccgagaactacggcctgcaggagaagatcagcctgaaccccagcgtgagattcaaggccgagaagctggagatggccctgaactacctgggcatccagcccaccaaggagcagcaccaggccctgagacagcaggtgcaggccgacagcaagggcaccgtgagcttcggcgacttcgtgcaggtggccagaaacctgttctgcctgcagctggacgaggtgaacgtgggcgcccacgagatcagcaacatcctggacagccagctgctgccctgcgacagcagcgaggccgacgagatggagagactgaagtgcgagagagacgacgccctgaaggaggtgaacaccctgaaggagaagctgctggagagcgacaagcagagaaagcagctgaccgaggagctgcagaacgtgaagcaggaggccaaggccgtggtggaggagaccagagccctgagaagcagaatccacctggccgaggccgcccagagacaggcccacggcatggagatggactacgaggaggtgatcagactgctggaggccaagatcaccgagctgaaggcccagctggccgactacagcgaccagaacaaggagagcgtgcaggacctgaagaagagaatcatggtgctggactgccagctgagaaagagcgagatggccagaaagaccttcgaggccagcaccgagaagctgctgcacttcgtggaggccatccaggaggtgttcagcgacaacagcacccccctgagcaacctgagcgagagaagagccgtgctggccagccagaccagcctgacccccctgggcagaaacggcagaagcatccccgccaccctggccctggagagcaaggagctggtgaagagcgtgagagccctgctggacatggactgcctgccctacggctgggaggaggcctacaccgccgacggcatcaagtacttcatcaaccacgtgacccagaccaccagctggatccaccccgtgatgagcgtgctgaacctgagcagaagcgaggagaacgaggaggactgcagcagagagctgcccaaccagaagagctag

SEQ ID NO: 11010 - DNA, 564 bp, Artificial Sequence
  Description of Artificial Sequence: Synthetic coding sequence
atggccgcccccggcgccctgctggtgatgggcgtgagcggcagcggcaagagcaccgtgggcgccctgctggccagcgagctgggctggaagttctacgacgccgacgactaccaccccgaggagaacagaagaaagatgggcaagggcatccccctgaacgaccaggacagaatcccctggctgtgcaacctgcacgacatcctgctgagagacgtggccagcggccagagagtggtgctggcctgcagcgccctgaagaagacctacagagacatcctgacccagggcaaggacggcgtggccctgaagtgcgaggagagcggcaaggaggccaagcaggccgagatgcagctgctggtggtgcacctgagcggcagcttcgaggtgatcagcggcagactgctgaagagagagggccacttcatgccccccgagctgctgcagagccagttcgagaccctggagccccccgccgcccccgagaacttcatccagatcagcgtggacaagaacgtgagcgagatcatcgccaccatcatggagaccctgaagatgaagtag

SEQ ID NO: 11011 - DNA, 1134 bp, Artificial Sequence
  Description of Artificial Sequence: Synthetic coding sequence
atggccaccatccccgactggaagctgcagctgctggccagaagaagacaggaggaggccagcgtgagaggcagagagaaggccgagagagagagactgagccagatgcccgcctggaagagaggcctgctggagagaagaagagccaagctgggcctgagccccggcgagcccagccccgtgctgggcaccgtggaggccggcccccccgaccccgacgagagcgccgtgctgctggaggccatcggccccgtgcaccagaacagattcatcagacaggagagacagcagcagcagcagcagcagcagagaagcgaggagctgctggccgagagaaagcccggccccctggaggccagagagagaagacccagccccggcgagatgagagaccagagccccaagggcagagagagcagagaggagagactgagccccagagagaccagagagagaagactgggcatcggcggcgcccaggagctgagcctgagacccctggaggccagagactggagacagagccccggcgaggtgggcgacagaagcagcagactgagcgaggcctggaagtggagactgagccccggcgagacccccgagagaagcctgagactggccgagagcagagagcagagccccagaagaaaggaggtggagagcagactgagccccggcgagagcgcctaccagaagctgggcctgaccgaggcccacaagtggagacccgacagcagagagagccaggagcagagcctggtgcagctggaggccaccgagtggagactgagaagcggcgaggagagacaggactacagcgaggagtgcggcagaaaggaggagtggcccgtgcccggcgtggcccccaaggagaccgccgagctgagcgagaccctgaccagagaggcccagggcaacagcagcgccggcgtggaggccgccgagcagagacccgtggaggacggcgagagaggcatgaagcccaccgagggctggaagtggaccctgatcatgagcctggccggcaagggcaaccagcacctggtgacctgcttcccccaccccgtgagcggcggcagagccaactgccccatcagcaccctgatccagagcccctggtgcggctggggctag

SEQ ID NO: 11012 - DNA, 2223 bp, Artificial Sequence
  Description of Artificial Sequence: Synthetic coding sequence
atggaggccgacggcgacggcgaggagctggccagactgagaagcgtgttcgccgcctgcgacgccaacagaagcggcagactggagagagaggagttcagagccctgtgcaccgagctgagagtgagacccgccgacgccgaggccgtgttccagagactggacgccgacagagacggcgccatcaccttccaggagttcgccagaggcttcctgggcagcctgagaggcggcagaagaagagactggggccccctggaccccgcccccgccgtgagcgaggccggccccgagacccacgacagcgaggaggacgagggcgacgaggacgccgccgccgccctggccaccagctgcggccccgccagccccggcagagcctggcaggacttccaggccagactgggcgacgaggccaagttcatccccagagaggagcaggtgagcaccctgtaccagaacatcaacctggtggagcccagactgatccagccctacgagcacgtgatcaagaacttcatcagagagatcagactgcagagcaccgagatggagaacctggccatcgccgtgaagagagcccaggacaaggccgccatgcagctgagcgagctggaggaggagatggaccagagaatccaggccgccgagcacaagaccagaaaggacgagaagagaaaggccgaggaggccctgagcgacctgagaagacagtacgagaccgaggtgggcgacctgcaggtgaccatcaagaagctgagaaagctggaggagcagagcaagagagtgagccagaaggaggacgtggccgccctgaagaagcagatctacgacctgagcatggagaaccagaaggtgaagaaggacctgctggaggcccagaccaacatcgccttcctgcagagcgagctggacgccctgaagagcgactacgccgaccagagcctgaacaccgagagagacctggagatcatcagagcctacaccgaggacagaaacagcctggagagacagatcgagatcctgcagaccgccaacagaaagctgcacgacagcaacgacggcctgagaagcgccctggagaacagctacagcaagttcaacagaagcctgcacatcaacaacatcagccccggcaacaccatcagcagaagcagccccaagttcatcggccacagcccccagcccctgggctacgacagaagcagcagaagcagctacgtggacgaggactgcgacagcctggccctgtgcgaccccctgcagagaaccaactgcgaggtggacagcctgcccgagagctgcttcgacagcggcctgagcaccctgagagaccccaacgagtacgacagcgaggtggagtacaagcaccagagaggcttccagagaagccacggcgtgcaggagagcttcggcggcgacgccagcgacaccgacgtgcccgacatcagagacgaggagaccttcggcctggaggacgtggccagcgtgctggactggaagccccagggcagcgtgagcgagggcagcatcgtgagcagcagcagaaagcccatcagcgccctgagcccccagaccgacctggtggacgacaacgccaagagcttcagcagccagaaggcctacaagatcgtgctggccggcgacgccgccgtgggcaagagcagcttcctgatgagactgtgcaagaacgagttcagagagaacatcagcgccaccctgggcgtggacttccagatgaagaccctgatcgtggacggcgagagaaccgtgctgcagctgtgggacaccgccggccaggagagattcagaagcatcgccaagagctacttcagaaaggccgacggcgtgctgctgctgtacgacgtgacctgcgagaagagcttcctgaacatcagagagtgggtggacatgatcgaggacgccgcccacgagaccgtgcccatcatgctggtgggcaacaaggccgacatcagagacaccgccgccaccgagggccagaagtgcgtgcccggccacttcggcgagaagctggccatgacctacggcgccctgttctgcgagaccagcgccaaggacggcagcaacatcgtggaggccgtgctgcacctggccagagaggtgaagaagagaaccgacaaggacgacagcagaagcatcaccaacctgaccggcaccaacagcaagaagagcccccagatgaagaactgctgcaacggctag

SEQ ID NO: 11013 - DNA, 4125 bp, Artificial Sequence
  Description of Artificial Sequence: Synthetic coding sequence
atggaggagaacgagagccagaagtgcgagccctgcctgccctacagcgccgacagaagacagatgcaggagcagggcaagggcaacctgcacgtgaccagccccgaggacgccgagtgcagaagaaccaaggagagactgagcaacggcaacagcagaggcagcgtgagcaagagcagcagaaacatccccagaagacacaccctgggcggccccagaagcagcaaggagatcctgggcatgcagaccagcgagatggacagaaagagagaggccttcctggagcacctgaagcagaagtacccccaccacgccagcgccatcatgggccaccaggagagactgagagaccagaccagaagccccaagctgagccacagcccccagccccccagcctgggcgaccccgtggagcacctgagcgagaccagcgccgacagcctggaggccatgagcgagggcgacgcccccacccccttcagcagaggcagcagaaccagagccagcctgcccgtggtgagaagcaccaaccagaccaaggagagaagcctgggcgtgctgtacctgcagtacggcgacgagaccaagcagctgagaatgcccaacgagatcaccagcgccgacaccatcagagccctgttcgtgagcgccttcccccagcagctgaccatgaagatgctggagagccccagcgtggccatctacatcaaggacgagagcagaaacgtgtactacgagctgaacgacgtgagaaacatccaggacagaagcctgctgaaggtgtacaacaaggaccccgcccacgccttcaaccacacccccaagaccatgaacggcgacatgagaatgcagagagagctggtgtacgccagaggcgacggccccggcgcccccagacccggcagcaccgcccaccccccccacgccatccccaacagcccccccagcacccccgtgccccacagcatgccccccagccccagcagaatcccctacggcggcaccagaagcatggtggtgcccggcaacgccaccatccccagagacagaatcagcagcctgcccgtgagcagacccatcagccccagccccagcgccatcctggagagaagagacgtgaagcccgacgaggacatgagcggcaagaacatcgccatgtacagaaacgagggcttctacgccgacccctacctgtaccacgagggcagaatgagcatcgccagcagccacggcggccaccccctggacgtgcccgaccacatcatcgcctaccacagaaccgccatcagaagcgccagcgcctactgcaaccccagcatgcaggccgagatgcacatggagcagagcctgtacagacagaagagcagaaagtaccccgacagccacctgcccaccctgggcagcaagaccccccccgccagcccccacagagtgagcgacctgagaatgatcgacatgcacgcccactacaacgcccacggccccccccacaccatgcagcccgacagagccagccccagcagacaggccttcaagaaggagcccggcaccctggtgtacatcgagaagcccagaagcgccgccggcctgagcagcctggtggacctgggcccccccctgatggagaagcaggtgttcgcctacagcaccgccaccatccccaaggacagagagaccagcgagaagatgatgaagaccaccgccaacagaaaccacaccgacagcgccggcaccccccacgtgagcggcggcaagatgctgagcgccctggagagcaccgtgccccccagccagcccccccccgtgggcaccagcgccatccacatgagcctgctggagatgagaagaagcgtggccgagctgagactgcagctgcagcagatgagacagctgcagctgcagaaccaggagctgctgagagccatgatgaagaaggccgagctggagatcagcggcaaggtgatggagaccatgaagagactggaggaccccgtgcagagacagagagtgctggtggagcaggagagacagaagtacctgcacgaggaggagaagatcgtgaagaagctgtgcgagctggaggacttcgtggaggacctgaagaaggacagcaccgccgccagcagactggtgaccctgaaggacgtggaggacggcgccttcctgctgagacaggtgggcgaggccgtggccaccctgaagggcgagttccccaccctgcagaacaagatgagagccatcctgagaatcgaggtggaggccgtgagattcctgaaggaggagccccacaagctggacagcctgctgaagagagtgagaagcatgaccgacgtgctgaccatgctgagaagacacgtgaccgacggcctgctgaagggcaccgacgccgcccaggccgcccagtacatggccatggagaaggccaccgccgccgaggtgctgaagagccaggaggaggccgcccacaccagcggccagcccttccacagcaccggcgcccccggcgacgccaagagcgaggtggtgcccctgagcggcatgatggtgagacacgcccagagcagccccgtggtgatccagcccagccagcacagcgtggccctgctgaaccccgcccagaacctgccccacgtggccagcagccccgccgtgccccaggaggccaccagcaccctgcagatgagccaggccccccagagcccccagatccccatgaacggcagcgccatgcagagcctgttcatcgaggagatccacagcgtgagcgccaagaacagagccgtgagcatcgagaaggccgagaagaagtgggaggagaagagacagaacctggaccactacaacggcaaggagttcgagaagctgctggaggaggcccaggccaacatcatgaagagcatccccaacctggagatgccccccgccaccggccccctgcccagaggcgacgcccccgtggacaaggtggagctgagcgacagccccaacagcgagcaggacctggagaagctgggcggcaagagcccccccccccccccccccccccccagaagaagctacctgcccggcagcggcctgaccaccaccagaagcggcgacgtggtgtacaccggcagaaaggagaacatcaccgccaaggccagcagcgaggacgccggccccagcccccagaccagagccaccaagtaccccgccgaggagcccgccagcgcctggacccccagccccccccccgtgaccaccagcagcagcaaggacgaggaggaggaggaggaggagggcgacaagatcatggccgagctgcaggccttccagaagtgcagcttcatggacgtgaacagcaacagccacgccgagcccagcagagccgacagccacgtgaaggacaccagaagcggcgccaccgtgccccccaaggagaagaagaacctggagttcttccacgaggacgtgagaaagagcgacgtggagtacgagaacggcccccagatggagttccagaagggcagcagcggcgccccccagaccagcagaatgcccgtgcccatgagcgccaagaacagacccggcaccctggacaagcccggcaagcagagcaagctgcaggaccccagacagtacagacaggccaacggcagcgccaagaagagcggcggcgacttcaagcccaccagccccagcctgcccgccagcaagatccccgccctgagccccagcagcggcaagagcagcagcctgcccagcagcagcggcgacagcagcaacctgcccaacccccccgccaccaagcccagcatcgccagcaaccccctgagcccccagaccggcccccccgcccacagcgccagcctgatccccagcgtgagcaacggcagcctgaagttccagagcctgacccacaccggcaagggccaccacctgagcttcagcccccagagccagaacggcagagcccccccccccctgagcttcagcagcagcccccccagccccgccagcagcgtgagcctgaaccagggcgccaagggcaccagaaccatccacacccccagcctgaccagctacaaggcccagaacggcagcagcagcaaggccacccccagcaccgccaaggagaccagctag

SEQ ID NO: 11014 - DNA, 5832 bp, Artificial Sequence
  Description of Artificial Sequence: Synthetic coding sequence
atggaggagaacgagagccagaagtgcgagccctgcctgccctacagcgccgacagaagacagatgcaggagcagggcaagggcaacctgcacgtgaccagccccgaggacgccgagtgcagaagaaccaaggagagactgagcaacggcaacagcagaggcagcgtgagcaagagcagcagaaacatccccagaagacacaccctgggcggccccagaagcagcaaggagatcctgggcatgcagaccagcgagatggacagaaagagagaggccttcctggagcacctgaagcagaagtacccccaccacgccagcgccatcatgggccaccaggagagactgagagaccagaccagaagccccaagctgagccacagcccccagccccccagcctgggcgaccccgtggagcacctgagcgagaccagcgccgacagcctggaggccatgagcgagggcgacgcccccacccccttcagcagaggcagcagaaccagagccagcctgcccgtggtgagaagcaccaaccagaccaaggagagaagcctgggcgtgctgtacctgcagtacggcgacgagaccaagcagctgagaatgcccaacgagatcaccagcgccgacaccatcagagccctgttcgtgagcgccttcccccagcagctgaccatgaagatgctggagagccccagcgtggccatctacatcaaggacgagagcagaaacgtgtactacgagctgaacgacgtgagaaacatccaggacagaagcctgctgaaggtgtacaacaaggaccccgcccacgccttcaaccacacccccaagaccatgaacggcgacatgagaatgcagagagagctggtgtacgccagaggcgacggccccggcgcccccagacccggcagcaccgcccaccccccccacgccatccccaacagcccccccagcacccccgtgccccacagcatgccccccagccccagcagaatcccctacggcggcaccagaagcatggtggtgcccggcaacgccaccatccccagagacagaatcagcagcctgcccgtgagcagacccatcagccccagccccagcgccatcctggagagaagagacgtgaagcccgacgaggacatgagcggcaagaacatcgccatgtacagaaacgagggcttctacgccgacccctacctgtaccacgagggcagaatgagcatcgccagcagccacggcggccaccccctggacgtgcccgaccacatcatcgcctaccacagaaccgccatcagaagcgccagcgcctactgcaaccccagcatgcaggccgagatgcacatggagcagagcctgtacagacagaagagcagaaagtaccccgacagccacctgcccaccctgggcagcaagaccccccccgccagcccccacagagtgagcgacctgagaatgatcgacatgcacgcccactacaacgcccacggccccccccacaccatgcagcccgacagagccagccccagcagacaggccttcaagaaggagcccggcaccctggtgtacatcgagaagcccagaagcgccgccggcctgagcagcctggtggacctgggcccccccctgatggagaagcaggtgttcgcctacagcaccgccaccatccccaaggacagagagaccagagagagaatgcaggccatggagaagcagatcgccagcctgaccggcctggtgcagagcgccctgttcaagggccccatcaccagctacagcaaggacgccagcagcgagaagatgatgaagaccaccgccaacagaaaccacaccgacagcgccggcaccccccacgtgagcggcggcaagatgctgagcgccctggagagcaccgtgccccccagccagcccccccccgtgggcaccagcgccatccacatgagcctgctggagatgagaagaagcgtggccgagctgagactgcagctgcagcagatgagacagctgcagctgcagaaccaggagctgctgagagccatgatgaagaaggccgagctggagatcagcggcaaggtgatggagaccatgaagagactggaggaccccgtgcagagacagagagtgctggtggagcaggagagacagaagtacctgcacgaggaggagaagatcgtgaagaagctgtgcgagctggaggacttcgtggaggacctgaagaaggacagcaccgccgccagcagactggtgaccctgaaggacgtggaggacggcgccttcctgctgagacaggtgggcgaggccgtggccaccctgaagggcgagttccccaccctgcagaacaagatgagagccatcctgagaatcgaggtggaggccgtgagattcctgaaggaggagccccacaagctggacagcctgctgaagagagtgagaagcatgaccgacgtgctgaccatgctgagaagacacgtgaccgacggcctgctgaagggcaccgacgccgcccaggccgcccagtacatggccatggagaaggccaccgccgccgaggtgctgaagagccaggaggaggccgcccacaccagcggccagcccttccacagcaccggcgcccccggcgacgccaagagcgaggtggtgcccctgagcggcatgatggtgagacacgcccagagcagccccgtggtgatccagcccagccagcacagcgtggccctgctgaaccccgcccagaacctgccccacgtggccagcagccccgccgtgccccaggaggccaccagcaccctgcagatgagccaggccccccagagcccccagatccccatgaacggcagcgccatgcagagcctgttcatcgaggagatccacagcgtgagcgccaagaacagagccgtgagcatcgagaaggccgagaagaagtgggaggagaagagacagaacctggaccactacaacggcaaggagttcgagaagctgctggaggaggcccaggccaacatcatgaagagcatccccaacctggagatgccccccgccaccggccccctgcccagaggcgacgcccccgtggacaaggtggagctgagcgaggacagccccaacagcgagcaggacctggagaagctgggcggcaagagcccccccccccccccccccccccccagaagaagctacctgcccggcagcggcctgaccaccaccagaagcggcgacgtggtgtacaccggcagaaaggagaacatcaccgccaaggccagcagcgaggacgccggccccagcccccagaccagagccaccaagtaccccgccgaggagcccgccagcgcctggacccccagccccccccccgtgaccaccagcagcagcaaggacgaggaggaggaggaggaggagggcgacaagatcatggccgagctgcaggccttccagaagtgcagcttcatggacgtgaacagcaacagccacgccgagcccagcagagccgacagccacgtgaaggacaccagaagcggcgccaccgtgccccccaaggagaagaagaacctggagttcttccacgaggacgtgagaaagagcgacgtggagtacgagaacggcccccagatggagttccagaaggtgaccaccggcgccgtgagacccagcgacccccccaagtgggagagaggcatggagaacagcatcagcgacgccagcagaaccagcgagtacaagaccgagatcatcatgaaggagaacagcatcagcaacatgagcctgctgagagacagcagaaactacagccaggagaccgtgcccaaggccagcttcggcttcagcggcatcagccccctggaggacgagatcaacaagggcagcaagatcagcggcctgcagtacagcatccccgacaccgagaaccagaccctgaactacggcaagaccaaggagatggagaagcagaacaccgacaagtgccacgtgagcagccacaccagactgaccgagagcagcgtgcacgacttcaagaccgaggaccaggaggtgatcaccaccgacttcggccaggtggtgctgagacccaaggaggccagacacgccaacgtgaaccccaacgaggacggcgagagcagcagcagcagccccaccgaggagaacgccgccaccgacaacatcgccttcatgatcaccgagaccaccgtgcaggtgctgagcagcggcgaggtgcacgacatcgtgagccagaagggcgaggacatccagaccgtgaacatcgacgccagaaaggagatgacccccagacaggagggcaccgacaacgaggaccccgtggtgtgcctggacaagaagcccgtgatcatcatcttcgacgagcccatggacatcagaagcgcctacaagagactgagcaccatcttcgaggagtgcgacgaggagctggagagaatgatgatggaggagaagatcgaggaggaggaggaggaggagaacggcgacagcgtggtgcagaacaacaacaccagccagatgagccacaagaaggtggcccccggcaacctgagaaccggccagcaggtggagaccaagagccagccccacagcctggccaccgagaccagaaaccccggcggccaggagatgaacagaaccgagctgaacaagttcagccacgtggacagccccaacagcgagtgcaagggcgaggacgccaccgacgaccagttcgagagccccaagaagaagttcaagttcaagttccccaagaagcagctggccgccctgacccaggccatcagaaccggcaccaagaccggcaagaagaccctgcaggtggtggtgtacgaggaggaggaggaggacggcaccctgaagcagcacaaggaggccaagagattcgagatcgccagaagccagcccgaggacacccccgagaacaccgtgagaagacaggagcagcccagcatcgagagcaccagccccatcagcagaaccgacgagatcagaaagaacacctacagaaccctggacagcctggagcagaccatcaagcagctggagaacaccatcagcgagatgagccccaaggccctggtggacaccagctgcagcagcaacagagacagcgtggccagcagcagccacatcgcccaggaggccagccccagacccctgctggtgcccgacgagggccccaccgccctggagccccccaccagcatccccagcgccagcagaaagggcagcagcggcgccccccagaccagcagaatgcccgtgcccatgagcgccaagaacagacccggcaccctggacaagcccggcaagcagagcaagctgcaggaccccagacagtacagacaggccaacggcagcgccaagaagagcggcggcgacttcaagcccaccagccccagcctgcccgccagcaagatccccgccctgagccccagcagcggcaagagcagcagcctgcccagcagcagcggcgacagcagcaacctgcccaacccccccgccaccaagcccagcatcgccagcaaccccctgagcccccagaccggcccccccgcccacagcgccagcctgatccccagcgtgagcaacggcagcctgaagttccagagcctgacccacaccggcaagggccaccacctgagcttcagcccccagagccagaacggcagagcccccccccccctgagcttcagcagcagcccccccagccccgccagcagcgtgagcctgaaccagggcgccaagggcaccagaaccatccacacccccagcctgaccagctacaaggcccagaacggcagcagcagcaaggccacccccagcaccgccaaggagaccagctag

SEQ ID NO: 11015 - DNA, 3795 bp, Artificial Sequence
  Description of Artificial Sequence: Synthetic coding sequence
atgcagaccagcgagatggacagaaagagagaggccttcctggagcacctgaagcagaagtacccccaccacgccagcgccatcatgggccaccaggagagactgagagaccagaccagaagccccaagctgagccacagcccccagccccccagcctgggcgaccccgtggagcacctgagcgagaccagcgccgacagcctggaggccatgagcgagggcgacgcccccacccccttcagcagaggcagcagaaccagagccagcctgcccgtggtgagaagcaccaaccagaccaaggagagaagcctgggcgtgctgtacctgcagtacggcgacgagaccaagcagctgagaatgcccaacgagatcaccagcgccgacaccatcagagccctgttcgtgagcgccttcccccagcagctgaccatgaagatgctggagagccccagcgtggccatctacatcaaggacgagagcagaaacgtgtactacgagctgaacgacgtgagaaacatccaggacagaagcctgctgaaggtgtacaacaaggaccccgcccacgccttcaaccacacccccaagaccatgaacggcgacatgagaatgcagagagagctggtgtacgccagaggcgacggccccggcgcccccagacccggcagcaccgcccaccccccccacgccatccccaacagcccccccagcacccccgtgccccacagcatgccccccagccccagcagaatcccctacggcggcaccagaagcatggtggtgcccggcaacgccaccatccccagagacagaatcagcagcctgcccgtgagcagacccatcagccccagccccagcgccatcctggagagaagagacgtgaagcccgacgaggacatgagcggcaagaacatcgccatgtacagaaacgagggcttctacgccgacccctacctgtaccacgagggcagaatgagcatcgccagcagccacggcggccaccccctggacgtgcccgaccacatcatcgcctaccacagaaccgccatcagaagcgccagcgcctactgcaaccccagcatgcaggccgagatgcacatggagcagagcctgtacagacagaagagcagaaagtaccccgacagccacctgcccaccctgggcagcaagaccccccccgccagcccccacagagtgagcgacctgagaatgatcgacatgcacgcccactacaacgcccacggccccccccacaccatgcagcccgacagagccagccccagcagacaggccttcaagaaggagcccggcaccctggtgtacatcgagaagcccagaagcgccgccggcctgagcagcctggtggacctgggcccccccctgatggagaagcaggtgttcgcctacagcaccgccaccatccccaaggacagagagaccagagagagaatgcaggccatggagaagcagatcgccagcctgaccggcctggtgcagagcgccctgttcaagggccccatcaccagctacagcaaggacgccagcagcgagaagatgatgaagaccaccgccaacagaaaccacaccgacagcgccggcaccccccacgtgagcggcggcaagatgctgagcgccctggagagcaccgtgccccccagccagcccccccccgtgggcaccagcgccatccacatgagcctgctggagatgagaagaagcgtggccgagctgagactgcagctgcagcagatgagacagctgcagctgcagaaccaggagctgctgagagccatgatgaagaaggccgagctggagatcagcggcaaggtgatggagaccatgaagagactggaggaccccgtgcagagacagagagtgctggtggagcaggagagacagaagtacctgcacgaggaggagaagatcgtgaagaagctgtgcgagctggaggacttcgtggaggacctgaagaaggacagcaccgccgccagcagactggtgaccctgaaggacgtggaggacggcgccttcctgctgagacaggtgggcgaggccgtggccaccctgaagggcgagttccccaccctgcagaacaagatgagagccatcctgagaatcgaggtggaggccgtgagattcctgaaggaggagccccacaagctggacagcctgctgaagagagtgagaagcatgaccgacgtgctgaccatgctgagaagacacgtgaccgacggcctgctgaagggcaccgacgccgcccaggccgcccagtacatggccatggagaaggccaccgccgccgaggtgctgaagagccaggaggaggccgcccacaccagcggccagcccttccacagcaccggcgcccccggcgacgccaagagcgaggtggtgcccctgagcggcatgatggtgagacacgcccagagcagccccgtggtgatccagcccagccagcacagcgtggccctgctgaaccccgcccagaacctgccccacgtggccagcagccccgccgtgccccaggaggccaccagcaccctgcagatgagccaggccccccagagcccccagatccccatgaacggcagcgccatgcagagcctgttcatcgaggagatccacagcgtgagcgccaagaacagagccgtgagcatcgagaaggccgagaagaagtgggaggagaagagacagaacctggaccactacaacggcaaggagttcgagaagctgctggaggaggcccaggccaacatcatgaagagcatccccaacctggagatgccccccgccaccggccccctgcccagaggcgacgcccccgtggacaaggtggagctgagcgaggacagccccaacagcgagcaggacctggagaagctgggcggcaagagcccccccccccccccccccccccccagaagaagctacctgcccggcagcggcctgaccaccaccagaagcggcgacgtggtgtacaccggcagaaaggagaacatcaccgccaaggccagcagcgaggacgccggccccagcccccagaccagagccaccaagtaccccgccgaggagcccgccagcgcctggacccccagccccccccccgtgaccaccagcagcagcaaggacgaggaggaggaggaggaggagggcgacaagatcatggccgagctgcagggcagcagcggcgccccccagaccagcagaatgcccgtgcccatgagcgccaagaacagacccggcaccctggacaagcccggcaagcagagcaagctgcaggaccccagacagtacagacaggccaacggcagcgccaagaagagcggcggcgacttcaagcccaccagccccagcctgcccgccagcaagatccccgccctgagccccagcagcggcaagagcagcagcctgcccagcagcagcggcgacagcagcaacctgcccaacccccccgccaccaagcccagcatcgccagcaaccccctgagcccccagaccggcccccccgcccacagcgccagcctgatccccagcgtgagcaacggcagcctgaagttccagagcctgacccacaccggcaagggccaccacctgagcttcagcccccagagccagaacggcagagcccccccccccctgagcttcagcagcagcccccccagccccgccagcagcgtgagcctgaaccagggcgccaagggcaccagaaccatccacacccccagcctgaccagctacaaggcccagaacggcagcagcagcaaggccacccccagcaccgccaaggagaccagctag

SEQ ID NO: 11016 - DNA, 531 bp, Artificial Sequence
  Description of Artificial Sequence: Synthetic coding sequence
atgggctgctgcggctgcagcggcggctgcggcagcggctgcggcggctgcggcagcggcagcggcggctgcggcagcggctgcggcggctgcggcagcagctgctgcgtgcccatctgctgctgcaagcccgtgtgctgctgcgtgcccgcctgcagctgcagcagctgcggcagctgcggcggcagcaagggcggctgcggcagctgcggcagcagcaagggcggctgcggcagctgcggctgcagccagagcaactgctgcaagccctgctgcagcagcagcggctgcggcagcttctgctgccagagcagctgcagcaagccctgctgctgccagagcagctgctgccagagcagctgctgcaagccctgctgctgccagagcagctgctgccagagcagctgcttcaagccctgctgctgccagagcagctgctgcgtgcccgtgtgctgccagagcagctgctgcaagccctgctgcagccagagcagctgctgcgtgcccatctgctgccagtacaagatctag

SEQ ID NO: 11017 - DNA, 513 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctacggcagcggctgcggcggctgcggcagcagctgctgcgtgcccgtgtgctgctgcaagcccgtgtgctgctgcgtgcccgcctgcagctgcagcagctgcggcagctgcggcggcagcaagggcgactgcggctgcggcagctgcggcggcagcaagggcggctgcggcagctgcggctgcagccagtgcaactgctgcaagccctgctgctgcagcagcggctgcggcagctgctgccagagcagctgctgcaacccctgctgctgccagagcagctgctgcgtgcccgtgtgctgccagagcagctgctgcaagccctgctgctgccagagcagctgctgcgtgcccagcagctgctgcagaagctgctgcagcaagagcagctgctgcgtgcccatctgctgccagtacaagatctag

SEQ ID NO: 11018 - DNA, 2169 bp, Artificial Sequence
  Description of Artificial Sequence: Synthetic coding sequence
atgatcgacagcgtgaagctgagaagagacagcgccgccgacttcttcagccactacgagtacctgtgcgccctgcagaacagcgtgcccctgcccgccgtgagagcctgcctgagagagggcgtgctggacttcaacgccgacagactgagaggcgtggactgggcccccctgctgagcaccctgaagatcaacaaggacctgcccctggtgagcatcaagagcttcttccagccctggctgggcgacaccggcagcgacatgaacaagttctgcagaagcagagtgcccgccatcagatacaaggacgtgaccttccagctgtgcaaggccctgaagggctgcctgagcatcagcagcgtgctgaagaacctggagctgaacggcctgatcctgagagagagagacctgaccatcctggccaagggcctgaacaagagcgccagcctggtgcacctgagcctggccaactgccccatcggcgacggcggcctggagatcatctgccagggcatcaagagcagcatcaccctgaagaccgtgaacttcaccggctgcaacctgacctggcagggcgccgaccacatggccaagatcctgaagtaccagaccatgagaagacacgaggagacctgggccgagagcctgagatacagaagacccgacctggactgcatggccggcctgagaagaatcaccctgaactgcaacaccctgatcggcgacctgggcgcctgcgccttcgccgacagcctgagcgaggacctgtggctgagagccctggacctgcagcagtgcggcctgaccaacgagggcgccaaggccctgctggaggccctggagaccaacaccaccctggtggtgctggacatcagaaagaaccccctgatcgaccacagcatgatgaaggccgtgatcaagaaggtgctgcagaacggcagaagcgccaagagcgagtaccagtggatcaccagccccagcgtgaaggagcccagcaagaccgccaagcagaagagaagaaccatcatcctgggcagcggccacaagggcaaggccaccatcagaatcgtgggcctggccaccaagaagcccgtgagcagcggcagaaagcacagcctgggcaaggagtactacgcccccgcccccctgccccccggcgtgagcggcttcctgccctggagaaccgccgagagagccaagagacacagaggcttccccctgatcaagaccagagacatctgcaaccagctgcagcagcccggcttccccgtgaccgtgaccgtggagagccccagcagcagcgaggtggaggaggtggacgacagcagcgagagcgtgcacgaggtgcccgagaagaccagcatcgagcaggaggccctgcaggagaagctggaggagtgcctgaagcagctgaaggaggagagagtgatcagactgaaggtggacaagagagtgagcgagctggagcacgagaacgcccagctgagaaacatcaacttcagcctgagcgaggccctgcacgcccagagcctgaccaacatgatcctggacgacgagggcgtgctgggcagcatcgagaacagcttccagaagttccacgccttcctggacctgctgaaggacgccggcctgggccagctggccaccatggccggcatcgaccagagcgacttccagctgctgggccacccccagatgaccagcaccgtgagcaacccccccaaggaggagaagaaggccctggaggacgagaagcccgagcccaagcagaacgccctgggccagatgcagaacatccaggtgagcatctgcatgcagagcgcctacaacgagggcaccctgatgaagttccagaagatcaccggcgacgccagaatccccctgcccctggacagcttccccgtgcccgtgagcacccccgagggcctgggcaccagcagcaacaacctgggcgtgcccgccaccgagcagagacaggagagcttcgagggcttcatcgccagaatgtgcagccccagccccgacgccaccagcggcaccggcagccagagaaaggaggaggagctgagcagaaacagcagaagcagcagcgagaagaagaccaagaccggcgagtacaccaagaagcacagcgacaagcagcaccccggcaaggacctgcacagctag

SEQ ID NO: 11019 - DNA, 1122 bp, Artificial Sequence
  Description of Artificial Sequence: Synthetic coding sequence
atggccctgaacgtggcccccgtgagagacaccaagtggctgaccctggaggtgtgcagacagttccagagaggcacctgcagcagaagcgacgaggagtgcaagttcgcccacccccccaagagctgccaggtggagaacggcagagtgatcgcctgcttcgacagcctgaagggcagatgcagcagagagaactgcaagtacctgcacccccccacccacctgaagacccagctggagatcaacggcagaaacaacctgatccagcagaagaccgccgccgccatgctggcccagcagatgcagttcatgttccccggcacccccctgcaccccgtgcccaccttccccgtgggccccgccatcggcaccaacaccgccatcagcttcgccccctacctggcccccgtgacccccggcgtgggcctggtgcccaccgagatcctgcccaccacccccgtgatcgtgcccggcagcccccccgtgaccgtgcccggcagcaccgccacccagaagctgctgagaaccgacaagctggaggtgtgcagagagttccagagaggcaactgcgccagaggcgagaccgactgcagattcgcccaccccgccgacagcaccatgatcgacaccagcgacaacaccgtgaccgtgtgcatggactacatcaagggcagatgcatgagagagaagtgcaagtacttccacccccccgcccacctgcaggccaagatcaaggccgcccagcaccaggccaaccaggccgccgtggccgcccaggccgccgccgccgccgccaccgtgatggccttcccccccggcgccctgcaccccctgcccaagagacaggccctggagaagagcaacggcaccagcgccgtgttcaaccccagcgtgctgcactaccagcaggccctgaccagcgcccagctgcagcagcacgccgccttcatccccaccggcagcgtgctgtgcatgacccccgccaccagcatcgacaacagcgagatcatcagcagaaacggcatggagtgccaggagagcgccctgagaatcaccaagcactgctactgcacctactaccccgtgagcagcagcatcgagctgccccagaccgcctgctag

SEQ ID NO: 11020 - DNA, 321 bp, Artificial Sequence
  Description of Artificial Sequence: Synthetic coding sequence
atgacccagagcaccgccaaggccatgaagagacccctggaggccaccgtggacctggccttcccccccggcgccctgcaccccctgcccaagagacaggccctggagaagagcaacggcaccagcgccgtgttcaaccccagcgtgctgcactaccagcaggccctgaccagcgcccagctgcagcagcacgccgccttcatccccaccgtgcccatgatgcacagcgccaccagcgccaccgtgagcgccgccaccacccccgccaccagcgtgcccttcgccgccaccgccaccgccaaccagctggtgtacagctag

SEQ ID NO: 11021 - DNA, 915 bp, Artificial Sequence
  Description of Artificial Sequence: Synthetic coding sequence
atggccaagatcgagaagaacgcccccaccatggagaagaagcccgagctgttcaacatcatggaggtggacggcgtgcccaccctgatcctgagcaaggagtggtgggagaaggtgtgcaacttccaggccaagcccgacgacctgatcctggccacctaccccaagagcggcaccacctggatgcacgagatcctggacatgatcctgaacgacggcgacgtggagaagtgcaagagagcccagaccctggacagacacgccttcctggagctgaagttcccccacaaggagaagcccgacctggagttcgtgctggagatgagcagcccccagctgatcaagacccacctgcccagccacctgatcccccccagcatctggaaggagaactgcaagatcgtgtacgtggccagaaaccccaaggactgcctggtgagctactaccacttccacagaatggccagcttcatgcccgacccccagaacctggaggagttctacgagaagttcatgagcggcaaggtggtgggcggcagctggttcgaccacgtgaagggctggtgggccgccaaggacatgcacagaatcctgtacctgttctacgaggacatcaagaagaaccccaagcacgagatccacaaggtgctggagttcctggagaagacctggagcggcgacgtgatcaacaagatcgtgcaccacaccagcttcgacgtgatgaaggacaaccccatggccaaccacaccgccgtgcccgcccacatcttcaaccacagcatcagcaagttcatgagaaagggcatgcccggcgactggaagaaccacttcaccgtggccctgaacgagaacttcgacaagcactacgagaagaagatggccggcagcaccctgaacttctgcctggagatctag

SEQ ID NO: 11022 - DNA, 1188 bp, Artificial Sequence
  Description of Artificial Sequence: Synthetic coding sequence
atggccagcgccgccagcgtgaccagcctggccgacgaggtgaactgccccatctgccagggcaccctgagagagcccgtgaccatcgactgcggccacaacttctgcagagcctgcctgaccagatactgcgagatccccggccccgacctggaggagagccccacctgccccctgtgcaaggagcccttcagacccggcagcttcagacccaactggcagctggccaacgtggtggagaacatcgagagactgcagctggtgagcaccctgggcctgggcgaggaggacgtgtgccaggagcacggcgagaagatctacttcttctgcgaggacgacgagatgcagctgtgcgtggtgtgcagagaggccggcgagcacgccacccacaccatgagattcctggaggacgccgccgccccctacagagagcagatccacaagtgcctgaagtgcctgagaaaggagagagaggagatccaggagatccagagcagagagaacaagagaatgcaggtgctgctgacccaggtgagcaccaagagacagcaggtgatcagcgagttcgcccacctgagaaagttcctggaggagcagcagagcatcctgctggcccagctggagagccaggacggcgacatcctgagacagagagacgagttcgacctgctggtggccggcgagatctgcagattcagcgccctgatcgaggagctggaggagaagaacgagagacccgccagagagctgctgaccgacatcagaagcaccctgatcagatgcgagaccagaaagtgcagaaagcccgtggccgtgagccccgagctgggccagagaatcagagacttcccccagcaggccctgcccctgcagagagagatgaagatgttcctggagaagctgtgcttcgagctggactacgagcccgcccacatcagcctggacccccagaccagccaccccaagctgctgctgagcgaggaccaccagagagcccagttcagctacaagtggcagaacagccccgacaacccccagagattcgacagagccacctgcgtgctggcccacaccggcatcaccggcggcagacacacctgggtgtggatggccagagtgcccggcgacagcggctgctgccagttctgcagcccccccagcgtgctgggcaccgaggtggccgcctag

SEQ ID NO: 11023 - DNA, 1446 bp, Artificial Sequence
  Description of Artificial Sequence: Synthetic coding sequence
atggccagcgccgccagcgtgaccagcctggccgacgaggtgaactgccccatctgccagggcaccctgagagagcccgtgaccatcgactgcggccacaacttctgcagagcctgcctgaccagatactgcgagatccccggccccgacctggaggagagccccacctgccccctgtgcaaggagcccttcagacccggcagcttcagacccaactggcagctggccaacgtggtggagaacatcgagagactgcagctggtgagcaccctgggcctgggcgaggaggacgtgtgccaggagcacggcgagaagatctacttcttctgcgaggacgacgagatgcagctgtgcgtggtgtgcagagaggccggcgagcacgccacccacaccatgagattcctggaggacgccgccgccccctacagagagcagatccacaagtgcctgaagtgcctgagaaaggagagagaggagatccaggagatccagagcagagagaacaagagaatgcaggtgctgctgacccaggtgagcaccaagagacagcaggtgatcagcgagttcgcccacctgagaaagttcctggaggagcagcagagcatcctgctggcccagctggagagccaggacggcgacatcctgagacagagagacgagttcgacctgctggtggccggcgagatctgcagattcagcgccctgatcgaggagctggaggagaagaacgagagacccgccagagagctgctgaccgacatcagaagcaccctgatcagatgcgagaccagaaagtgcagaaagcccgtggccgtgagccccgagctgggccagagaatcagagacttcccccagcaggccctgcccctgcagagagagatgaagatgttcctggagaacctgcccaaccacctggtgatccccaccgcccacatcagcctggacccccagaccagccaccccaagctgctgctgagcgaggaccaccagagagcccagttcagctacaagtggcagaacagccccgacaacccccagagattcgacagagccacctgcgtgctggcccacaccggcatcaccggcggcagacacacctgggtggtgagcatcgacctggcccacggcggcagctgcaccgtgggcgtggtgagcgaggacgtgcagagaaagggcgagctgagactgagacccgaggagggcgtgtgggccgtgagactggcctggggcttcgtgagcgccctgggcagcttccccaccagactgaccctgaaggagcagcccagacaggtgagagtgagcctggactacgaggtgggctgggtgaccttcaccaacgccgtgaccagagagcccatctacaccttcaccgccagcttcaccagaaaggtgatccccttcttcggcctgtggggcagaggcagcagcttcagcctgagcagctag

SEQ ID NO: 11024 - DNA, 2604 bp, Artificial Sequence; identical to SEQ ID NO: 10319
  Description of Artificial Sequence: Synthetic coding sequence

SEQ ID NO: 11025 - DNA, 279 bp, Artificial Sequence
  Description of Artificial Sequence: Synthetic coding sequence
atggccaccccccccaagagaagagccgtggaggccaccggcgagaaggtgctgagatacgagaccttcatcagcgacgtgctgcagagagacctgagaaaggtgctggaccacagagacaaggtgtacgagcagctggccaagtacctgcagctgagaaacgtgatcgagagactgcaggtgaagaccatgggcctgggcaccatcttcctggtgtgcgtgggcaagggcggcaagtgggaggagagactgcagacccagccctgccacctgacctag

SEQ ID NO: 11026 - DNA, 2532 bp, Artificial Sequence
  Description of Artificial Sequence: Synthetic coding sequence
atggccgtggaggacagcaccctgcaggtggtggtgagagtgagaccccccacccccagagagctggacagccagagaagacccgtggtgcaggtggtggacgagagagtgctggtgttcaaccccgaggagcccgacggcggcttccccggcctgaagtggggcggcacccacgacggccccaagaagaagggcaaggacctgaccttcgtgttcgacagagtgttcggcgaggccgccacccagcaggacgtgttccagcacaccacccacagcgtgctggacagcttcctgcagggctacaactgcagcgtgttcgcctacggcgccaccggcgccggcaagacccacaccatgctgggcagagagggcgaccccggcatcatgtacctgaccaccgtggagctgtacagaagactggaggccagacagcaggagaagcacttcgaggtgctgatcagctaccaggaggtgtacaacgagcagatccacgacctgctggagcccaagggccccctggccatcagagaggaccccgacaagggcgtggtggtgcagggcctgagcttccaccagcccgccagcgccgagcagctgctggagatcctgaccagaggcaacagaaacagaacccagcaccccaccgacgccaacgccaccagcagcagaagccacgccatcttccagatcttcgtgaagcagcaggacagagtgcccggcctgacccaggccgtgcaggtggccaagatgagcctgatcgacctggccggcagcgagagagccagcagcacccacgccaagggcgagagactgagagagggcgccaacatcaacagaagcctgctggccctgatcaacgtgctgaacgccctggccgacgccaagggcagaaagacccacgtgccctacagagacagcaagctgaccagactgctgaaggacagcctgggcggcaactgcagaaccgtgatgatcgccgccatcagccccagcagcctgacctacgaggacacctacaacaccctgaagtacgccgacagagccaaggagatcagactgagcctgaagagcaacgtgaccagcctggactgccacatcagccagtacgccaccatctgccagcagctgcaggccgaggtggccgccctgagaaagaagctgcaggtgtacgagggcggcggccagccccccccccaggacctgcccggcagccccaagagcggccccccccccgagcacctgcccagcagccccctgcccccccacccccccagccagccctgcacccccgagctgcccgccggccccagagccctgcaggaggagagcctgggcatggaggcccaggtggagagagccatggagggcaacagcagcgaccaggagcagagccccgaggacgaggacgagggccccgccgaggaggtgcccacccagatgcccgagcagaaccccacccacgccctgcccgagagccccagactgaccctgcagcccaagcccgtggtgggccacttcagcgccagagagctggacggcgacagaagcaagcagctggccctgaaggtgctgtgcgtggcccagagacagtacagcctgctgcaggccgccaacctgctgacccccgacatgatcaccgagttcgagaccctgcagcagctggtgcaggaggagaagatcgagcccggcgccgaggccctgagaaccagcggcctggccagaggcgcccccctggcccaggagctgtgcagcgagagcatccccgtgcccagccccctgtgccccgagccccccggctacaccggccccgtgaccagaaccatggccagaagactgagcggccccctgcacaccctgggcatcccccccggccccaactgcacccccgcccagggcagcagatggcccatggagaagaagagaagaagacccagcgccctggaggccgacagccccatggcccccaagagaggcaccaagagacagagacagagcttcctgccctgcctgagaagaggcagcctgcccgacacccagcccagccagggccccagcacccccaagggcgagagagccagcagcccctgccacagccccagagtgtgccccgccaccgtgatcaagagcagagtgcccctgggccccagcgccatgcagaactgcagcacccccctggccctgcccaccagagacctgaacgccaccttcgacctgagcgaggagccccccagcaagcccagcttccacgagtgcatcggctgggacaagatcccccaggagctgagcagactggaccagcccttcatccccagagcccccgtgcccctgttcaccatgaagggccccaagcccaccagcagcctgcccggcaccagcgcctgcaagaagaagagagtggccagcagcagcgtgagccacggcagaagcagaatcgccagactgcccagcagcaccctgaagagacccggccccctgtacagccaggtgaccggcaccagagacagagacagcctgggccacggcggcagatag

SEQ ID NO: 11027 - DNA, 561 bp, Artificial Sequence
  Description of Artificial Sequence: Synthetic coding sequence
atggagccccccagaggcccccccgccaacggcgccgagcccagcagagccgtgggcaccgtgaaggtgtacctgcccaacaagcagagaaccgtggtgaccgtgagagacggcatgagcgtgtacgacagcctggacaaggccctgaaggtgagaggcctgaaccaggactgctgcgtggtgtacagactgatcaagggcagaaagaccgtgaccgcctgggacaccgccatcgcccccctggacggcgaggagctgatcgtggaggtgctggaggacgtgcccctgaccatgcacaacttcgtgagaaagaccttcttcagcctggccttctgcgacttctgcctgaagttcctgttccacggcttcagatgccagacctgcggctacaagttccaccagcactgcagcagcaaggtgcccaccgtgtgcgtggacatgagcaccaacagacagcagttctaccacagcgtgcaggacctgagcggcggcagcagacagcacgaggcccccagcaacagacccctgaacgagctgctgaccccccagggccccagatag

SEQ ID NO: 11028 - DNA, 1821 bp, Artificial Sequence
  Description of Artificial Sequence: Synthetic coding sequence
atggagccccccagaggcccccccgccaacggcgccgagcccagcagagccgtgggcaccgtgaaggtgtacctgcccaacaagcagagaaccgtggtgaccgtgagagacggcatgagcgtgtacgacagcctggacaaggccctgaaggtgagaggcctgaaccaggactgctgcgtggtgtacagactgatcaagggcagaaagaccgtgaccgcctgggacaccgccatcgcccccctggacggcgaggagctgatcgtggaggtgctggaggacgtgcccctgaccatgcacaacttcgtgagaaagaccttcttcagcctggccttctgcgacttctgcctgaagttcctgttccacggcttcagatgccagacctgcggctacaagttccaccagcactgcagcagcaaggtgcccaccgtgtgcgtggacatgagcaccaacagacagcagttctaccacagcgtgcaggacctgagcggcggcagcagacagcacgaggcccccagcaacagacccctgaacgagctgctgaccccccagggccccagccccagaacccagcactgcgaccccgagcacttccccttccccgcccccgccaacgcccccctgcagagaatcagaagcaccagcacccccaacgtgcacatggtgagcaccaccgcccccatggacagcaacctgatccagctgaccggccagagcttcagcaccgacgccgccggcagcagaggcggcagcgacggcacccccagaggcagccccagccccgccagcgtgagcagcggcagaaagagcccccacagcaagagccccgccgagcagagagagagaaagagcctggccgacgacaagaagaaggtgaagaacctgggctacagagacagcggctactactgggaggtgccccccagcgaggtgcagctgctgaagagaatcggcaccggcagcttcggcaccgtgttcagaggcagatggcacggcgacgtggccgtgaaggtgctgaaggtgagccagcccaccgccgagcaggcccaggccttcaagaacgagatgcaggtgctgagaaagaccagacacgtgaacatcctgctgttcatgggcttcatgaccagacccggcttcgccatcatcacccagtggtgcgagggcagcagcctgtaccaccacctgcacgtggccgacaccagattcgacatggtgcagctgatcgacgtggccagacagaccgcccagggcatggactacctgcacgccaagaacatcatccacagagacctgaagagcaacaacatcttcctgcacgagggcctgaccgtgaagatcggcgacttcggcctggccaccgtgaagaccagatggagcggcgcccagcccctggagcagcccagcggcagcgtgctgtggatggccgccgaggtgatcagaatgcaggaccccaacccctacagcttccagagcgacgtgtacgcctacggcgtggtgctgtacgagctgatgaccggcagcctgccctacagccacatcggctgcagagaccagatcatcttcatggtgggcagaggctacctgagccccgacctgagcaagatcagcagcaactgccccaaggccatgagaagactgctgagcgactgcctgaagttccagagagaggagagacccctgttcccccagatcctggccaccatcgagctgctgcagagaagcctgcccaagatcgagagaagcgccagcgagcccagcctgcacagaacccaggccgacgagctgcccgcctgcctgctgagcgccgccagactggtgccctag

SEQ ID NO: 11029 - DNA, 3036 bp, Artificial Sequence
  Description of Artificial Sequence: Synthetic coding sequence
atggtgagcagcgacagacccgtgagcctggaggacgaggtgagccacagcatgaaggagatgatcggcggctgctgcgtgtgcagcgacgagagaggctgggccgagaaccccctggtgtactgcgacggccacggctgcagcgtggccgtgcaccaggcctgctacggcatcgtgcaggtgcccaccggcccctggttctgcagaaagtgcgagagccaggagagagccgccagagtgagatgcgagctgtgcccccacaaggacggcgccctgaagagaaccgacaacggcggctgggcccacgtggtgtgcgccctgtacatccccgaggtgcagttcgccaacgtgagcaccatggagcccatcgtgctgcagagcgtgccccacgacagatacaacaagacctgctacatctgcgacgagcagggcagagagagcaaggccgccaccggcgcctgcatgacctgcaacaagcacggctgcagacaggccttccacgtgacctgcgcccagttcgccggcctgctgtgcgaggaggagggcaacggcgccgacaacgtgcagtactgcggctactgcaagtaccacttcagcaagctgaagaagagcaagagaggcagcaacagaagctacgaccagagcctgagcgacagcagcagccacagccaggacaagcaccacgagaaggagaagaagaagtacaaggagaaggacaagcacaagcagaagcacaagaagcagcccgagcccagccccgccctggtgcccagcctgaccgtgaccaccgagaagacctacaccagcaccagcaacaacagcatcagcggcagcctgaagagactggaggacaccaccgccagattcaccaacgccaacttccaggaggtgagcgcccacaccagcagcggcaaggacgtgagcgagaccagaggcagcgagggcaagggcaagaagagcagcgcccacagcagcggccagagaggcagaaagcccggcggcggcagaaaccccggcaccaccgtgagcgccgccagccccttcccccagggcagcttcagcggcacccccggcagcgtgaagagcagcagcggcagcagcgtgcagagcccccaggacttcctgagcttcaccgacagcgacctgagaaacgacagctacagccacagccagcagagcagcgccaccaaggacgtgcacaagggcgagagcggcagccaggagggcggcgtgaacagcttcagcaccctgatcggcctgcccagcaccagcgccgtgaccagccagcccaagagcttcgagaacagccccggcgacctgggcaacagcagcctgcccaccgccggctacaagagagcccagaccagcggcatcgaggaggagaccgtgaaggagaagaagagaaagggcaacaagcagagcaagcacggccccggcagacccaagggcaacaagaaccaggagaacgtgagccacctgagcgtgagcagcgccagccccaccagcagcgtggccagcgccgccggcagcatcaccagcagcagcctgcagaagagccccaccctgctgagaaacggcagcctgcagagcctgagcgtgggcagcagccccgtgggcagcgagatcagcatgcagtacagacacgacggcgcctgccccaccaccaccttcagcgagctgctgaacgccatccacaacggcatctacaacagcaacgacgtggccgtgagcttccccaacgtggtgagcggcagcggcagcagcacccccgtgagcagcagccacctgccccagcagagcagcggccacctgcagcaggtgggcgccctgagccccagcgccgtgagcagcgccgcccccgccgtggccaccacccaggccaacaccctgagcggcagcagcctgagccaggcccccagccacatgtacggcaacagaagcaacagcagcatggccgccctgatcgcccagagcgagaacaaccagaccgaccaggacctgggcgacaacagcagaaacctggtgggcagaggcagcagccccagaggcagcctgagccccagaagccccgtgagcagcctgcagatcagatacgaccagcccggcaacagcagcctggagaacctgccccccgtggccgccagcatcgagcagctgctggagagacagtggagcgagggccagcagttcctgctggagcagggcacccccagcgacatcctgggcatgctgaagagcctgcaccagctgcaggtggagaacagaagactggaggagcagatcaagaacctgaccgccaagaaggagagactgcagctgctgaacgcccagctgagcgtgcccttccccaccatcaccgccaaccccagccccagccaccagatccacaccttcagcgcccagaccgcccccaccaccgacagcctgaacagcagcaagagcccccacatcggcaacagcttcctgcccgacaacagcctgcccgtgctgaaccaggacctgaccagcagcggccagagcaccagcagcagcagcgccctgagcacccccccccccgccggccagagccccgcccagcagggcagcggcgtgagcggcgtgcagcaggtgaacggcgtgaccgtgggcgccctggccagcggcatgcagcccgtgaccagcaccatccccgccgtgagcgccgtgggcggcatcatcggcgccctgcccggcaaccagctggccatcaacggcatcgtgggcgccctgaacggcgtgatgcagacccccgtgaccatgagccagaaccccacccccctgacccacaccaccgtgccccccaacgccacccaccccatgcccgccaccctgaccaacagcgccagcggcctgggcctgctgagcgaccagcagagacagatcctgatccaccagcagcagttccagcagctgctgaacagccagcagctgacccccgtgcacagacacccccacttcacccagctgccccccacccacttcagccccagcatggagatcatgcaggtgagaaagtag

SEQ ID NO: 11030 - DNA, 3084 bp, Artificial Sequence
  Description of Artificial Sequence: Synthetic coding sequence
atggtgagcagcgacagacccgtgagcctggaggacgaggtgagccacagcatgaaggagatgatcggcggctgctgcgtgtgcagcgacgagagaggctgggccgagaaccccctggtgtactgcgacggccacggctgcagcgtggccgtgcaccaggcctgctacggcatcgtgcaggtgcccaccggcccctggttctgcagaaagtgcgagagccaggagagagccgccagagtgagatgcgagctgtgcccccacaaggacggcgccctgaagagaaccgacaacggcggctgggcccacgtggtgtgcgccctgtacatccccgaggtgcagttcgccaacgtgagcaccatggagcccatcgtgctgcagagcgtgccccacgacagatacaacaagacctgctacatctgcgacgagcagggcagagagagcaaggccgccaccggcgcctgcatgacctgcaacaagcacggctgcagacaggccttccacgtgacctgcgcccagttcgccggcctgctgtgcgaggaggagggcaacggcgccgacaacgtgcagtactgcggctactgcaagtaccacttcagcaagctgaagaagagcaagagaggcagcaacagaagctacgaccagagcctgagcgacagcagcagccacagccaggacaagcaccacgagaaggagaagaagaagtacaaggagaaggacaagcacaagcagaagcacaagaagcagcccgagcccagccccgccctggtgcccagcctgaccgtgaccaccgagaagacctacaccagcaccagcaacaacagcatcagcggcagcctgaagagactggaggacaccaccgccagattcaccaacgccaacttccaggaggtgagcgcccacaccagcagcggcaaggacgtgagcgagaccagaggcagcgagggcaagggcaagaagagcagcgcccacagcagcggccagagaggcagaaagcccggcggcggcagaaaccccggcaccaccgtgagcgccgccagccccttcccccagggcagcttcagcggcacccccggcagcgtgaagagcagcagcggcagcagcgtgcagagcccccaggacttcctgagcttcaccgacagcgacctgagaaacgacagctacagccacagccagcagagcagcgccaccaaggacgtgcacaagggcgagagcggcagccaggagggcggcgtgaacagcttcagcaccctgatcggcctgcccagcaccagcgccgtgaccagccagcccaagagcttcgagaacagccccggcgacctgggcaacagcagcctgcccaccgccggctacaagagagcccagaccagcggcatcgaggaggagaccgtgaaggagaagaagagaaagggcaacaagcagagcaagcacggccccggcagacccaagggcaacaagaaccaggagaacgtgagccacctgagcgtgagcagcgccagccccaccagcagcgtggccagcgccgccggcagcatcaccagcagcagcctgcagaagagccccaccctgctgagaaacggcagcctgcagagcctgagcgtgggcagcagccccgtgggcagcgagatcagcatgcagtacagacacgacggcgcctgccccaccaccaccttcagcgagctgctgaacgccatccacaacgacagaggcgacagcagcaccctgaccaagcaggagctgaagttcatcggcatctacaacagcaacgacgtggccgtgagcttccccaacgtggtgagcggcagcggcagcagcacccccgtgagcagcagccacctgccccagcagagcagcggccacctgcagcaggtgggcgccctgagccccagcgccgtgagcagcgccgcccccgccgtggccaccacccaggccaacaccctgagcggcagcagcctgagccaggcccccagccacatgtacggcaacagaagcaacagcagcatggccgccctgatcgcccagagcgagaacaaccagaccgaccaggacctgggcgacaacagcagaaacctggtgggcagaggcagcagccccagaggcagcctgagccccagaagccccgtgagcagcctgcagatcagatacgaccagcccggcaacagcagcctggagaacctgccccccgtggccgccagcatcgagcagctgctggagagacagtggagcgagggccagcagttcctgctggagcagggcacccccagcgacatcctgggcatgctgaagagcctgcaccagctgcaggtggagaacagaagactggaggagcagatcaagaacctgaccgccaagaaggagagactgcagctgctgaacgcccagctgagcgtgcccttccccaccatcaccgccaaccccagccccagccaccagatccacaccttcagcgcccagaccgcccccaccaccgacagcctgaacagcagcaagagcccccacatcggcaacagcttcctgcccgacaacagcctgcccgtgctgaaccaggacctgaccagcagcggccagagcaccagcagcagcagcgccctgagcacccccccccccgccggccagagccccgcccagcagggcagcggcgtgagcggcgtgcagcaggtgaacggcgtgaccgtgggcgccctggccagcggcatgcagcccgtgaccagcaccatccccgccgtgagcgccgtgggcggcatcatcggcgccctgcccggcaaccagctggccatcaacggcatcgtgggcgccctgaacggcgtgatgcagacccccgtgaccatgagccagaaccccacccccctgacccacaccaccgtgccccccaacgccacccaccccatgcccgccaccctgaccaacagcgccagcggcctgggcctgctgagcgaccagcagagacagatcctgatccaccagcagcagttccagcagctgctgaacagccagcagctgacccccgtgcacagacacccccacttcacccagctgccccccacccacttcagccccagcatggagatcatgcaggtgagaaagtag

SEQ ID NO: 11031 - DNA, 567 bp, Artificial Sequence; identical to SEQ ID NO: 10128
  Description of Artificial Sequence: Synthetic coding sequence

SEQ ID NO: 11032 - DNA, 381 bp, Artificial Sequence
  Description of Artificial Sequence: Synthetic coding sequence
atggtgagcagcgacagacccgtgagcctggaggacgaggtgagccacagcatgaaggagatgatcggcggctgctgcgtgtgcagcgacgagagaggctgggccgagaaccccctggtgtactgcgacggccacggctgcagcgtggccgtgcaccaggcctgctacggcatcgtgcaggtgcccaccggcccctggttctgcagaaagtgcgagagccaggagagagccgccagagtggccgagagcagaagcgtggcccaggccaaggtgcagtggtgcgacctgagccccctgcagcccctgctgcccggcttcaagagattcagctgcctgagcctgcccaacggcatgcagttcctgctggtgagcctgatctag

SEQ ID NO: 11033 - DNA, 540 bp, Artificial Sequence
  Description of Artificial Sequence: Synthetic coding sequence
atggtgagcagcgacagacccgtgagcctggaggacgaggtgagccacagcatgaaggagatgatcggcggctgctgcgtgtgcagcgacgagagaggctgggccgagaaccccctggtgtactgcgacggccacggctgcagcgtggccgtgcaccaggcctgctacggcatcgtgcaggtgcccaccggcccctggttctgcagaaagtgcgagagccaggagagagccgccagagtgatggtgtgcaacagctgctggctggccagcagcgagaacgtgacccccggctacatcgagcaccactgcgcctgcgccagcccccaccccagatgcctggtgagcaacgtgccccccgtgagcggcgccctgatgcactgcttctgggcctgcctgaccaccgccgccttcttcggcccccagagcttcaccacctgccacatgagcttcctggtgagcagagacatcctgttctacatctacggcttcatgcccttcatcagcgtggtgatctggagattcaagaaggagagatggtag

SEQ ID NO: 11034 - DNA, 540 bp, Artificial Sequence
  Description of Artificial Sequence: Synthetic coding sequence
atgggcctgatcttcgccaagctgtggagcctgttctgcaaccaggagcacaaggtgatcatcgtgggcctggacaacgccggcaagaccaccatcctgtaccagttcctgatgaacgaggtggtgcacaccagccccaccatcggcagcaacgtggaggagatcgtggtgaagaacacccacttcctgatgtgggacatcggcggccaggagagcctgagaagcagctggaacacctactacagcaacaccgagttcatcatcctggtggtggacagcatcgacagagagagactggccatcaccaaggaggagctgtacagaatgctggcccacgaggacctgagaaaggccgccgtgctgatcttcgccaacaagcaggacatgaagggctgcatgaccgccgccgagatcagcaagtacctgaccctgagcagcatcaaggaccacccctggcacatccagagctgctgcgccctgaccggcgagggcctgtgccagggcctggagtggatgaccagcagaatcggcgtgagatag

SEQ ID NO: 11035 - DNA, 3345 bp, Artificial Sequence
  Description of Artificial Sequence: Synthetic coding sequence
atgagccagacccaggactacgagtgcagaagccacaacgtggacctgcccgagagcagaatccccggcagcaacaccagactggagtgggtggagatcatcgagcccagaaccagagagagaatgtacgccaacctggtgaccggcgagtgcgtgtgggacccccccgccggcgtgagaatcaagagaaccagcgagaaccagtggtgggagctgttcgaccccaacaccagcagattctactactacaacgccagcacccagagaaccgtgtggcacagaccccagggctgcgacatcatccccctggccaagctgcagaccctgaagcagaacaccgagagccccagagccagcgccgagagcagccccggcagaggcagcagcgtgagcagagagggcagcaccagcagcagcctggagcccgagcccgacaccgagaaggcccaggagctgcccgccagagccggcagacccgccgccttcggcaccgtgaaggaggacagcggcagcagcagcccccccggcgtgttcctggagaaggactacgagatctacagagactacagcgccgacggccagctgctgcactacagaaccagcagcctgagatggaacagcggcgccaaggagagaatgctgatcaaggtggccgacagagagcccagcttcctggccgcccagggcaacggctacgcccccgacggcccccccggcgtgagaagcagaagacccagcggcagccagcacagccccagcctgcagaccttcgcccccgaggccgacggcaccatcttcttccccgagagaagacccagccccttcctgaagagagccgagctgcccggcagcagcagccccctgctggcccagcccagaaagcccagcggcgacagccagcccagcagccccagatacggctacgagccccccctgtacgaggagccccccgtggagtaccaggcccccatctacgacgagccccccatggacgtgcagttcgaggccggcggcggctaccaggccggcagcccccagagaagccccggcagaaagcccagacccttcctgcagcccaacaagcagggcccccccagcccctgccagcagctggtgctgaccaagcagaagtgccccgagagattcctgagcctggagtacagccccgccggcaaggagtacgtgagacagctggtgtacgtggagcaggccggcagcagccccaagctgagagccggccccagacacaagtacgcccccaaccccggcggcggcagctacagcctgcagcccagcccctgcctgctgagagaccagagactgggcgtgaagagcggcgactacagcaccatggagggccccgagctgagacacagccagccccccacccccctgccccaggcccaggaggacgccatgagctggagcagccagcaggacaccctgagcagcaccggctacagccccggcaccagaaagagaaagagcagaaagcccagcctgtgccaggccaccagcgccacccccaccgagggccccggcgacctgctggtggagcagcccctggccgaggagcagcccccctgcggcaccagcctggcccccgtgaagagagccgagggcgaggccgagggcgccagaggcgccgccgagcccttcctggcccaggccagactggcctgggaggcccagcaggcccacttccacatgaagcagagaagcagctgggacagccagcaggacggcagcggctacgagagcgacggcgccctgcccctgcccatgcccggccccgtggtgagagccttcagcgaggacgaggccctggcccagcaggagaacagacactggagaagaggcaccttcgagaagctgggcttcccccagatcctgctggagaagagcgtgagcgtgcagaccaacctggccagccccgagccctacctgcaccccagccagagcgaggacctggccgcctgcgcccagttcgagagcagcagacagagcagaagcggcgtgcccagcagcagctgcgtgttccccaccttcaccctgagaaagcccagcagcgagaccgacatcgagaactgggccagcaagcacttcaacaagcacacccagggcctgttcagaagaaaggtgagcatcgccaacatgctggcctggagcagcgagagcatcaagaagcccatgatcgtgaccagcgacagacacgtgaagaaggaggcctgcgagctgttcaagctgatccagatgtacatgggcgacagaagagccaaggccgaccccctgcacgtggccctggaggtggccaccaagggctggagcgtgcagggcctgagagacgagctgtacatccagctgtgcagacagaccaccgagaacttcagactggagagcctggccagaggctgggagctgatggccatctgcctggccttcttcccccccacccccaagttccacagctacctggagggctacatctacagacacatggaccccgtgaacgacaccaaggtgacccagcacatcaaggagctgctggagagaaacaccaagaagaagagcaagctgagaaagaagcccaagccctacgtggaggagcccgacggcgtggccatcagcacctacgccaagtactgctaccacaagctgcagaaggccgccctgaccggcgccaagaagggcctgaagaagcccaacgtggaggagatcagacacgccaagaacgccgtgttcagccccagcatgttcggcagcgccctgcaggaggtgatgggcatgcagagagagagataccccgagagacagctgccctgggtgcagaccagactgagcgaggaggtgctggccctgaacggcgaccagaccgagggcatcttcagagtgcccggcgacatcgacgaggtgaacgccctgaagctgcaggtggaccagtggaaggtgcccaccggcctggaggacccccacgtgcccgccagcctgctgaagctgtggtacagagagctggaggagcccctgatcccccacgagttctacgagcagtgcatcgcccactacgacagccccgaggccgccgtggccgtggtgcacgccctgcccagaatcaacagaatggtgctgtgctacctgatcagattcctgcaggtgttcgtgcagcccgccaacgtggccgtgaccaagatggacgtgagcaacctggccatggtgatggcccccaactgcctgagatgccagagcgacgaccccagagtgatcttcgagaacaccagaaaggagatgagcttcctgagagtgctgatccagcacctggacaccagcttcatggagggcgtgctgtag

SEQ ID NO: 11036 - DNA, 822 bp, Artificial Sequence; identical to SEQ ID NO: 10030
  Description of Artificial Sequence: Synthetic coding sequence

SEQ ID NO: 11037 - DNA, 3633 bp, Artificial Sequence
  Description of Artificial Sequence: Synthetic coding sequence
atgcccagaggcgaggcccccggccccggcagaagaggcgccaaggacgaggccctgggcgaggagagcggcgagagatggagccccgagttccacctgcagagaaagctggccgacagcagccacagcgagcagcaggacagaaacagagtgagcgaggagctgatcatggtggtgcaggagatgaagaagtacttccccagcgagagaagaaacaagcccagcaccctggacgccctgaactacgccctgagatgcgtgcacagcgtgcaggccaacagcgagttcttccagatcctgagccagaacggcgccccccaggccgacgtgagcatgtacagcctggaggagctggccaccatcgccagcgagcacaccagcaagaacaccgacaccttcgtggccgtgttcagcttcctgagcggcagactggtgcacatcagcgagcaggccgccctgatcctgaacagaaagaaggacgtgctggccagcagccacttcgtggacctgctggccccccaggacatgagagtgttctacgcccacaccgccagagcccagctgcccttctggaacaactggacccagagagccgccgccagatacgagtgcgcccccgtgaagcccttcttctgcagaatcagaggcggcgaggacagaaagcaggagaagtgccacagccccttcagaatcatcccctacctgatccacgtgcaccaccccgcccagcccgagctggagagcgagccctgctgcctgaccgtggtggagaagatccacagcggctacgaggcccccagaatccccgtgaacaagagaatcttcaccaccacccacacccccggctgcgtgttcctggaggtggacgagaaggccgtgcccctgctgggctacctgccccaggacctgatcggcaccagcatcctgagctacctgcaccccgaggacagaagcctgatggtggccatccaccagaaggtgctgaagtacgccggccacccccccttcgagcacagccccatcagattctgcacccagaacggcgactacatcatcctggacagcagctggagcagcttcgtgaacccctggagcagaaagatcagcttcatcatcggcagacacaaggtgagaaccagccccctgaacgaggacgtgttcgccaccaagatcaagaagatgaacgacaacgacaaggacatcaccgagctgcaggagcagatctacaagctgctgctgcagcccgtgcacgtgagcgtgagcagcggctacggcagcctgggcagcagcggcagccaggagcagctggtgagcatcgccagcagcagcgaggccagcggccacagagtggaggagaccaaggccgagcagatgaccctgcagcaggtgtacgccagcgtgaacaagatcaagaacctgggccagcagctgtacatcgagagcatgaccaagagcagcttcaagcccgtgaccggcaccagaaccgagcccaacggcggcggcgagagcgccaacggcggcggcgagtgcaagaccttcaccagcttccaccagaccctgaagaacaacagcgtgtacaccgagccctgcgaggacctgagaaacgacgagcacagccccagctaccagcagatcaactgcatcgacagcgtgatcagatacctgaagagctacaacatccccgccctgaagagaaagtgcatcagctgcaccaacaccaccagcagcagcagcgaggaggacaagcagaaccacaaggccgacgacgtgcaggccctgcaggccggcctgcagatccccgccatccccaagagcgagatgcccaccaacggcagaagcatcgacaccggcggcggcgccccccagatcctgagcaccgccatgctgagcctgggcagcggcatcagccagtgcggctacagcagcaccatcgtgcacgtgcccccccccgagaccgccagagacgccaccctgttctgcgagccctggaccctgaacatgcagcccgcccccctgaccagcgaggagttcaagcacgtgggcctgaccgccgccgtgctgagcgcccacacccagaaggaggagcagaactacgtggacaagttcagagagaagatcctgagcagcccctacagcagctacctgcagcaggagagcagaagcaaggccaagtacagctacttccagggcgacagcaccagcaagcagaccagaagcgccggctgcagaaagggcaagcacaagagaaagaagctgcccgagccccccgacagcagcagcagcaacaccggcagcggccccagaagaggcgcccaccagaacgcccagccctgctgccccagcgccgccagcagcccccacaccagcagccccaccttcccccccgccgccatggtgcccagccaggccccctacctggtgcccgccttccccctgcccgccgccaccagccccggcagagagtacgccgcccccggcaccgcccccgagggcctgcacggcctgcccctgagcgagggcctgcagccctaccccgccttccccttcccctacctggacaccttcatgaccgtgttcctgcccgacccccccgtgtgccccctgctgagccccagcttcctgccctgccccttcctgggcgccaccgccagcagcgccatcagccccagcatgagcagcgccatgagccccaccctggaccccccccccagcgtgaccagccagagaagagaggaggagaagtgggaggcccagagcgagggccaccccttcatcaccagcagaagcagcagccccctgcagctgaacctgctgcaggaggagatgcccagacccagcgagagccccgaccagatgagaagaaacacctgcccccagaccgagtaccagtgcgtgaccggcaacaacggcagcgagagcagccccgccaccaccggcgccctgagcaccggcagcccccccagagagaaccccagccaccccaccgccagcgccctgagcaccggcagcccccccatgaagaaccccagccaccccaccgccagcgccctgagcaccggcagcccccccatgaagaaccccagccaccccaccgccagcaccctgagcatgggcctgccccccagcagaacccccagccaccccaccgccaccgtgctgagcaccggcagcccccccagcgagagccccagcagaaccggcagcgccgccagcggcagcagcgacagcagcatctacctgaccagcagcgtgtacagcagcaagatcagccagaacggccagcagagccaggacgtgcagaagaaggagaccttccccaacgtggccgaggagcccatctggagaatgatcagacagacccccgagagaatcctgatgacctaccaggtgcccgagagagtgaaggaggtggtgctgaaggaggacctggagaagctggagagcatgagacagcagcagccccagttcagccacggccagaaggaggagctggccaaggtgtacaactggatccagagccagaccgtgacccaggagatcgacatccaggcctgcgtgacctgcgagaacgaggacagcgccgacggcgccgccaccagctgcggccaggtgctggtggaggacagctgctag

SEQ ID NO: 11038 - DNA, 1137 bp, Artificial Sequence
  Description of Artificial Sequence: Synthetic coding sequence
atgcccagaggcgaggcccccggccccggcagaagaggcgccaaggacgaggccctgggcgaggagagcggcgagagatggagccccgagttccacctgcagagaaagctggccgacagcagccacagcgagcagcaggacagaaacagagtgagcgaggagctgatcatggtggtgcaggagatgaagaagtacttccccagcgagagaagaaacaagcccagcaccctggacgccctgaactacgccctgagatgcgtgcacagcgtgcaggccaacagcgagttcttccagatcctgagccagaacggcgccccccaggccgacgtgagcatgtacagcctggaggagctggccaccatcgccagcgagcacaccagcaagaacaccgacaccttcgtggccgtgttcagcttcctgagcggcagactggtgcacatcagcgagcaggccgccctgatcctgaacagaaagaaggacgtgctggccagcagccacttcgtggacctgctggccccccaggacatgagagtgttctacgcccacaccgccagagcccagctgcccttctggaacaactggacccagagagccgccagatacgagtgcgcccccgtgaagcccttcttctgcagaatcagaggcggcgaggacagaaagcaggagaagtgccacagccccttcagaatcatcccctacctgatccacgtgcaccaccccgcccagcccgagctggagagcgagccctgctgcctgaccgtggtggagaagatccacagcggctacgaggcccccagaatccccgtgaacaagagaatcttcaccaccacccacacccccggctgcgtgttcctggaggtggacgagaaggccgtgcccctgctgggctacctgccccaggacctgatcggcaccagcatcctgagctacctgcaccccgaggacagaagcctgatggtggccatccaccagaaggtgctgaagtacgccggccacccccccttcgagcacagccccatcagattctgcacccagaacggcgactacatcatcctggacagcagctggagcagcttcgtgaacccctggagcagaaagatcagcttcatcatcggcagacacaaggtgagaacctag

SEQ ID NO: 11039 - DNA, 1794 bp, Artificial Sequence
  Description of Artificial Sequence: Synthetic coding sequence
atggagagacccgcccccctggccgtgctgcccttcagcgaccccgcccacgccctgagcctgctgagaggcctgagccagctgagagccgagagaaagttcctggacgtgaccctggaggccgccggcggcagagacttccccgcccacagagccgtgctggccgccgccagcccctacttcagagccatgttcgccggccagctgagagagagcagagccgagagagtgagactgcacggcgtgccccccgacatgctgcagctgctgctggacttcagctacaccggcagagtggccgtgagcggcgacaacgccgagcccctgctgagagccgccgacctgctgcagttccccgccgtgaaggaggcctgcggcgccttcctgcagcagcagctggacctggccaactgcctggacatgcaggacttcgccgaggccttcagctgcagcggcctggccagcgccgcccagagattcatcctgagacacgtgggcgagctgggcgccgagcagctggagagactgcccctggccagactgctgagatacctgagagacgacggcctgtgcgtgcccaaggaggaggccgcctaccagctggccctgagatgggtgagagccgacccccccagaagagccgcccactggccccagctgctggaggccgtgagactgcccttcgtgagaagattctacctgctggcccacgtggaggccgagcccctggtggccagatgccccccctgcctgagactgctgagagaggccagagacttccaggccgccagatacgacagacacgacagaggcccctgccccagaatgagacccagacccagcaccggcctggccgagatcctggtgctggtgggcggctgcgaccaggactgcgacgagctggtgaccgtggactgctacaacccccagaccggccagtggagatacctggccgagttccccgaccacctgggcggcggctacagcatcgtggccctgggcaacgacatctacgtgaccggcggcagcgacggcagcagactgtacgactgcgtgtggagatacaacagcagcgtgaacgagtgggccgaggtggcccccatgctgaaggccagagagtaccacagcagcagcgtgctggacggcctgctgtacgtggtggccgccgacagcaccgagagatacgaccacaccaccgacagctgggaggccctgcagcccatgacctaccccatggacaactgcagcaccaccgcctgcagaggcagactgtacgccatcggcagcctggccggcaaggagaccatggtgatgcagtgctacgaccccgacaccgacctgtggagcctggtggactgcggccagctgcccccctggagcttcgcccccaagaccgccaccctgaacggcctgatgtacttcgtgagagacgacagcgccgaggtggacgtgtacaaccccaccagaaacgagtgggacaagatccccagcatgaaccaggtgcacgtgggcggcagcctggccgtgctgggcggcaagctgtacgtgagcggcggctacgacaacaccttcgagctgagcgacgtggtggaggcctacgaccccgagaccagagcctggagcgtggtgggcagactgcccgagcccaccttctggcacggcagcgtgagcatcttcagacagttcatgccccagaccttcagcggcggcagaggcttcgagctggacagcggcagcgacgacatggaccccggcagacccagaccccccagagaccccgacgagctgcactag

SEQ ID NO: 11040 - DNA, 1620 bp, Artificial Sequence
  Description of Artificial Sequence: Synthetic coding sequence
atggagagacccgcccccctggccgtgctgcccttcagcgaccccgcccacgccctgagcctgctgagaggcctgagccagctgagagccgagagaaagttcctggacgtgaccctggaggccgccggcggcagagacttccccgcccacagagccgtgctggccgccgccagcccctacttcagagccatgttcgccggccagctgagagagagcagagccgagagagtgagactgcacggcgtgccccccgacatgctgcagctgctgctggacttcagctacaccggcagagtggccgtgagcggcgacaacgccgagcccctgctgagagccgccgacctgctgcagttccccgccgtgaaggaggcctgcggcgccttcctgcagcagcagctggacctggccaactgcctggacatgcaggacttcgccgaggccttcagctgcagcggcctggccagcgccgcccagagattcatcctgagacacgtgggcgagctgggcgccgagcagctggagagactgcccctggccagactgctgagatacctgagagacgacggcctgtgcgtgcccaaggaggaggccgcctaccagctggccctgagatgggtgagagccgacccccccagaagagccgcccactggccccagctgctggaggccgtgagactgcccttcgtgagaagattctacctgctggcccacgtggaggccgagcccctggtggccagatgccccccctgcctgagactgctgagagaggccagagacttccaggccgccagatacgacagacacgacagaggcccctgccccagaatgagacccagacccagcaccggcctggccgagatcctggtgctggtgggcggctgcgaccaggactgcgacgagctggtgaccgtggactgctacaacccccagaccggccagtggagatacctggccgagttccccgaccacctgggcggcggctacagcatcgtggccctgggcaacgacatctacgtgaccggcggcagcgacggcagcagactgtacgactgcgtgtggagatacaacagcagcgtgaacgagtgggccgaggtggcccccatgctgaaggccagagagtaccacagcagcagcgtgctggacggcctgctgtacgtggtggccgccgacagcaccgagagatacgaccacaccaccgacagctgggaggccctgcagcccatgacctaccccatggacaactgcagcaccaccgcctgcagaggcagactgtacgccatcggcagcctggccggcaaggagaccatggtgatgcagtgctacgaccccgacaccgacctgtggagcctggtggactgcggccagctgcccccctggagcttcgcccccaagaccgccaccctgaacggcctgatgtacttcgtgagagacgacagcgccgaggtggacgtgtacaaccccaccagaaacgagtgggacaagatccccagcatgaaccaggtgaacttccaggccggccagcactggaagcacagactggtgctgatcctgcagcccaagtgccacagagacgagtgcctgggcagcaccgccatgatgggcggcagccacctgaactag

SEQ ID NO: 11041 - DNA, 2067 bp, Artificial Sequence
  Description of Artificial Sequence: Synthetic coding sequence
atggacggcagcttcgtgcagcacagcgtgagagtgctgcaggagctgaacaagcagagagagaagggccagtactgcgacgccaccctggacgtgggcggcctggtgttcaaggcccactggagcgtgctggcctgctgcagccacttcttccagagcctgtacggcgacggcagcggcggcagcgtggtgctgcccgccggcttcgccgagatcttcggcctgctgctggacttcttctacaccggccacctggccctgaccagcggcaacagagaccaggtgctgctggccgccagagagctgagagtgcccgaggccgtggagctgtgccagagcttcaagcccaagaccagcgtgggccaggccgccggcggccagagcggcctgggcccccccgccagccagaacgtgaacagccacgtgaaggagcccgccggcctggaggaggaggaggtgagcagaaccctgggcctggtgcccagagaccaggagcccagaggcagccacagcccccagagaccccagctgcacagccccgcccagagcgagggccccagcagcctgtgcggcaagctgaagcaggccctgaagccctgccccctggaggacaagaagcccgaggactgcaaggtgccccccagacccctggaggccgagggcgcccagctgcagggcggcagcaacgagtgggaggtggtggtgcaggtggaggacgacggcgacggcgactacatgagcgagcccgaggccgtgctgaccagaagaaagagcaacgtgatcagaaagccctgcgccgccgagcccgccctgagcgccggcagcctggccgccgagcccgccgagaacagaaagggcaccgccgtgcccgtggagtgccccacctgccacaagaagttcctgagcaagtactacctgaaggtgcacaacagaaagcacaccggcgagaagcccttcgagtgccccaagtgcggcaagtgctacttcagaaaggagaacctgctggagcacgaggccagaaactgcatgaacagaagcgagcaggtgttcacctgcagcgtgtgccaggagaccttcagaagaagaatggagctgagagtgcacatggtgagccacaccggcgagatgccctacaagtgcagcagctgcagccagcagttcatgcagaagaaggacctgcagagccacatgatcaagctgcacggcgcccccaagccccacgcctgccccacctgcgccaagtgcttcctgagcagaaccgagctgcagctgcacgaggccttcaagcacagaggcgagaagctgttcgtgtgcgaggagtgcggccacagagccagcagcagaaacggcctgcagatgcacatcaaggccaagcacagaaacgagagaccccacgtgtgcgagttctgcagccacgccttcacccagaaggccaacctgaacatgcacctgagaacccacaccggcgagaagcccttccagtgccacctgtgcggcaagaccttcagaacccaggccagcctggacaagcacaacagaacccacaccggcgagagacccttcagctgcgagttctgcgagcagagattcaccgagaagggccccctgctgagacacgtggccagcagacaccaggagggcagaccccacttctgccagatctgcggcaagaccttcaaggccgtggagcagctgagagtgcacgtgagaagacacaagggcgtgagaaagttcgagtgcaccgagtgcggctacaagttcaccagacaggcccacctgagaagacacatggagatccacgacagagtggagaactacaaccccagacagagaaagctgagaaacctgatcatcgaggacgagaagatggtggtggtggccctgcagccccccgccgagctggaggtgggcagcgccgaggtgatcgtggagagcctggcccagggcggcctggccagccagctgcccggccagagactgtgcgccgaggagagcttcaccggccccggcgtgctggagcccagcctgatcatcaccgccgccgtgcccgaggactgcgacacctag

SEQ ID NO: 11042 - DNA, 525 bp, Artificial Sequence
  Description of Artificial Sequence: Synthetic coding sequence
atgacccactgctgcagcccctgctgccagcccacctgctgcagaaccacctgctgcagaaccacctgctggaagcccaccaccgtgaccacctgcagcagcaccccctgctgccagcccgcctgctgcgtgagcagctgctgccagccctgctgcagacccacctgctgccagaacacctgctgcagaaccacctgctgccagcccacctgcgtgaccagctgctgccagcccagctgctgcagcaccccctgctgccagcccacctgctgcggcagcagctgctgcggccagaccagctgcggcagcagctgcggccagagcagcagctgcgcccccgtgtactgcagaagaacctgctactaccccaccaccgtgtgcctgcccggctgcctgaaccagagctgcggcagcaactgctgccagccctgctgcagacccgcctgctgcgagaccacctgctgcagaaccacctgcttccagcccacctgcgtgagcagctgctgccagcccagctgctgctag

SEQ ID NO: 11043 - DNA, 597 bp, Artificial Sequence
  Description of Artificial Sequence: Synthetic coding sequence
atggtgagcagctgctgcggcagcgtgtgcagcgaccagggctgcagccaggacctgtgccaggagacctgctgcagacccagctgctgccagaccacctgctgcagaaccacctgctacagacccagctgctgcgtgagcagctgctgcagaccccagtgctgccagagcgtgtgctgccagcccacctgctgcagaccccccagatgctgcatcagcagctgctgcagacccagctgctgcatgagcagctgctgcaagccccagtgctgccagagcgtgtgctgccagcccaccaccacctgctgccaccccagatgctgcatcagcagctgctgcagacccagctgctgcgtgagcagctgctgcaagccccagtgctgccagagcgtgtgctgccagcccaactgctgcagacccagctgcagcatcagcagctgctgcagacccagctgctgcgagagcagctgctgcagaccctgctgctgcgtgagacccgtgtgcggcagagtgagctgccacaccacctgctacagacccacctgcgtgatcagcagctgccccagacccctgtgctgcgccagcagctgctgctag

SEQ ID NO: 11044 - DNA, 1296 bp, Artificial Sequence
  Description of Artificial Sequence: Synthetic coding sequence
atgaccagcgactgcagcagcacccactgcagccccgagagctgcggcaccgccagcggctgcgcccccgccagcagctgcagcgtggagaccgcctgcctgcccggcacctgcgccaccagcagatgccagacccccagcttcctgagcagaagcagaggcctgaccggctgcctgctgccctgctacttcaccggcagctgcaacagcccctgcctggtgggcaactgcgcctggtgcgaggacggcgtgttcaccagcaacgagaaggagaccatgcagttcctgaacgacagactggccagctacctggagaaggtgagaagcctggaggagaccaacgccgagctggagagcagaatccaggagcagtgcgagcaggacatccccatggtgtgccccgactaccagagatacttcaacaccatcgaggacctgcagcagaagatcctgtgcaccaaggccgagaacagcagactggccgtgcagctggacaactgcaagctggccaccgacgacttcaagagcaagtacgagagcgagctgagcctgagacagctgctggaggccgacatcagcagcctgcacggcatcctggaggagctgaccctgtgcaagagcgacctggaggcccacgtggagagcctgaaggaggacctgctgtgcctgaagaagaaccacgaggaggaggtgaacctgctgagagagcagctgggcgacagactgagcgtggagctggacaccgcccccaccctggacctgaacagagtgctggacgagatgagatgccagtgcgagaccgtgctggccaacaacagaagagaggccgaggagtggctggccgtgcagaccgaggagctgaaccagcagcagctgagcagcgccgagcagctgcagggctgccagatggagatcctggagctgaagagaaccgccagcgccctggagatcgagctgcaggcccagcagagcctgaccgagagcctggagtgcaccgtggccgagaccgaggcccagtacagcagccagctggcccagatccagtgcctgatcgacaacctggagaaccagctggccgagatcagatgcgacctggagagacagaaccaggagtaccaggtgctgctggacgtgaaggccagactggagggcgagatcaacacctactggggcctgctggacagcgaggacagcagactgagctgcagcccctgcagcaccacctgcaccagcagcaacacctgcgagccctgcagcgcctacgtgatctgcaccgtggagaactgctgcctgtag

SEQ ID NO: 11045 - DNA, 1047 bp, Artificial Sequence
  Description of Artificial Sequence: Synthetic coding sequence
atggccggcagcctgcccccctgcgtggtggactgcggcaccggctacaccaagctgggctacgccggcaacaccgagccccagttcatcatccccagctgcatcgccatcagagagagcgccaaggtggtggaccaggcccagagaagagtgctgagaggcgtggacgacctggacttcttcatcggcgacgaggccatcgacaagcccacctacgccaccaagtggcccatcagacacggcatcatcgaggactgggacctgatggagagattcatggagcaggtggtgttcaagtacctgagagccgagcccgaggaccactacttcctgatgaccgagccccccctgaacacccccgagaacagagagtacctggccgagatcatgttcgagagcttcaacgtgcccggcctgtacatcgccgtgcaggccgtgctggccctggccgccagctggaccagcagacaggtgggcgagagaaccctgaccggcatcgtgatcgacagcggcgacggcgtgacccacgtgatccccgtggccgagggctacgtgatcggcagctgcatcaagcacatccccatcgccggcagagacatcacctacttcatccagcagctgctgagagagagagaggtgggcatcccccccgagcagagcctggagaccgccaaggccatcaaggagaagtactgctacatctgccccgacatcgtgaaggagttcgccaagtacgacgtggaccccagaaagtggatcaagcagtacaccggcatcaacgccatcaaccagaagaagttcgtgatcgacgtgggctacgagagattcctgggccccgagatcttcttccaccccgagttcgccaaccccgacttcatggagagcatcagcgacgtggtggacgaggtgatccagaactgccccatcgacgtgagaagacccctgtacaagcccgagttcttccaggtgtgccacaccaagaaggactacgaggagtacggccccagcatctgcagacacaaccccgtgttcggcgtgatgagctag

SEQ ID NO: 11046 - DNA, 273 bp, Artificial Sequence; identical to SEQ ID NO: 9311
  Description of Artificial Sequence: Synthetic coding sequence

SEQ ID NO: 11047 - DNA, 249 bp, Artificial Sequence
  Description of Artificial Sequence: Synthetic coding sequence
atggccagcagcagcggcgccggcgccgccgccgccgccgccgccgccaacctgaacgccgtgagagagaccatggacgtgctgctggagatcagcagaatcctgaacaccggcctggacatggagaccctgagcatctgcgtgagactgtgcgagcagggcatcaaccccgaggccctgagcagcgtgatcaaggagctgagaaaggccaccgaggccctgaaggccgccgagaacatgaccagctag

SEQ ID NO: 11048 - DNA, 3732 bp, Artificial Sequence
  Description of Artificial Sequence: Synthetic coding sequence
atggagaccagagccgccgagaacaccgccatcttcatgtgcaagtgctgcaacctgttcagccccaaccagagcgagctgctgagccacgtgagcgagaagcacatggaggagggcgtgaacgtggacgagatcatcatccccctgagacccctgagcacccccgagccccccaacagcagcaagaccggcgacgagttcctggtgatgaagagaaagagaggcagacccaagggcagcaccaagaagagcagcaccgaggaggagctggccgagaacatcgtgagccccaccgaggacagccccctggcccccgaggagggcaacagcctgccccccagcagcctggagtgcagcaagtgctgcagaaagttcagcaacaccagacagctgagaaagcacatctgcatcatcgtgctgaacctgggcgaggaggagggcgaggccggcaacgagagcgacctggagctggagaagaagtgcaaggaggacgacagagagaaggccagcaagagacccagaagccagaagaccgagaaggtgcagaagatcagcggcaaggaggccagacagctgagcggcgccaagaagcccatcatcagcgtggtgctgaccgcccacgaggccatccccggcgccaccaagatcgtgcccgtggaggccggcccccccgagaccggcgccaccaacagcgagaccaccagcgccgacctggtgcccagaagaggctaccaggagtacgccatccagcagaccccctacgagcagcccatgaagagcagcagactgggccccacccagctgaagatcttcacctgcgagtactgcaacaaggtgttcaagttcaagcacagcctgcaggcccacctgagaatccacaccaacgagaagccctacaagtgcccccagtgcagctacgccagcgccatcaaggccaacctgaacgtgcacctgagaaagcacaccggcgagaagttcgcctgcgactactgcagcttcacctgcctgagcaagggccacctgaaggtgcacatcgagagagtgcacaagaagatcaagcagcactgcagattctgcaagaagaagtacagcgacgtgaagaacctgatcaagcacatcagagacgcccacgacccccaggacaagaaggtgaaggaggccctggacgagctgtgcctgatgaccagagagggcaagagacagctgctgtacgactgccacatctgcgagagaaagttcaagaacgagctggacagagacagacacatgctggtgcacggcgacaagtggcccttcgcctgcgagctgtgcggccacggcgccaccaagtaccaggccctggagctgcacgtgagaaagcaccccttcgtgtacgtgtgcgccgtgtgcagaaagaagttcgtgagcagcatcagactgagaacccacatcaaggaggtgcacggcgccgcccaggaggccctggtgttcaccagcagcatcaaccagagcttctgcctgctggagcccggcggcgacatccagcaggaggccctgggcgaccagctgcagctggtggaggaggagttcgccctgcagggcgtgaacgccctgaaggaggaggcctgccccggcgacacccagctggaggagggcagaaaggagcccgaggcccccggcgagatgcccgcccccgccgtgcacctggccagcccccaggccgagagcaccgccctgcccccctgcgagctggagaccaccgtggtgagcagcagcgacctgcacagccaggaggtggtgagcgacgacttcctgctgaagaacgacaccagcagcgccgaggcccacgccgcccccgagaagccccccgacatgcagcacagaagcagcgtgcagacccagggcgaggtgatcaccctgctgctgagcaaggcccagagcgccggcagcgaccaggagagccacggcgcccagagccccctgggcgagggccagaacatggccgtgctgagcgccggcgaccccgaccccagcagatgcctgagaagcaaccccgccgaggccagcgacctgctgccccccgtggccggcggcggcgacaccatcacccaccagcccgacagctgcaaggccgcccccgagcacagaagcggcatcaccgccttcatgaaggtgctgaacagcctgcagaagaagcagatgaacaccagcctgtgcgagagaatcagaaaggtgtacggcgacctggagtgcgagtactgcggcaagctgttctggtaccaggtgcacttcgacatgcacgtgagaacccacaccagagagcacctgtactactgcagccagtgccactacagcagcatcaccaagaactgcctgaagagacacgtgatccagaagcacagcaacatcctgctgaagtgccccaccgacggctgcgactacagcacccccgacaagtacaagctgcaggcccacctgaaggtgcacaccgccctggacaagagaagctacagctgccccgtgtgcgagaagagcttcagcgaggacagactgatcaagagccacatcaagaccaaccaccccgaggtgagcatgagcaccatcagcgaggtgctgggcagaagagtgcagctgaagggcctgatcggcaagagagccatgaagtgcccctactgcgacttctacttcatgaagaacggcagcgacctgcagagacacatctgggcccacgagggcgtgaagcccttcaagtgcagcctgtgcgagtacgccaccagaagcaagagcaacctgaaggcccacatgaacagacacagcaccgagaagacccacctgtgcgacatgtgcggcaagaagttcaagagcaagggcaccctgaagagccacaagctgctgcacaccgccgacggcaagcagttcaagtgcaccgtgtgcgactacaccgccgcccagaagccccagctgctgagacacatggagcagcacgtgagcttcaagcccttcagatgcgcccactgccactacagctgcaacatcagcggcagcctgaagagacactacaacagaaagcaccccaacgaggagtacgccaacgtgggcaccggcgagctggccgccgaggtgctgatccagcagggcggcctgaagtgccccgtgtgcagcttcgtgtacggcaccaagtgggagttcaacagacacctgaagaacaagcacggcctgaaggtggtggagatcgacggcgaccccaagtgggagaccgccaccgaggcccccgaggagcccagcacccagtacctgcacatcaccgaggccgaggaggacgtgcagggcacccaggccgccgtggccgccctgcaggacctgagatacaccagcgagagcggcgacagactggaccccaccgccgtgaacatcctgcagcagatcatcgagctgggcgccgagacccacgacgccaccgccctggccagcgtggtggccatggcccccggcaccgtgaccgtggtgaagcaggtgaccgaggaggagcccagcagcaaccacaccgtgatgatccaggagaccgtgcagcaggccagcgtggagctggccgagcagcaccacctggtggtgagcagcgacgacgtggagggcatcgagaccgtgaccgtgtacacccagggcggcgaggccagcgagttcatcgtgtacgtgcaggaggccatgcagcccgtggaggagcaggccgtggagcagcccgcccaggagctgtag

SEQ ID NO: 11049 - DNA, 2274 bp, Artificial Sequence
  Description of Artificial Sequence: Synthetic coding sequence
atggccctgggcgaggagaaggccgaggccgaggccagcgaggacaccaaggcccagagctacggcagaggcagctgcagagagagagagctggacatccccggccccatgagcggcgagcagccccccagactggaggccgagggcggcctgatcagccccgtgtggggcgccgagggcatccccgcccccacctgctggatcggcaccgaccccggcggccccagcagagcccaccagccccaggccagcgacgccaacagagagcccgtggccgagagaagcgagcccgccctgagcggcctgccccccgccaccatgggcagcggcgacctgctgctgagcggcgagagccaggtggagaagaccaagctgagcagcagcgaggagttcccccagaccctgagcctgcccagaaccaccaccatctgcagcggccacgacgccgacaccgaggacgaccccagcctggccgacctgccccaggccctggacctgagccagcagccccacagcagcggcctgagctgcctgagccagtggaagagcgtgctgagccccggcagcgccgcccagcccagcagctgcagcatcagcgccagcagcaccggcagcagcctgcagggccaccaggagagagccgagcccagaggcggcagcctggccaaggtgagcagcagcctggagcccgtggtgccccaggagcccagcagcgtggtgggcctgggccccagaccccagtggagcccccagcccgtgttcagcggcggcgacgccagcggcctgggcagaagaagactgagcttccaggccgagtactgggcctgcgtgctgcccgacagcctgccccccagccccgacagacacagccccctgtggaaccccaacaaggagtacgaggacctgctggactacacctaccccctgagacccggcccccagctgcccaagcacctggacagcagagtgcccgccgaccccgtgctgcaggacagcggcgtggacctggacagcttcagcgtgagccccgccagcaccctgaagagccccaccaacgtgagccccaactgcccccccgccgaggccaccgccctgcccttcagcggccccagagagcccagcctgaagcagtggcccagcagagtgccccagaagcagggcggcatgggcctggccagctggagccagctggccagcacccccagagcccccggcagcagagacgccagatgggagagaagagagcccgccctgagaggcgccaaggacagactgaccatcggcaagcacctggacatgggcagcccccagctgagaaccagagacagaggctggcccagccccagacccgagagagagaagagaaccagccagagcgccagaagacccacctgcaccgagagcagatggaagagcgaggaggaggtggagagcgacgacgagtacctggccctgcccgccagactgacccaggtgagcagcctggtgagctacctgggcagcatcagcaccctggtgaccctgcccaccggcgacatcaagggccagagccccctggaggtgagcgacagcgacggccccgccagcttccccagcagcagcagccagagccagctgccccccggcgccgccctgcagggcagcggcgaccccgagggccagaacccctgcttcctgagaagcttcgtgagagcccacgacagcgccggcgagggcagcctgggcagcagccaggccctgggcgtgagcagcggcctgctgaagaccagacccagcctgcccgccagactggacagatggcccttcagcgaccccgacgtggagggccagctgcccagaaagggcggcgagcagggcaaggagagcctggtgcagtgcgtgaagaccttctgctgccagctggaggagctgatctgctggctgtacaacgtggccgacgtgaccgaccacggcaccgccgccagaagcaacctgaccagcctgaagagcagcctgcagctgtacagacagttcaagaaggacatcgacgagcaccagagcctgaccgagagcgtgctgcagaagggcgagatcctgctgcagtgcctgctggagaacacccccgtgctggaggacgtgctgggcagaatcgccaagcagagcggcgagctggagagccacgccgacagactgtacgacagcatcctggccagcctggacatgctggccggctgcaccctgatccccgacaagaagcccatggccgccatggagcacccctgcgagggcgtgtag

SEQ ID NO: 11050 - DNA, 540 bp, Artificial Sequence
  Description of Artificial Sequence: Synthetic coding sequence
atgaaccccagcatgaagcagaagcaggaggagatcaaggagaacatcaagaacagcagcgtgcccagaagaaccctgaagatgatccagcccagcgccagcggcagcctggtgggcagagagaacgagctgagcgccggcctgagcaagagaaagcacagaaacgaccacctgaccagcaccaccagcagccccggcgtgatcgtgcccgagagcagcgagaacaagaacctgggcggcgtgacccaggagagcttcgacctgatgatcaaggagaaccccagcagccagtactggaaggaggtggccgagaagagaagaaaggccctgtacgaggccctgaaggagaacgagaagctgcacaaggagatcgagcagaaggacaacgagatcgccagactgaagaaggagaacaaggagctggccgaggtggccgagcacgtgcagtacatggccgagctgatcgagagactgaacggcgagcccctggacaacttcgagagcctggacaaccaggagttcgacagcgaggaggagtag

SEQ ID NO: 11051 - DNA, 309 bp, Artificial Sequence
  Description of Artificial Sequence: Synthetic coding sequence
atgaaccccagcatgaagcagaagcaggaggagatcaaggagaacatcaagaacagcagcgtgcccagaagaaccctgaagatgatccagcccagcgccagcggcagcctggtgggcagagagaacgagctgagcgccggcctgagcaagagaaagcacagaaacgaccacctgaccagcaccaccagcagccccggcgtgatcgtgcccgagagcagcgagaacaagaacctgggcggcgtgacccaggagagcttcgacctgatgatcaaggagaaccccagcagccagtactggaaggaggtgtag

SEQ ID NO: 11052 - DNA, 2259 bp, Artificial Sequence
  Description of Artificial Sequence: Synthetic coding sequence
atggccgagcccgccagcgtgaccgtgaccttcgacgacgtggccctgtacttcagcgagcaggagtgggagatcctggagaagtggcagaagcagatgtacaagcaggagatgaagaccaactacgagaccctggacagcctgggctacgccttcagcaagcccgacctgatcacctggatggagcagggcagaatgctgctgatcagcgagcagggctgcctggacaagaccagaagaaccaccagcccccccaccgacgagcagctgaacatgaagaacaccggcaagctgctgtgcttcgacgacgagggcacccccagaaccaaggaggaggactgcagactgaacggcccccagaagcaggacctgtgcgccgccctgagaggcaaggagagaaagatcctgctggcccagaccgccaccttccagagccccagcctgagagagaccgagatcctgaacaagaaggtgagcatcaccgcctacgaccccgacaagaaggacctgagacacaagcccagagagacccccggcagactggagatccccaccggccccagatgctacagctgctacgtgtgcagaaaggtgttccaggtgagaagagacctgctgaagcacaagagaagccacagcaagagccagctgtgcagataccccaagtacaagaacagcagcagaggcaagagcgagctgagaagaacccagagactgctgtgccagaagaagagattccagtgcagcgagtgcgagaagagctacttcctgaagggcagcctggtgacccaccaggtggtgcacaccggccagagaccctacccctgccccgagtgcgacaagaccttcagatacagagccaacctgaagaagcacctgtgcctgcacagaggcgagagacccttctgctgcggcgagtgcggcagagccttcgtgcagcagtgcgagctgaccgagcacctgagactgcacagcggcgagaagcccttccagtgcccccagtgcgacagatgcttcagactgaagagaggcatgaaggtgcacctgacccagcacagcggcaagagacccttccactgccccgagtgcggcagaagcttcagcagaaaggccgccctgaagacccaccagagaacccacagcgaggagaagcccttcagctgcggcgagtgcggcagaaagttcatctacaagatcaagctggacgagcacatcagagtgcacaccggcgagaagcccttcagctgccccgagtgcaacaagagcttcagactgaagagaagcctgaaggcccacggcctgcagcacatcggcaagagacccttccagtgccccgagtgcagcagaggcttcttctggagaaacgccatgagagcccaccagagactgcacagcgagcagaagcccttcccctgcgccgagtgcggcaagagattcaccagacccagcaagctggcctgccacaccagagtgcacgacagacagaaggagttcccctgcggcgagtgcaagaagaccttcagccagcagagcagactgacccagcacctgaaggtgcacaccaccgagaagcccttcagctgcgccgagtgcggcagaagcttcagaagaagagcccacctgaccgagcacaccagactgcacagcggcgaggagcccttccagtgccccgagtgcgacaagagcttcagctggaaggccagcatgaagttccaccagagaatgcacagagacgagaagcccttcgcctgcggcgagtgcgacaagacctacacccaccagagccagctgaccgagcacctgagactgcacagcggcgagaagccctaccagtgccccgagtgcgagaagaccttcagactgaagggcaacctgaagagccacctgctgcagcacagcggccagaagcccttcagctgcgtgatgtgcggcaagagcttcacccagcagtacagactgaccgagcacatcagagtgcacagcggcgagaagcccttccagtgccccgagtgcgacaagagctactgcatcagaggcagcctgaaggtgcacctgtacaagcacagcggcgagagacccttccagtgccccgagtgcggcaagggcttcctgcagaagagaagcctgaaggcccacctgtgcctgcacagcggcgagagacccttcagctgcgacgagtgcggcagaagcttcacctacgtgggcgccctgaagacccacatcgccgtgcacgccaaggagaagcccagcagcctgtag

SEQ ID NO: 11053 - DNA, 1935 bp, Artificial Sequence
  Description of Artificial Sequence: Synthetic coding sequence
atgttcctgacctacatggagaccgtgaccaaggagctggtgagctggatgagaggccacgagagcagcgtgttcagcatcagcgtgcacgccagcggcaagtacgccatcaccaccagcagcgacaccgcccagctgtgggacctggacaccttccagagaaagagaaagctgaacatcagacagagcgtgggcatccagaaggtgttcttcctgcccctgagcaacaccatcctgagctgcttcaaggacaacagcatcttcgcctgggagtgcgacaccctgttctgcaagtaccagctgcccgccccccccgagagcagcagcatcctgtacaaggtgttcgccgtgaccagagacggcagaatcctggccgccggcggcaagagcaaccacctgcacctgtggtgcctggaggccagacagctgttcagaatcatccagatgcccaccaaggtgagagccatcagacacctggagttcctgcccgacagcttcgacgccggcagcaaccaggtgctgggcgtgctgagccaggacggcatcatgagattcatcaacatgcagacctgcaagctgctgttcgagatcggcagcctggacgagggcatcagcagcagcgccatcagcccccacggcagatacatcgccagcatcatggagaacggcagcctgaacatctacagcgtgcaggccctgacccaggagatcaacaagccccccccccccctggtgaaggtgatcgaggacctgcccaagaacaagctgagcagcagcgacctgaagatgaaggtgaccagcggcagagtgcagcagcccgccaagagcagagagagcaagatgcagaccagaatcctgaagcaggacctgaccggcgacttcgagagcaagaagaacgagctgcccgacggcctgaacaagaagagactgcagatcctgctgaagggctacggcgagtaccccaccaagtacagaatgttcatctggagaagcctgctgcagctgcccgagaaccacaccgccttcagcaccctgatcgacaagggcacccacgtggccttcctgaacctgcagaagaagtaccccatcaagagcagaaagctgctgagagtgctgcagagaaccctgagcgccctggcccactggagcgtgatcttcagcgacaccccctacctgcccctgctggccttccccttcgtgaagctgttccagaacaaccagctgatctgcttcgaggtgatcgccaccctgatcatcaactggtgccagcactggttcgagtacttccccaacccccccatcaacatcctgagcatgatcgagaacgtgctggccttccacgacaaggagctgctgcagcacttcatcgaccacgacatcaccagccagctgtacgcctggcccctgctggagaccgtgttcagcgaggtgctgaccagagaggagtggctgaagctgttcgacaacatcttcagcaaccaccccagcttcctgctgatgaccgtggtggcctacaacatctgcagcagaacccccctgctgagctgcaacctgaaggacgacttcgagttcttcttccaccacagaaacaacctggacatcaacgtggtgatcagacaggtgtaccacctgatggagaccacccccaccgacatccaccccgacagcatgctgaacgtgttcgtggccctgaccaagggccagtaccccgtgttcaaccagtaccccaagttcatcgtggactaccagacccaggagagagagagaatcagaaacgacgagctggactacctgagagagagacagctgaagatctgcaagctgaagagcaccagcaaggagctgaagatgaagctgggcaccagaaacagaagctgcttcgtgaagctgaagaagcaggaggagaagtgcagctacaagagaagaagaaagtag

SEQ ID NO: 11054 - DNA, 735 bp, Artificial Sequence
  Description of Artificial Sequence: Synthetic coding sequence
atgccccacaagatcggcttcgtggtggtgagcagcagcggccacgaggacggcttcagcgccagagagctgatgatccacgcccccaccgtgagcggctggagaagccccagattctgccagttcccccaggagatcgtgctgcagatggtggagagatgcagaatcagaaagctgcagctgctggcccaccagtacatgatcagcagcaagatcgagttctacatcagcgagagcctgcccgagtacttcgccccctaccaggccgagagattcagaagactgggctacgtgagcctgtgcgacaacgagaagaccggctgcaaggccagagagctgaagagcgtgtacgtggacgccgtgggccagttcctgaagctgatcttccaccagaaccacgtgaacaagtacaacatctacaaccaggtggccctggtggccatcaacatcatcggcgaccccgccgacttcagcgacgagagcaacaccgccagcagagagaagctgatcgaccactacctgggccacaacagcgaggaccccgccctggagggcacctacgccagcagcgtgagaaccggcggcgagagcaccttcggcgagctgaagggccccgccgtgcccagcagcgtgaccctgagcgtgctgggcaccagcctgggccagtggttcccctgccacctgcccgccgtggacgacaacgagggcacccccttccagagatgcctggtgtag

SEQ ID NO: 11055 - DNA, 2778 bp, Artificial Sequence
  Description of Artificial Sequence: Synthetic coding sequence
atgccccacaagatcggcttcgtggtggtgagcagcagcggccacgaggacggcttcagcgccagagagctgatgatccacgcccccaccgtgagcggctggagaagccccagattctgccagttcccccaggagatcgtgctgcagatggtggagagatgcagaatcagaaagctgcagctgctggcccaccagtacatgatcagcagcaagatcgagttctacatcagcgagagcctgcccgagtacttcgccccctaccaggccgagagattcagaagactgggctacgtgagcctgtgcgacaacgagaagaccggctgcaaggccagagagctgaagagcgtgtacgtggacgccgtgggccagttcctgaagctgatcttccaccagaaccacgtgaacaagtacaacatctacaaccaggtggccctggtggccatcaacatcatcggcgaccccgccgacttcagcgacgagagcaacaccgccagcagagagaagctgatcgaccactacctgggccacaacagcgaggaccccgccctggagggcacctacgccagaaagagcgactacatcagccccctggacgacctggccttcgacatgtaccaggaccccgaggtggcccagatcatcagaaagctggacgagagaaagagagaggccgtgcagaaggagagatacgactacgccaagaagctgaagcaggccatcgccgacctgcagaaggtgggcgagagactgggcagatacgaggtggagaagagatgcgccgtggagaaggaggactacgacctggccaaggagaagaagcagcagatggagcagtacagagccgaggtgtacgagcagctggagctgcacagcctgctggacgccgagctgatgagaagacccttcgacctgcccctgcagcccctggccagaagcggcagcccctgccaccagaagcccatgcccagcctgccccagctggaggagagaggcaccgagaaccagttcgccgagcccttcctgcaggagaagcccagcagctacagcctgaccatcagcccccagcacagcgccgtggaccccctgctgcccgccaccgacccccaccccaagatcaacgccgagagcctgccctacgacgagagacccctgcccgccatcagaaagcactacggcgaggccgtggtggagcccgagatgagcaacgccgacatcagcgacgccagaagaggcggcatgctgggcgagcccgagcccctgaccgagaaggccctgagagaggccagcagcgccatcgacgtgctgggcgagaccctggtggccgaggcctactgcaagacctggagctacagagaggacgccctgctggccctgagcaagaagctgatggagatgcccgtgggcacccccaaggaggacctgaagaacaccctgagagccagcgtgttcctggtgagaagagccatcaaggacatcgtgaccagcgtgttccaggccagcctgaagctgctgaagatgatcatcacccagtacatccccaagcacaagctgagcaagctggagaccgcccactgcgtggagagaaccatccccgtgctgctgaccagaaccggcgacagcagcgccagactgagagtgaccgccgccaacttcatccaggagatggccctgttcaaggaggtgaagagcctgcagatcatccccagctacctggtgcagcccctgaaggccaacagcagcgtgcacctggccatgagccagatgggcctgctggccagactgctgaaggacctgggcaccggcagcagcggcttcaccatcgacaacgtgatgaagttcagcgtgagcgccctggagcacagagtgtacgaggtgagagagaccgccgtgagaatcatcctggacatgtacagacagcaccaggccagcatcctggagtacctgccccccgacgacagcaacaccagaagaaacatcctgtacaagaccatcttcgagggcttcgccaagatcgacggcagagccaccgacgccgagatgagagccagaagaaaggccgccaccgaggaggccgagaagcagaagaaggaggagatcaaggccctgcagggccagctggccgccctgaaggagatccaggccgaggtgcaggagaaggagagcgacgccgtgaagcccaagaaccaggacatccagggcggcaaggccgcccccgccgaggccctgggcatccccgacgagcactacctggacaacctgtgcatcttctgcggcgagagaagcgagagcttcaccgaggagggcctggacctgcactactggaagcactgcctgatgctgaccagatgcgaccactgcaagcaggtggtggagatcagcagcctgaccgagcacctgctgaccgagtgcgacaagaaggacggcttcggcaagtgctacagatgcagcgaggccgtgttcaaggaggagctgcccagacacatcaagcacaaggactgcaaccccgccaagcccgagaagctggccaacagatgccccctgtgccacgagaacttcagccccggcgaggaggcctggaaggcccacctgatgggccccgccggctgcaccatgaacctgagaaagacccacatcctgcagaaggcccccgccctgcagcccggcaagagcagcgccgtggccgccagcggccccctgggcagcaaggccggcagcaagatccccacccccaagggcggcctgagcaagagcagcagcagaacctacgccaagagatag

SEQ ID NO: 11056 - DNA, 2145 bp, Artificial Sequence
  Description of Artificial Sequence: Synthetic coding sequence
atggccagagccggcagctgcggcggcgccgccgccggcgccggcagacccgagccctgggagctgagcctggaggaggtgctgaaggcctacgagcagcccctgaacgaggagcaggcctgggccgtgtgcttccagggctgcagaggcctgagaggcagccccggcagaagactgagagacaccggcgacctgctgctgagaggcgacggcagcgtgggcgccagagagcccgaggccgccgagcccgccaccatggtggtgcccctggccagcagcgaggcccagaccgtgcagagcctgggcttcgccatctacagagccctggactggggcctggacgagagcgaggagagagagctgagcccccagctggagagactgatcgacctgatggccaacaacgacagcgaggacagcggctgcggcgccgccgacgagggctacggcggccccgaggaggaggaggaggccgagggcgtgcccagaagcgtgagaaccttcgcccaggccatgagactgtgcgccgccagactgaccgaccccagaggcgcccaggcccactaccaggccgtgtgcagagccctgttcgtggagaccctggagctgagagccttcctggccagagtgagagaggccaaggagatgctgcagaagctgagagaggacgagccccacctggagacccccagagccgagctggacagcctgggccacaccgactgggccagactgtgggtgcagctgatgagagagctgagaagaggcgtgaagctgaagaaggtgcaggagcaggagttcaaccccctgcccaccgagttccagctgacccccttcgagatgctgatgcaggacatcagagccagaaactacaagctgagaaaggtgatggtggacggcgacatcccccccagagtgaagaaggacgcccacgagctgatcctggacttcatcagaagcagaccccccctgaagcaggtgagcgagagaagactgagacccctgccccccaagcagagaagcctgcacgagaagatcctggaggagatcaagcaggagagaagactgagacccgtgagaggcgagggctgggccgccagaggcttcggcagcctgccctgcatcctgaacgcctgcagcggcgacgccaagagcaccagctgcatcaacctgagcgtgaccgacgccggcggcagcgcccagagacccagacccagagtgctgctgaaggcccccaccctggccgagatggaggagatgaacaccagcgaggaggaggagagcccctgcggcgaggtgaccctgaagagagacagaagcttcagcgagcacgacctggcccagctgagaagcgaggtggccagcggcctgcagagcgccacccacccccccggcggcaccgagccccccagacccagagccggcagcgcccacgtgtggagacccggcagcagagaccagggcacctgccccgccagcgtgagcgaccccagccaccccctgctgagcaacagaggcagcagcggcgacagacccgaggccagcatgacccccgacgccaagcacctgtggctggagttcagccaccccgtggagagcctggccctgaccgtggaggaggtgatggacgtgagaagagtgctggtgaaggccgagatggagaagttcctgcagaacaaggagctgttcagcagcctgaagaagggcaagatctgctgctgctgcagagccaagttccccctgttcagctggccccccagctgcctgttctgcaagagagccgtgtgcaccagctgcagcatcaagatgaagatgcccagcaagaagttcggccacatccccgtgtacaccctgggcttcgagagcccccagagagtgagcgccgccaagaccgcccccatccagagaagagacatcttccagagcctgcagggcccccagtggcagagcgtggaggaggccttcccccacatctacagccacggctgcgtgctgaaggacgtgtgcagcgagtgcaccagcttcgtggccgacgtggtgagaagcagcagaaagagcgtggacgtgctgaacaccacccccagaagaagcagacagacccagagcctgtacatccccaacaccagaaccctggacttcaagtag

SEQ ID NO: 11057 - DNA, 1308 bp, Artificial Sequence
  Description of Artificial Sequence: Synthetic coding sequence
atgaacttcagcgaggtgttcaagctgagcagcctgctgtgcaagttcagccccgacggcaagtacctggccagctgcgtgcagtacagactggtggtgagagacgtgaacaccctgcagatcctgcagctgtacacctgcctggaccagatccagcacatcgagtggagcgccgacagcctgttcatcctgtgcgccatgtacaagagaggcctggtgcaggtgtggagcctggagcagcccgagtggcactgcaagatcgacgagggcagcgccggcctggtggccagctgctggagccccgacggcagacacatcctgaacaccaccgagttccacctgagaatcaccgtgtggagcctgtgcaccaagagcgtgagctacatcaagtaccccaaggcctgcctgcagggcatcaccttcaccagagacggcagatacatggccctggccgagagaagagactgcaaggactacgtgagcatcttcgtgtgcagcgactggcagctgctgagacacttcgacaccgacacccaggacctgaccggcatcgagtgggcccccaacggctgcgtgctggccgtgtgggacacctgcctggagtacaagatcctgctgtacagcctggacggcagactgctgagcacctacagcgcctacgagtggagcctgggcatcaagagcgtggcctggagccccagcagccagttcctggccgtgggcagctacgacggcaaggtgagaatcctgaaccacgtgacctggaagatgatcaccgagttcggccaccccgccgccatcaacgaccccaagatcgtggtgtacaaggaggccgagaagagcccccagctgggcctgggctgcctgagcttccccccccccagagccggcgccggccccctgcccagcagcgagagcaagtacgagatcgccagcgtgcccgtgagcctgcagaccctgaagcccgtgaccgacagagccaaccccaagatcggcatcggcatgctggccttcagccccgacagctacttcctggccaccagaaacgacaacatccccaacgccgtgtgggtgtgggacatccagaagctgagactgttcgccgtgctggagcagctgagccccgtgagagccttccagtgggacccccagcagcccagactggccatctgcaccggcggcagcagactgtacctgtggagccccgccggctgcatgagcgtgcaggtgcccggcgagggcaagcacatccccgaggccaccgacgtggccgccctgctgtgcgccgtgtggcaccacaccggctag

SEQ ID NO: 11058 - DNA, 819 bp, Artificial Sequence
  Description of Artificial Sequence: Synthetic coding sequence
atgctgcagctgagagacagcgtggacagcgccggcaccagccccaccgccgtgctggccgccggcgaggaggtgggcgccggcggcggccccggcggcggcagacccggcgccggcacccccctgagacagaccctgtggcccctgagcatccacgaccccaccagaagagccagagtgaaggagtacttcgtgttcagacccggcagcatcgagcaggccgtggaggagatcagagtggtggtgagacccgtggaggacggcgagatccagggcgtgtggctgctgaccgaggtggaccactggaacaacgagaaggagagactggtgctggtgaccgagcagagcctgctgatctgcaagtacgacttcatcagcctgcagtgccagcaggtggtgagaatcgccctgaacgccgtggacaccatcagctacggcgagttccagttcccccccaagagcctgaacaagagagagggcttcggcatcagaatccagtgggacaagcagagcagacccagcttcatcaacagatggaacccctggagcaccaacgtgccctacgccaccttcaccgagcaccccatggccggcgccgacgagaagaccgccagcctgtgccagctggagagcttcaaggccctgctgatccaggccgtgaagaaggcccagaaggagagccccctgcccggccaggccaacggcgtgctgatcctggagagacccctgctgatcgagacctacgtgggcctgatgagcttcatcaacaacgaggccaagctgggctacagcatgaccagaggcaagatcggcttctag

SEQ ID NO: 11059 - DNA, 870 bp, Artificial Sequence
  Description of Artificial Sequence: Synthetic coding sequence
atgtggcccttccccagcagaagcctgttccccccccccacccaggcctggctgcagaccgtgagcagcgaccccgaggcccagggctggggcgcctggaacgagaccaaggagatcctgggccccgagggcggcgagggcaaggaggagaaggaggaggaggaggacgccgaggaggaccaggacggcgacgccggcttcctgctgagcctgctggagcaggagaacctggccgagtgccccctgcccgaccaggagctggaggccatcaagatgaaggtgtgcgccatggagcaggccgagggcacccccagaccccccggcgtgcagcagcaggccgaggaggaggagggcaccgccgccggccagctgctgagccccgagaccgtgggctgccccctgagcggcacccccgaggagaaggtggaggccgaccacagaagcgtgtacgtgggcaacgtggactacggcggcagcgccgaggagctggaggcccacttcagcagatgcggcgaggtgcacagagtgaccatcctgtgcgacaagttcagcggccaccccaagggctacgcctacatcgagttcgccaccaagggcagcgtgcaggccgccgtggagctggaccagagcctgttcagaggcagagtgatcaaggtgctgcccaagagaaccaacttccccggcatcagcagcaccgacagaggcggcctgagaggccaccccggcagcagaggcgcccccttcccccacagcggcctgcagggcagacccagactgagaccccagggccagaacagaacccccgccgccctgacccccctgtgggccagacccctgccctgggtggtggtgagccacgtgatcaagtag

SEQ ID NO: 11060 - DNA, 1266 bp, Artificial Sequence
  Description of Artificial Sequence: Synthetic coding sequence
atgttcgagatcctgaccagcgagttcagctaccagcacagcctgagcatcctggtggaggagttcctgcagagcaaggagctgagagccaccgtgacccagatggagcaccaccacctgttcagcaacatcctggacgtgctgggcgccagccagagattcttcgaggacctggagcagagacacaaggcccaggtgctggtggaggacatcagcgacatcctggaggagcacgccgagaagcacttccacccctacatcgcctactgcagcaacgaggtgtaccagcagagaaccctgcagaagctgatcagcagcaacgccgccttcagagaggccctgagagagatcgagagaagacccgcctgcggcggcctgcccatgctgagcttcctgatcctgcccatgcagagagtgaccagactgcccctgctgatggacaccctgtgcctgaagacccagggccacagcgagagatacaaggccgccagcagagccctgaaggccatcagcaagctggtgagacagtgcaacgagggcgcccacagaatggagagaatggagcagatgtacaccctgcacacccagctggacttcagcaaggtgaagagcctgcccctgatcagcgccagcagatggctgctgaagagaggcgagctgttcctggtggaggagaccggcctgttcagaaagatcgccagcagacccacctgctacctgttcctgttcaacgacgtgctggtggtgaccaagaagaagagcgaggagagctacatggtgcaggactacgcccagatgaaccacatccaggtggagaagatcgagcccagcgagctgcccctgcccggcggcggcaacagaagcagcagcgtgccccaccccttccaggtgaccctgctgagaaacagcgagggcagacaggagcagctgctgctgagcagcgacagcgccagcgacagagccagatggatcgtggccctgacccacagcgagagacagtggcagggcctgagcagcaagggcgacctgccccaggtggagatcaccaaggccttcttcgccaagcaggccgacgaggtgaccctgcagcaggccgacgtggtgctggtgctgcagcaggaggacggctggctgtacggcgagagactgagagacggcgagaccggctggttccccgaggacttcgccagattcatcaccagcagagtggccgtggagggcaacgtgagaagaatggagagactgagagtggagaccgacgtgtag

SEQ ID NO: 11061 - DNA, 1266 bp, Artificial Sequence; identical to SEQ ID NO: 11060
  Description of Artificial Sequence: Synthetic coding sequence

SEQ ID NO: 11062 - DNA, 2130 bp, Artificial Sequence
  Description of Artificial Sequence: Synthetic coding sequence
atggcccagagacacagcgacagcagcctggaggagaagctgctgggccacagattccacagcgagctgagactggacgccggcggcaaccccgccagcggcctgcccatggtgagaggcagccccagagtgagagacgacgccgccttccagccccaggtgcccgcccccccccagcccagaccccccggccacgaggagccctggcccatcgtgctgagcaccgagagccccgccgccctgaagctgggcacccagcagctgatccccaagagcctggccgtggccagcaaggccaagacccccgccagacaccagagcttcggcgccgccgtgctgagcagagaggccgccagaagagaccccaagctgctgcccgcccccagcttcagcctggacgacatggacgtggacaaggaccccggcggcatgctgagaagaaacctgagaaaccagagctacagagccgccatgaagggcctgggcaagcccggcggccagggcgacgccatccagctgagccccaagctgcaggccctggccgaggagcccagccagccccacaccagaagccccgccaagaacaagaagaccctgggcagaaagagaggccacaagggcagcttcaaggacgacccccagctgtaccaggagatccaggagagaggcctgaacaccagccaggagagcgacgacgacatcctggacgagagcagcagccccgagggcacccagaaggtggacgccaccatcgtggtgaagagctacagacccgcccaggtgacctggagccagctgcccgaggtggtggagctgggcatcctggaccagctgagcaccgaggagagaaagagacaggaggccatgttcgagatcctgaccagcgagttcagctaccagcacagcctgagcatcctggtggaggagttcctgcagagcaaggagctgagagccaccgtgacccagatggagcaccaccacctgttcagcaacatcctggacgtgctgggcgccagccagagattcttcgaggacctggagcagagacacaaggcccaggtgctggtggaggacatcagcgacatcctggaggagcacgccgagaagcacttccacccctacatcgcctactgcagcaacgaggtgtaccagcagagaaccctgcagaagctgatcagcagcaacgccgccttcagagaggccctgagagagatcgagagaagacccgcctgcggcggcctgcccatgctgagcttcctgatcctgcccatgcagagagtgaccagactgcccctgctgatggacaccctgtgcctgaagacccagggccacagcgagagatacaaggccgccagcagagccctgaaggccatcagcaagctggtgagacagtgcaacgagggcgcccacagaatggagagaatggagcagatgtacaccctgcacacccagctggacttcagcaaggtgaagagcctgcccctgatcagcgccagcagatggctgctgaagagaggcgagctgttcctggtggaggagaccggcctgttcagaaagatcgccagcagacccacctgctacctgttcctgttcaacgacgtgctggtggtgaccaagaagaagagcgaggagagctacatggtgcaggactacgcccagatgaaccacatccaggtggagaagatcgagcccagcgagctgcccctgcccggcggcggcaacagaagcagcagcgtgccccaccccttccaggtgaccctgctgagaaacagcgagggcagacaggagcagctgctgctgagcagcgacagcgccagcgacagagccagatggatcgtggccctgacccacagcgagagacagtggcagggcctgagcagcaagggcgacctgccccaggtggagatcaccaaggccttcttcgccaagcaggccgacgaggtgaccctgcagcaggccgacgtggtgctggtgctgcagcaggaggacggctggctgtacggcgagagactgagagacggcgagaccggctggttccccgaggacttcgccagattcatcaccagcagagtggccgtggagggcaacgtgagaagaatggagagactgagagtggagaccgacgtgtag

SEQ ID NO: 11063 - DNA, 1287 bp, Artificial Sequence
  Description of Artificial Sequence: Synthetic coding sequence
atggtgtggcaggtgctggagggcctgagccaggacagcgccaagagactgagattcgtggccggcgtgatcttcgtggacgagggcgccgcctgcggccagagcctggaggagagaagcaagaccctggccgaggtgaagcccatcctgcaggccaccggcttcccctggcacgtggtggccctggaggaggtgttcagcctgccccccagcgtgctgtggtgcagcgcccaggagctggtgggcagcgagggcgcctacaaggccgccgtggacagcttcctgcagcagcagcacgtgctgggcgccggcggcggccccggccccacccagggcgaggagcagcccccccagccccccctggacccccagaacctggccagaccccccgcccccgcccagaccgaggccctgagccagctgttctgcagcgtgagaaccctgaccgccaaggaggagctgctgcagaccctgagaacccacctgatcctgcacatggccagagcccacggctacagcaaggtgatgaccggcgacagctgcaccagactggccatcaagctgatgaccaacctggccctgggcagaggcgccttcctggcctgggacaccggcttcagcgacgagagacacggcgacgtggtggtggtgagacccatgagagaccacaccctgaaggaggtggccttctacaacagactgttcagcgtgcccagcgtgttcacccccgccgtggacaccaaggcccccgagaaggccagcatccacagactgatggaggccttcatcctgagactgcagacccagttccccagcaccgtgagcaccgtgtacagaaccagcgagaagctggtgaagggccccagagacggccccgccgccggcgacagcggccccagatgcctgctgtgcatgtgcgccctggacgtggacgccgccgacagcgccaccgccttcggcgcccagaccagcagcagactgagccagatgcagagccccatccccctgaccgagaccagaaccccccccggcccctgctgcagccccggcgtgggctgggcccagagatgcggccagggcgcctgcagaagagaggacccccaggcctgcatcgaggagcagctgtgctacagctgcagagtgaacatgaaggacctgcccagcctggaccccctgcccccctacatcctggccgaggcccagctgagaacccagagagcctggggcctgcaggagatcagagactgcctgatcgaggacagcgacgacgaggccggccagagctag

SEQ ID NO: 11064 - DNA, 417 bp, Artificial Sequence
  Description of Artificial Sequence: Synthetic coding sequence
atgggcgagcaggccgacggcaaggacagcatcgccagacaggtggcccccgagagccactggcccgagctgagagtgctgatcctggtggtgagcgccgagaagaagctgaccggcagcaccgtgggcatgagagccagcgtggagaccagccccctgctgagattcagagccgagagcgtggtgcccgcccacggcggcgacggccccctgcaccccggcgccagactgccccagctgagacccgccgaccacgagggccagcagcccgtgcccagacacctgcccagacacctgccccccagcctgaccagcatgcccagccccggcgccagcagcacctggtgcaccgccagcacccccaccaccggcacccccagatggagaacccccctgaccagagcccccatgccctag

SEQ ID NO: 11065 - DNA, 597 bp, Artificial Sequence
  Description of Artificial Sequence: Synthetic coding sequence
atgagcaccgtggacctggccagagtgggcgcctgcatcctgaagcacgccgtgaccggcgaggccgtggagctgagaagcctgtggagagagcacgcctgcgtggtggccggcctgagaagattcggctgcgtggtgtgcagatggatcgcccaggacctgagcagcctggccggcctgctggaccagcacggcgtgagactggtgggcgtgggccccgaggccctgggcctgcaggagttcctggacggcgactacttcgccggcgagctgtacctggacgagagcaagcagctgtacaaggagctgggcttcaagagatacaacagcctgagcatcctgcccgccgccctgggcaagcccgtgagagacgtggccgccaaggccaaggccgtgggcatccagggcaacctgagcggcgacctgctgcagagcggcggcctgctggtggtgagcaagggcggcgacaaggtgctgctgcacttcgtgcagaagagccccggcgactacgtgcccaaggagcacatcctgcaggtgctgggcatcagcgccgaggtgtgcgccagcgaccccccccagtgcgacagagaggtgtag

SEQ ID NO: 11066 - DNA, 642 bp, Artificial Sequence
  Description of Artificial Sequence: Synthetic coding sequence
tgaagcagagagagaggcagcagaagcgaggagcccggcgccggcaacagagagagcggcagcagagagcccggcctggccgccgccgccatgagcaccgtggacctggccagagtgggcgcctgcatcctgaagcacgccgtgaccggcgaggccgtggagctgagaagcctgtggagagagcacgcctgcgtggtggccggcctgagaagattcggctgcgtggtgtgcagatggatcgcccaggacctgagcagcctggccggcctgctggaccagcacggcgtgagactggtgggcgtgggccccgaggccctgggcctgcaggagttcctggacggcgactacttcgccggcgagctgtacctggacgagagcaagcagctgtacaaggagctgggcttcaagagatacaacagcctgagcatcctgcccgccgccctgggcaagcccgtgagagacgtggccgccaaggccaaggccgtgggcatccagggcaacctgagcggcgacctgctgcagagcggcggcctgctggtggtgagcaaggaggtgcccagaagactgagaccccagggcgcccaccccgccggccccggccacctgtgcggcggcctgtgccagagacccgccagcgtgtag

SEQ ID NO: 11067 - DNA, 2553 bp, Artificial Sequence
  Description of Artificial Sequence: Synthetic coding sequence
atggccgaggtggaggccgtgcagctgaaggaggagggcaacagacacttccagctgcaggactacaaggccgccaccaacagctacagccaggccctgaagctgaccaaggacaaggccctgctggccaccctgtacagaaacagagccgcctgcggcctgaagaccgagagctacgtgcaggccgccagcgacgccagcagagccatcgacatcaacagcagcgacatcaaggccctgtacagaagatgccaggccctggagcacctgggcaagctggaccaggccttcaaggacgtgcagagatgcgccaccctggagcccagaaaccagaacttccaggagatgctgagaagactgaacaccagcatccaggagaagctgagagtgcagttcagcaccgacagcagagtgcagaagatgttcgagatcctgctggacgagaacagcgaggccgacaagagagagaaggccgccaacaacctgatcgtgctgggcagagaggaggccggcgccgagaagatcttccagaacaacggcgtggccctgctgctgcagctgctggacaccaagaagcccgagctggtgctggccgccgtgagaaccctgagcggcatgtgcagcggccaccaggccagagccaccgtgatcctgcacgccgtgagaatcgacagaatctgcagcctgatggccgtggagaacgaggagatgagcctggccgtgtgcaacctgctgcaggccatcatcgacagcctgagcggcgaggacaagagagagcacagaggcaaggaggaggccctggtgctggacaccaagaaggacctgaagcagatcaccagccacctgctggacatgctggtgagcaagaaggtgagcggccagggcagagaccaggccctgaacctgctgaacaagaacgtgcccagaaaggacctggccatccacgacaacagcagaaccatctacgtggtggacaacggcctgagaaagatcctgaaggtggtgggccaggtgcccgacctgcccagctgcctgcccctgaccgacaacaccagaatgctggccagcatcctgatcaacaagctgtacgacgacctgagatgcgaccccgagagagaccacttcagaaagatctgcgaggagtacatcaccggcaagttcgacccccaggacatggacaagaacctgaacgccatccagaccgtgagcggcatcctgcagggccccttcgacctgggcaaccagctgctgggcctgaagggcgtgatggagatgatggtggccctgtgcggcagcgagagagagaccgaccagctggtggccgtggaggccctgatccacgccagcaccaagctgagcagagccaccttcatcatcaccaacggcgtgagcctgctgaagcagatctacaagaccaccaagaacgagaagatcaagatcagaaccctggtgaccagcgacaagaccatcctgtacagcgtggccaccaccctggtgaactgcaccaacagctacgacgtgaaggaggtgatccccgagctggtgcagctggccaagttcagcaagcagcacgtgcccgaggagcaccccaaggacaagaaggacttcatcgacatgagagtgaagagactgctgaaggccggcgtgatcagcgccctggcctgcatggtgaaggccgacagcgccatcctgaccgaccagaccaaggagctgctggccagagtgttcctggccctgtgcgacaaccccaaggacagaggcaccatcgtggcccagggcggcggcaaggccctgatccccctggccctggagggcaccgacgtgggcaaggtgaaggccgcccacgccctggccaagatcgccgccgtgagcaaccccgacatcgccttccccggcgagagagtgtacgaggtggtgagacccctggtgagactgctggacacccagagagacggcctgcagaactacgaggccctgctgggcctgaccaacctgagcggcagaagcgacaagctgagacagaagatcttcaaggagagagccctgcccgacatcgagaactacatgttcgagaaccacgaccagctgagacaggccgccaccgagtgcatgtgcaacatggtgctgcacaaggaggtgcaggagagattcctggccgacggcaacgacagactgaagctggtggtgctgctgtgcggcgaggacgacgacaaggtgcagaacgccgccgccggcgccctggccatgctgaccgccgcccacaagaagctgtgcctgaagatgacccaggtgaccacccagtggctggagatcctgcagagactgtgcctgcacgaccagctgagcgtgcagcacagaggcctggtgatcgcctacaacctgctggccgccgacgccgagctggccaagaagctggtggagagcgagctgctggagatcctgaccgtggtgggcaagcaggagcccgacgagaagaaggccgaggtggtgcagaccgccagagagtgcctgatcaagtgcatggactacggcttcatcaagcccgtgagctag

SEQ ID NO: 11068 - DNA, 552 bp, Artificial Sequence; identical to SEQ ID NO: 10168
  Description of Artificial Sequence: Synthetic coding sequence

SEQ ID NO: 11069 - DNA, 366 bp, Artificial Sequence
  Description of Artificial Sequence: Synthetic coding sequence
atgttcaacaagtgcagcttccacagcagcatctacagacccgccgccgacaacagcgccagcagcctgtgcgccatcatctgcttcctgaacctggtgatcgagtgcgacctggagaccaacagcgagatcaacaagctgatcatctacctgttcagccagaacaacagaatcagattcagcaagctgctgctgaagatcctgttctacatcagcatcttcagctaccccgagctgatgtgcgagcagtacgtgaccttcatcaagcccggcatccactacggccaggtgagcaagaagcacatcatctacagcaccttcctgagcaagaacttcaagttccagctgctgagagtgtgctggtag

SEQ ID NO: 11070 - DNA, 972 bp, Artificial Sequence
  Description of Artificial Sequence: Synthetic coding sequence
atggagagcagagtggccgacgccggcaccggcgagaccgccagagccgccggcggcagccccgccgtgggctgcaccaccagaggccccgtggtgagcgcccccctgggcgccgccagatggaagctgctgagacaggtgctgaagcagaagcacctggacgactgcctgagacacgtgagcgtgagaagattcgagagcttcaacctgttcagcgtgaccgagggcaaggagagagagaccgaggaggaggtgggcgcctgggtgcagtacaccagcatcttctgccccgagtacagcatcagcctgagacacaacagcggcagcctgaacgtggaggacgtgctgaccagcttcgacaacaccggcaacgtgtgcatctggcccagcgaggaggtgctggcctactactgcctgaagcacaacaacatcttcagagccctggccgtgtgcgagctgggcggcggcatgacctgcctggccggcctgatggtggccatcagcgccgacgtgaaggaggtgctgctgaccgacggcaacgagaaggccatcagaaacgtgcaggacatcatcaccagaaaccagaaggccggcgtgttcaagacccagaagatcagcagctgcgtgctgagatgggacaacgagaccgacgtgagccagctggagggccacttcgacatcgtgatgtgcgccgactgcctgttcctggaccagtacagagccagcctggtggacgccatcaagagactgctgcagcccagaggcaaggccatggtgttcgcccccagaagaggcaacaccctgaaccagttctgcaacctggccgagaaggccggcttctgcatccagagacacgagaactacgacgagcacatcagcaacttccacagcaagctgaagaaggagaaccccgacatctacgaggagaacctgcactaccccctgctgctgatcctgaccaagcacggctag

SEQ ID NO: 11071 - DNA, 3120 bp, Artificial Sequence; identical to SEQ ID NO: 10450
  Description of Artificial Sequence: Synthetic coding sequence

SEQ ID NO: 11072 - DNA, 390 bp, Artificial Sequence
  Description of Artificial Sequence: Synthetic coding sequence
atgtacagacagagattcctgtacagcctgtacagacacacccactgggtgagatgcgccaagttcagccccgacggcagactgatcgtgagctgcagcgaggacaagaccatcaagatctgggacaccaccaacaagcagtgcgtgaacaacttcagcgacagcgtgggcgacctgagcctgctgttccacttccagaaggtggagagctacctgcaccaggaggtgcagacccacagaagctactacggcggcctgaccctgatgaactgcatcgtgaaggtgctgcccaaggagatcagcaaggactacatcctgatccaccaccacatcttcctgatcagcacccaggagcaccacatccccatgagaaagaagctgagactgtag

SEQ ID NO: 11073 - DNA, 2178 bp, Artificial Sequence
  Description of Artificial Sequence: Synthetic coding sequence
atgcaccccgagcccagcgagcccgccaccggcggcgccgccgagctggactgcgcccaggagcccggcgtggaggagagcgccggcgaccacggcagcgccggcagaggcggctgcaaggaggagatcaacgaccccaaggagatctgcgtgggcagcagcgacaccagctaccacagccagcagaagcagagcggcgacaacggcagcggcggccacttcgcccaccccagagaggacagagaggacagaggccccagaatgaccaagagcagcctgcagaagctgtgcaagcagcacaagctgtacatcacccccgccctgaacgacaccctgtacctgcacttcaagggcttcgacagaatcgagaacctggaggagtacaccggcctgagatgcctgtggctgcagagcaacggcatccagaagatcgagaacctggaggcccagaccgagctgagatgcctgttcctgcagatgaacctgctgagaaagatcgagaacctggagcccctgcagaagctggacgccctgaacctgagcaacaactacatcaagaccatcgagaacctgagctgcctgcccgtgctgaacaccctgcagatggcccacaaccacctggagaccgtggaggacatccagcacctgcaggagtgcctgagactgtgcgtgctggacctgagccacaacaagctgagcgaccccgagatcctgagcatcctggagagcatgcccgacctgagagtgctgaacctgatgggcaaccccgtgatcagacagatccccaactacagaagaaccgtgaccgtgagactgaagcacctgacctacctggacgacagacccgtgttccccaaggacagagcctgcgccgaggcctgggccagaggcggctacgccgccgagaaggaggagagacagcagtgggagagcagagagagaaagaagatcaccgacagcatcgaggccctggccatgatcaagcagagagccgaggagagaaagagacagagagagagccaggagagaggcgagatgaccagcagcgacgacggcgagaacgtgcccgccagcgccgagggcaaggaggagccccccggcgacagagagaccagacagaagatggagctgttcgtgaaggagagcttcgaggccaaggacgagctgtgccccgagaagcccagcggcgaggagccccccgtggaggccaagagagaggacggcggccccgagcccgagggcaccctgcccgccgagaccctgctgctgagcagccccgtggaggtgaagggcgaggacggcgacggcgagcccgagggcaccctgcccgccgaggccccccccccccccccccccgtggaggtgaagggcgaggacggcgaccaggagcccgagggcaccctgcccgccgagaccctgctgctgagcccccccgtgaaggtgaagggcgaggacggcgacagagagcccgagggcaccctgcccgccgaggcccccccccccccccccctgggcgccgccagagaggagcccaccccccaggccgtggccaccgagggcgtgttcgtgaccgagctggacggcaccagaaccgaggacctggagaccatcagactggagaccaaggagaccttctgcatcgacgacctgcccgacctggaggacgacgacgagaccggcaagagcctggaggaccagaacatgtgcttccccaagatcgaggtgatcagcagcctgagcgacgacagcgaccccgagctggactacaccagcctgcccgtgctggagaacctgcccaccgacaccctgagcaacatcttcgccgtgagcaaggacaccagcaaggccgccagagtgcccttcaccgacatcttcaagaaggaggccaagagagacctggagatcagaaagcaggacaccaagagccccagacccctgatccaggagctgagcgacgaggaccccagcggccagctgctgatgccccccacctgccagagagacgccgcccccctgaccagcagcggcgacagagacagcgacttcctggccgccagcagccccgtgcccaccgagagcgccgccaccccccccgagacctgcgtgggcgtggcccagcccagccaggccctgcccacctgggacctgaccgccttccccgcccccaaggccagctag

SEQ ID NO: 11074 - DNA, 957 bp, Artificial Sequence
  Description of Artificial Sequence: Synthetic coding sequence
tgaggcatcaacggcagcgagggcgacggcgccgagatcgccgagaagttcgtgttcttcatcggcagcaagaacggcggcaagaccaccatcatcctgagatgcctggacagagacgagccccccaagcccaccctggccctggagtacacctacggcagaagagccaagggccacaacacccccaaggacatcgcccacttctgggagctgggcggcggcaccagcctgctggacctgatcagcatccccatcaccggcgacaccctgagaaccttcagcctggtgctggtgctggacctgagcaagcccaacgacctgtggcccaccatggagaacctgctgcaggccaccaagagccacgtggacaaggtgatcatgaagctgggcaagaccaacgccaaggccgtgagcgagatgagacagaagatctggaacaacatgcccaaggaccaccccgaccacgagctgatcgaccccttccccgtgcccctggtgatcatcggcagcaagtacgacgtgttccaggacttcgagagcgagaagagaaaggtgatctgcaagaccctgagattcgtggcccactactacggcgccagcctgatgttcaccagcaagagcgaggccctgctgctgaagatcagaggcgtgatcaaccagctggccttcggcatcgacaagagcaagagcatctgcgtggaccagaacaagcccctgttcatcaccgccggcctggacagcttcggccagatcggcagcccccccgtgcccgagaacgacatcggcaagctgcacgcccacagccccatggagctgtggaagaaggtgtacgagaagctgttcccccccaagagcatcaacaccctgaaggacatcaaggaccccgccagagacccccagtacgccgagaacgaggtggacgagatgagaatccagaaggacctggtgctgagctag

SEQ ID NO: 11075 - DNA, 2559 bp, Artificial Sequence
  Description of Artificial Sequence: Synthetic coding sequence
atggaggccctgggccccggcggcgacagagccagccccgccagcagcaccagcagcctggacctgtggcacctgagcatgagagccgacagcgcctacagcagcttcagcgccgccagcggcggccccgagcccagaacccagagccccggcaccgacctgctgccctacctggactgggactacgtgagagtggtgtggggcggccccggccccgccccccccgacgccgccctgtgcaccagccccagacccagacccgccgtggccgccagaagcggcccccagcccaccgaggtgcccggcacccccggccccctgaacagacaggccacccccctgctgtacgccctggccgccgaggccgaggccgccgcccaggccgccgagccccccagcccccccgccagcagagccgcctacagacagagactgcagggcgcccagagaagagtgctgagagagaccagcttccagagaaaggagctgagaatgagcctgcccgccagactgagacccaccgtgcccgccagaccccccgccacccaccccagaagcgccagcctgagccaccccggcggcgagggcgagcccgccagaagcagagcccccgcccccggcaccgccggcagaggccccctggccaaccagcagagaaagtggtgcttcagcgagcccggcaagctggacagagtgggcagaggcggcggccccgccagagagtgcctgggcgaggcctgcagcagcagcggcctgcccggccccgagcccctggagttccagcaccccgccctggccaagttcgaggaccacgaggtgggctggctgcccgagacccagccccagggcagcatgaacctggacagcggcagcctgaagctgggcgacgccttcagacccgccagcagaagcagaagcgccagcggcgaggtgctgggcagctggggcggcagcggcggcaccatccccatcgtgcaggccgtgccccagggcgccgagacccccagacccctgttccagaccaagctgagcagattcctgccccagaaggaggccgccgtgatgtaccccgccgagctgccccagagcagccccgccgacagcgagcagagagtgagcgagacctgcatcgtgcccgcctggctgcccagcctgcccgacgaggtgttcctggaggaggcccccctggtgagaatgagaagcccccccgacccccacgccagccagggcccccccgccagcgtgcacgccagcgaccagccctacggcaccggcctgggccagagaaccggccaggtgaccgtgcccaccgagtaccccctgcacgagtgccccggcaccgccggcgccgacgactgctggcagggcgtgaacggcagcgtgggcatcagcagacccaccagccacacccccaccggcaccgccaacgacaacatccccaccatcgaccccaccggcctgaccaccaacccccccaccgccgccgagagcgacctgctgaagcccgtgcccgccgacgccctgggcctgagcggcaacgacacccccggccccagccacaacaccgccctggccagaggcaccggccagcccggcagcagacccacctggcccagccagtgcctggaggagctggtgcaggagctggccagactggaccccagcctgtgcgaccccctggccagccagcccagccccgagccccccctgggcctgctggacggcctgatccccctggccgaggtgagagccgccatgagacccgcctgcggcgaggccggcgaggaggccgccagcaccttcgagcccggcagctaccagttcagcttcacccagctgctgcccgcccccagagaggagaccagactggagaaccccgccacccaccccgtgctggaccagccctgcggccagggcctgcccgcccccaacaacagcatccagggcaagaaggtggagctggccgccagactgcagaagatgctgcaggacctgcacaccgagcaggagagactgcagggcgaggcccaggcctgggccagaagacaggccgccctggaggccgccgtgagacaggcctgcgccccccaggagctggagagattcagcagattcatggccgacctggagagagtgctgggcctgctgctgctgctgggcagcagactggccagagtgagaagagccctggccagagccgccagcgacagcgaccccgacgagcaggccagcctgctgcagagactgagactgctgcagagacaggaggaggacgccaaggagctgaaggagcacgtggccagaagagagagagccgtgagagaggtgctggtgagagccctgcccgtggaggagctgagagtgtactgcgccctgctggccggcaaggccgccgtgctggcccagcagagaaacctggacgagagaatcagactgctgcaggaccagctggacgccatcagagacgacctgggccaccacgcccccagccccagccccgccagaccccccggcacctgcccccccgtgcagccccccttccccctgctgctgacctag

SEQ ID NO: 11076 - DNA, 1776 bp, Artificial Sequence
  Description of Artificial Sequence: Synthetic coding sequence
atggcccagggcagcgtgagcttcaacgacgtgaccgtggacttcacccaggaggagtggcagcacctggaccacgcccagaagaccctgtacatggacgtgatgctggagaactactgccacctgatcagcgtgggctgccacatgaccaagcccgacgtgatcctgaagctggagagaggcgaggagccctggaccagcttcgccggccacacctgcctggaggagaactggaaggccgaggacttcctggtgaagttcaaggagcaccaggagaagtacagcagaagcgtggtgagcatcaaccacaagaagctggtgaaggagaagagcaagatctacgagaagaccttcaccctgggcaagaaccccgtgaacagcaagaacctgccccccgagtacgacacccacggcagaatcctgaagaacgtgagcgagctgatcatcagcaacctgaaccccgccagaaagagactgagcgagtacaacggctacggcaagagcctgctgagcaccaagcaggagaccacccaccccgaggtgaagagccacaaccagagcgccagagccttcagccacaacgaggtgctgatgcagtaccagaagaccgagacccccgcccagagcttcggctacaacgactgcgagaagagcttcctgcagagaggcggcctgatcacccacagcagaccctacaagggcgagaaccccagcgtgtacaacaagaagagaagagccaccaacatcgagaagaagcacacctgcaacgagtgcggcaagagcttctgcagaaagagcgtgctgatcctgcaccagggcatccacagcgaggagaagccctaccagtgccaccagtgcggcaacgccttcagaagaaagagctacctgatcgaccaccagagaacccacaccggcgagaagccctacgagtgcaacgactgcggcaagagcttcagacagaagaccaccctgagcctgcaccagagaatccacaccggcgagaagccctacatctgcaaggagtgcggcaagagcttccaccagaaggccaacctgaccgtgcaccagagaacccacaccggcgagaagccctacatctgcaacgagtgcggcaagagcttcagccagaagaccaccctggccctgcacgagaagacccacaacgaggagaagccctacatctgcagcgagtgcggcaagagcttcagacagaagaccaccctggtggcccaccagagaacccacaccggcgagaagagctacgagtgcccccactgcggcaaggccttcagaatgaagagctacctgatcgaccaccacagaacccacaccggcgagaagccctacgagtgcaacgagtgcggcaagagcttcagccagaagaccaacctgaacctgcaccagagaatccacaccggcgagaagccctacgtgtgcaacgagtgcggcaagagcttcagacagaaggccaccctgaccgtgcaccagaagatccacaccggccagaagagctacgagtgcccccagtgcggcaaggccttcagcagaaagagctacctgatccaccaccagagaacccacaccggcgagaagccctacaagtgcagcgagtgcggcaagtgcttcagacagaagaccaacctgatcgtgcaccagagaacccacaccggcgagaagccctacgtgtgcaacgagtgcggcaagagcttcagctacaagagaaacctgatcgtgcaccagagaacccacaagggcgagaacatcgagatgcagtag

SEQ ID NO: 11077 - DNA, 2934 bp, Artificial Sequence
  Description of Artificial Sequence: Synthetic coding sequence
atgggctggaagcccagcgaggccagaggccagagccagagcttccaggccagcggcctgcagcccagaagcctgaaggccgccagaagagccaccggcagacccgacagaagcagagccgccagacccaccatggaccccagcgcccacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcggcgagggcaagcccggcagagtggtggacatcagaggctgggacgtggagaccggcagaagcgtggccagcgtgacctgggccgacggcaccaccaacgtgtacagagtgggccacaagggcaaggtggacctgaagtgcgtgggcgaggccgccggcggcttctactacaaggaccacctgcccagactgggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagcaccacagcttctgggtgggcgacgtggtgagagtgatcggcgacctggacaccgtgaagagactgcaggccggccacggcgagtggaccgacgacatggcccccgccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 11078 - DNA, 2262 bp, Artificial Sequence
  Description of Artificial Sequence: Synthetic coding sequence
atggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagttcatcggccagaccggcaccgtgcacagaatcaccgacagaggcgacgtgagagtgcagttcaaccacgagaccagatggaccttccaccccggcgccctgaccaagcaccacagcttctgggtgggcgacgtggtgagagtgatcggcgacctggacaccgtgaagagactgcaggccggccacggcgagtggaccgacgacatggcccccgccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagtgagagcccaggacgaggaggtgcaccaggtgcccggcggcagacagcaggagaccgcccccagaagactgtag

SEQ ID NO: 11079 - DNA, 1161 bp, Artificial Sequence
  Description of Artificial Sequence: Synthetic coding sequence
atgggcaaggactactacaagatcctgggcatccccagcggcgccaacgaggacgagatcaagaaggcctacagaaagatggccctgaagtaccaccccgacaagaacaaggagcccaacgccgaggagaagttcaaggagatcgccgaggcctacgacgtgctgagcgaccccaagaagagaggcctgtacgaccagtacggcgaggagggcctgaagaccggcggcggcaccagcggcggcagcagcggcagcttccactacaccttccacggcgacccccacgccaccttcgccagcttcttcggcggcagcaaccccttcgacatcttcttcgccagcagcagaagcaccagacccttcagcggcttcgaccccgacgacatggacgtggacgaggacgaggaccccttcggcgccttcggcagattcggcttcaacggcctgagcagaggccccagaagagcccccgagcccctgtaccccagaagaaaggtgcaggacccccccgtggtgcacgagctgagagtgagcctggaggagatctaccacggcagcaccaagagaatgaagatcaccagaagaagactgaaccccgacggcagaaccgtgagaaccgaggacaagatcctgcacatcgtgatcaagagaggctggaaggagggcaccaagatcaccttccccaaggagggcgacgccacccccgacaacatccccgccgacatcgtgttcgtgctgaaggacaagccccacgcccacttcagaagagacggcaccaacgtgctgtacagcgccctgatcagcctgaaggaggccctgtgcggctgcaccgtgaacatccccaccatcgacggcagagtgatccccctgccctgcaacgacgtgatcaagcccggcaccgtgaagagactgagaggcgagggcctgcccttccccaaggtgcccacccagagaggcgacctgatcgtggagttcaaggtgagattccccgacagactgaccccccagaccagacagatcctgaagcagcagtacccccagcacagcctgcacagcatgtgcacccagctggacgtgcactggaccctggccaccttcagcaagatgcagaagaaggccaccggcttccaggagaacgtgcccgtgcccgaccccttctag

SEQ ID NO: 11080 - DNA, 1008 bp, Artificial Sequence
  Description of Artificial Sequence: Synthetic coding sequence
atgctgggcagcggcttcaaggccgagagactgagagtgaacctgagactggtgatcaacagactgaagctgctggagaagaagaagaccgagctggcccagaaggccagaaaggagatcgccgactacctggccgccggcaaggacgagagagccagaatcagagtggagcacatcatcagagaggactacctggtggaggccatggagatcctggagctgtactgcgacctgctgctggccagattcggcctgatccagagcatgaaggagctggacagcggcctggccgagagcgtgagcaccctgatctgggccgcccccagactgcagagcgaggtggccgagctgaagatcgtggccgaccagctgtgcgccaagtacagcaaggagtacggcaagctgtgcagaaccaaccagatcggcaccgtgaacgacagactgatgcacaagctgagcgtggaggccccccccaagatcctggtggagagatacctgatcgagatcgccaagaactacaacgtgccctacgagcccgacagcgtggtgatggccgaggccccccccggcgtggagaccgacctgatcgacgtgggcttcaccgacgacgtgaagaagggcggccccggcagaggcggcagcggcggcttcaccgcccccgtgggcggccccgacggcaccgtgcccatgcccatgcccatgcccatgcccatgcccagcgccaacacccccttcagctaccccctgcccaagggccccgtggacgacatcaacgccgacaagaacatcagcagcgcccagatcgtgggccccggccccaagcccgaggccagcgccaagctgcccagcagacccgccgacaactacgacaacttcgtgctgcccgagctgcccagcgtgcccgacaccctgcccaccgccagcgccggcgccagcaccagcgccagcgaggacatcgacttcgacgacctgagcagaagattcgaggagctgaagaagaagacctag

SEQ ID NO: 11081 - DNA, 1101 bp, Artificial Sequence
  Description of Artificial Sequence: Synthetic coding sequence
atgctgggcagcggcttcaaggccgagagactgagagtgaacctgagactggtgatcaacagactgaagctgctggagaagaagaagaccgagctggcccagaaggccagaaaggagatcgccgactacctggccgccggcaaggacgagagagccagaatcagagtggagcacatcatcagagaggactacctggtggaggccatggagatcctggagctgtactgcgacctgctgctggccagattcggcctgatccagagcatgaaggagctggacagcggcctggccgagagcgtgagcaccctgatctgggccgcccccagactgcagagcgaggtggccgagctgaagatcgtggccgaccagctgtgcgccaagtacagcaaggagtacggcaagctgtgcagaaccaaccagatcggcaccgtgaacgacagactgatgcacaagctgagcgtggaggccccccccaagatcctggtggagagatacctgatcgagatcgccaagaactacaacgtgccctacgagcccgacagcgtggtgatggccgaggccccccccggcgtggagaccgacctgatcgacgtgggcttcaccgacgacgtgaagaagggcggccccggcagaggcggcagcggcggcttcaccgcccccgtgggcggccccgacggcaccgtgcccatgcccatgcccatgcccatgcccatgcccagcgccaacacccccttcagctaccccctgcccaagggccccagcgacttcaacggcctgcccatgggcacctaccaggccttccccaacatccaccccccccagatccccgccaccccccccagctacgagagcgtggacgacatcaacgccgacaagaacatcagcagcgcccagatcgtgggccccggccccaagcccgaggccagcgccaagctgcccagcagacccgccgacaactacgacaacttcgtgctgcccgagctgcccagcgtgcccgacaccctgcccaccgccagcgccggcgccagcaccagcgccagcgaggacatcgacttcgacgacctgagcagaagattcgaggagctgaagaagaagacctag

SEQ ID NO: 11082 - DNA, 948 bp, Artificial Sequence
  Description of Artificial Sequence: Synthetic coding sequence
atggagaagtacgagaagctggccaagaccggcgagggcagctacggcgtggtgttcaagtgcagaaacaagaccagcggccaggtggtggccgtgaagaagttcgtggagagcgaggacgaccccgtggtgaagaagatcgccctgagagagatcagaatgctgaagcagctgaagcaccccaacctggtgaacctgatcgaggtgttcagaagaaagagaaagatgcacctggtgttcgagtactgcgaccacaccctgctgaacgagctggagagaaaccccaacggcgtggccgacggcgtgatcaagagcgtgctgtggcagaccctgcaggccctgaacttctgccacatccacaactgcatccacagagacatcaagcccgagaacatcctgatcaccaagcagggcatcatcaagatctgcgacttcggcttcgcccagatcctgatccccggcgacgcctacaccgactacgtggccaccagatggtacagagcccccgagctgctggtgggcgacacccagtacggcagcagcgtggacatctgggccatcggctgcgtgttcgccgagctgctgaccggccagcccctgtggcccggcaagagcgacgtggaccagctgtacctgatcatcagaaccctgggcaagctgatccccagacaccagagcatcttcaagagcaacggcttcttccacggcatcagcatccccgagcccgaggacatggagaccctggaggagaagttcagcgacgtgcaccccgtggccctgaacttcatgaagggctgcctgaagatgaaccccgacgacagactgacctgcagccagctgctggagagcagctacttcgacagcttccaggaggcccagatcaagagaaaggccagaaacgagggcagaaacagaagaagacagcaggtgctgcccctgaagagctag

SEQ ID NO: 11083 - DNA, 948 bp, Artificial Sequence
  Description of Artificial Sequence: Synthetic coding sequence
atggccaacgaccccctggagggcttccacgaggtgaacctggccagccccaccagccccgacctgctgggcgtgtacgagagcggcacccaggagcagaccaccagccccagcgtgatctacagaccccaccccagcgccctgagcagcgtgcccatccaggccaacgccctggacgtgagcgagctgcccacccagcccgtgtacagcagccccagaagactgaactgcgccgagatcagcagcatcagcttccacgtgaccgaccccgccccctgcagcaccagcggcgtgaccgccggcctgaccaagctgaccaccagaaaggacaactacaacgccgagagagagttcctgcagggcgccaccatcaccgaggcctgcgacggcagcgacgacatcttcggcctgagcaccgacagcctgagcagactgagaagccccagcgtgctggaggtgagagagaagggctacgagagactgaaggaggagctggccaaggcccagagagagctgaagctgaaggacgaggagtgcgagagactgagcaaggtgagagaccagctgggccaggagctggaggagctgaccgccagcctgttcgaggaggcccacaagatggtgagagaggccaacatcaagcaggccaccgccgagaagcagctgaaggaggcccagggcaagatcgacgtgctgcaggccgaggtggccgccctgaagaccctggtgctgagcagcagccccaccagccccacccaggagcccctgcccggcggcaagacccccttcaagaagggccacaccagaaacaagagcaccagcagcgccatgagcggcagccaccaggacctgagcgtgatccagcccatcgtgaaggactgcaaggaggtgacccaccagggcctgagccccctgaccctgctgatcctggtgagcagccaccactag

SEQ ID NO: 11084 - DNA, 1074 bp, Artificial Sequence
  Description of Artificial Sequence: Synthetic coding sequence
atggccagagagaacggcgagagcagcagcagctggaagaagcaggccgaggacatcaagaagatcttcgagttcaaggagaccctgggcaccggcgccttcagcgaggtggtgctggccgaggagaaggccaccggcaagctgttcgccgtgaagtgcatccccaagaaggccctgaagggcaaggagagcagcatcgagaacgagatcgccgtgctgagaaagatcaagcacgagaacatcgtggccctggaggacatctacgagagccccaaccacctgtacctggtgatgcagctggtgagcggcggcgagctgttcgacagaatcgtggagaagggcttctacaccgagaaggacgccagcaccctgatcagacaggtgctggacgccgtgtactacctgcacagaatgggcatcgtgcacagagacctgaagcccgagaacctgctgtactacagccaggacgaggagagcaagatcatgatcagcgacttcggcctgagcaagatggagggcaagggcgacgtgatgagcaccgcctgcggcacccccggctacgtggcccccgaggtgctggcccagaagccctacagcaaggccgtggactgctggagcatcggcgtgatcgcctacatcctgctgtgcggctacccccccttctacgacgagaacgacagcaagctgttcgagcagatcctgaaggccgagtacgagttcgacagcccctactgggacgacatcagcgacagcgccaaggacttcatcagaaacctgatggagaaggaccccaacaagagatacacctgcgagcaggccgccagacacccctggatcgccggcgacaccgccctgaacaagaacatccacgagagcgtgagcgcccagatcagaaagaacttcgccaagagcaagtggagacaggccttcaacgccaccgccgtggtgagacacatgagaaagctgcacctgggcagcagcctggacagcagcaacgccagcgtgagcagcagcctgagcctggccagccagaaggactgcgcctacgtggccaagcccgagagcctgagctag

SEQ ID NO: 11085 - DNA, 1158 bp, Artificial Sequence
  Description of Artificial Sequence: Synthetic coding sequence
atggccagagagaacggcgagagcagcagcagctggaagaagcaggccgaggacatcaagaagatcttcgagttcaaggagaccctgggcaccggcgccttcagcgaggtggtgctggccgaggagaaggccaccggcaagctgttcgccgtgaagtgcatccccaagaaggccctgaagggcaaggagagcagcatcgagaacgagatcgccgtgctgagaaagatcaagcacgagaacatcgtggccctggaggacatctacgagagccccaaccacctgtacctggtgatgcagctggtgagcggcggcgagctgttcgacagaatcgtggagaagggcttctacaccgagaaggacgccagcaccctgatcagacaggtgctggacgccgtgtactacctgcacagaatgggcatcgtgcacagagacctgaagcccgagaacctgctgtactacagccaggacgaggagagcaagatcatgatcagcgacttcggcctgagcaagatggagggcaagggcgacgtgatgagcaccgcctgcggcacccccggctacgtggcccccgaggtgctggcccagaagccctacagcaaggccgtggactgctggagcatcggcgtgatcgcctacatcctgctgtgcggctacccccccttctacgacgagaacgacagcaagctgttcgagcagatcctgaaggccgagtacgagttcgacagcccctactgggacgacatcagcgacagcgccaaggacttcatcagaaacctgatggagaaggaccccaacaagagatacacctgcgagcaggccgccagacacccctggatcgccggcgacaccgccctgaacaagaacatccacgagagcgtgagcgcccagatcagaaagaacttcgccaagagcaagtggagacaggccttcaacgccaccgccgtggtgagacacatgagaaagctgcacctgggcagcagcctggacagcagcaacgccagcgtgagcagcagcctgagcctggccagccagaaggactgcctggcccccagcaccctgtgcagcttcatcagcagcagcagcggcgtgagcggcgtgggcgccgagagaagacccagacccaccaccgtgaccgccgtgcacagcggcagcaagtag

SEQ ID NO: 11086 - DNA, 888 bp, Artificial Sequence
  Description of Artificial Sequence: Synthetic coding sequence
atgaagaaggagcacgtgctgcactgccagttcagcgcctggtaccccttcttcagaggcgtgaccatcaagagcgtgatcctgcccctgccccagaacgtgaaggactacctgctggacgacggcaccctggtggtgagcggcagagacgacccccccacccacagccagcccgacagcgacgacgaggccgaggagatccagtggagcgacgacgagaacaccgccaccctgaccgcccccgagttccccgagttcgccaccaaggtgcaggaggccatcaacagcctgggcggcagcgtgttccccaagctgaactggagcgcccccagagacgcctactggatcgccatgaacagcagcctgaagtgcaagaccctgagcgacatcttcctgctgttcaagagcagcgacttcatcaccagagacttcacccagcccttcatccactgcaccgacgacagccccgacccctgcatcgagtacgagctggtgctgagaaagtggtgcgagctgatccccggcgccgagttcagatgcttcgtgaaggagaacaagctgatcgtggtgttcgacatctacagagacagcagaggcaaggtgtggctgatcgacttcaaccccttcggcgaggtgaccgacagcctgctgttcacctgggaggagctgatcagcgagaacaacctgaacggcgacttcagcgaggtggacgcccaggagcaggacagccccgccttcagatgcaccaacagcgaggtgaccgtgcagcccagcccctacctgagctacagactgcccaaggacttcgtggacctgagcaccggcgaggacgcccacaagctgatcgacttcctgaagctgaagagaaaccagcaggaggacgactag

SEQ ID NO: 11087 - DNA, 3273 bp, Artificial Sequence
  Description of Artificial Sequence: Synthetic coding sequence
atggagcagcccaagggcgtggactggaccgtgatcatcctgacctgccagtacaaggacagcgtgcaggtgttccagagagagctggaggtgagacagaagagagagcagatccccgccggcaccctgctgctggccgtggaggaccccgagaagagagtgggcagcggcggcgccaccctgaacgccctgctggtggccgccgagcacctgagcgccagagccggcttcacctggatctgcgtgggcgtgagcctgtggatcagaggctgccacccccccggcagactgcccgaggccagcgtgcacagagccttccccctgctgcaggtggtgaccagcgacgtgctgcacagcgcctggatcctgatcctgcacatgggcagagacttccccttcgacgactgcggcagagccttcacctgcctgcccgtggagaaccccgaggcccccgtggaggccctggtgtgcaacctggactgcctgctggacatcatgacctacagactgggccccggcagcccccccggcgtgtgggtgtgcagcaccgacatgctgctgagcgtgcccgccaaccccggcatcagctgggacagcttcagaggcgccagagtgatcgccctgcccggcagccccgcctacgcccagaaccacggcgtgtacctgaccgacccccagggcctggtgctggacatctactaccagggcaccgaggccgagatccagagatgcgtgagacccgacggcagagtgcccctggtgagcggcgtggtgttcttcagcgtggagaccgccgagagactgctggccacccacgtgagcccccccctggacgcctgcacctacctgggcctggacagcggcgccagacccgtgcagctgagcctgttcttcgacatcctgcactgcatggccgagaacgtgaccagagaggacttcctggtgggcagaccccccgagctgggccagggcgacgccgacgtggccggctacctgcagagcgccagagcccagctgtggagagagctgagagaccagcccctgaccatggcctacgtgagcagcggcagctacagctacatgaccagcagcgccagcgagttcctgctgagcctgaccctgcccggcgcccccggcgcccagatcgtgcacagccaggtggaggagcagcagctgctggccgccggcagcagcgtggtgagctgcctgctggagggccccgtgcagctgggccccggcagcgtgctgcagcactgccacctgcagggccccatccacatcggcgccggctgcctggtgaccggcctggacaccgcccacagcaaggccctgcacggcagagagctgagagacctggtgctgcagggccaccacaccagactgcacggcagccccggccacgccttcaccctggtgggcagactggacagctgggagagacagggcgccggcacctacctgaacgtgccctggagcgagttcttcaagagaaccggcgtgagagcctgggacctgtgggaccccgagaccctgcccgccgagtactgcctgcccagcgccagactgttccccgtgctgcaccccagcagagagctgggcccccaggacctgctgtggatgctggaccaccaggaggacggcggcgaggccctgagagcctggagagccagctggagactgagctgggagcagctgcagccctgcctggacagagccgccaccctggccagcagaagagacctgttcttcagacaggccctgcacaaggccagacacgtgctggaggccagacaggacctgagcctgagacccctgatctgggccgccgtgagagagggctgccccggccccctgctggccaccctggaccaggtggccgccggcgccggcgaccccggcgtggccgccagagccctggcctgcgtggccgacgtgctgggctgcatggccgagggcagaggcggcctgagaagcggccccgccgccaaccccgagtggatgagacccttcagctacctggagtgcggcgacctggccgccggcgtggaggccctggcccaggagagagacaagtggctgagcagacccgccctgctggtgagagccgccagacactacgagggcgccggccagatcctgatcagacaggccgtgatgagcgcccagcacttcgtgagcaccgagcaggtggagctgcccggccccggccagtgggtggtggccgagtgccccgccagagtggacttcagcggcggctggagcgacaccccccccctggcctacgagctgggcggcgccgtgctgggcctggccgtgagagtggacggcagaagacccatcggcgccagagccagaagaatccccgagcccgagctgtggctggccgtgggccccagacaggacgagatgaccgtgaagatcgtgtgcagatgcctggccgacctgagagactactgccagccccacgcccccggcgccctgctgaaggccgccttcatctgcgccggcatcgtgcacgtgcacagcgagctgcagctgagcaccagcagcatcctggccggcaccgccctggccgccctgcagagagccgccggcagagtggtgggcaccgaggccctgatccacgccgtgctgcacctggagcaggtgctgaccaccggcggcggctggcaggaccaggtgggcggcctgatgcccggcatcaaggtgggcagaagcagagcccagctgcccctgaaggtggaggtggaggaggtgaccgtgcccgagggcttcgtgcagaagctgaacgaccacctgctgctggtgtacaccggcaagaccagactggccagaaacctgctgcaggacgtgctgagaagctggtacgccagactgcccgccgtggtgcagaacgcccacagcctggtgagacagaccgaggagtgcgccgagggcttcagacagggcagcctgcccctgctgggccagtgcctgaccagctactgggagcagaagaagctgatggcccccggctgcgagcccctgaccgtgagaagaatgatggacgtgctggccccccacgtgcacggccagagcctggccggcgccggcggcggcggcttcctgtacctgctgaccaaggagccccagcagaaggaggccctggaggccgtgctggccaagaccgagggcctgggcaactacagcatccacctggtggaggtggacacccagggcctgagcctgaagctgctgggcaccgaggccagcacctgctgccccttcccctag

SEQ ID NO: 11088 - DNA, 318 bp, Artificial Sequence
  Description of Artificial Sequence: Synthetic coding sequence
atgctggagctggcccaggacagactgcagttcgagaccgtggaggtgagcgagcccagcatgctgcagaagatcctgaccaccagaagaagagagaccggcggcaacgagcccctgcccgtgcccaccctgcagcaccacctggccccccccgccgaggccagaaaggtgcccagcgccagccaggtgcaggccatcaagtgcttcctgagcaagtgctggagcctgaacatcagcaccaaggagtacgcctacctgaagggcaccgtgctgttcaaccccggcaagggcaaggagaacgactgcaaccaccactag

SEQ ID NO: 11089 - DNA, 1413 bp, Artificial Sequence
  Description of Artificial Sequence: Synthetic coding sequence
atggccggcgagaaccaccagtggcagggcagcatcctgtacaacatgctgatgagcgccaagcagaccagagccgcccccgaggcccccgagaccagactggtggaccagtgctggggctgcagctgcggcgacgagcccggcgtgggcagagagggcctgctgggcggcagaaacgtggccctgctgtacagatgctgcttctgcggcaaggaccaccccagacagggcagcatcctgtacagcatgctgaccagcgccaagcagacctacgccgcccccaaggcccccgaggccaccctgggcccctgctggggctgcagctgcggcagcgaccccggcgtgggcagagccggcctgcccggcggcagacccgtggccctgctgtacagatgctgcttctgcggcgaggaccaccccagacagggcagcatcctgtacagcctgctgaccagcagcaagcagacccacgtggcccccgccgcccccgaggccagacccggcggcgcctggtgggacagaagctacttcgcccagagacccggcggcaaggaggccctgcccggcggcagagccaccgccctgctgtacagatgctgcttctgcggcgaggaccacccccagcagggcagcaccctgtactgcgtgcccaccagcaccaaccaggcccaggccgcccccgaggagagacccagagccccctggtgggacaccagcagcggcgccctgagacccgtggccctgaagagcccccaggtggtgtgcgaggccgccagcgccggcctgctgaagaccctgagattcgtgaagtacctgccctgcttccaggtgctgcccctggaccagcagctggtgctggtgagaaactgctgggccagcctgctgatgctggagctggcccaggacagactgcagttcgagaccgtggaggtgagcgagcccagcatgctgcagaagatcctgaccaccagaagaagagagaccggcggcaacgagcccctgcccgtgcccaccctgcagcaccacctggccccccccgccgaggccagaaaggtgcccagcgccagccaggtgcaggccatcaagtgcttcctgagcaagtgctggagcctgaacatcagcaccaaggagtacgcctacctgaagggcaccgtgctgttcaaccccgacgtgcccggcctgcagtgcgtgaagtacatccagggcctgcagtggggcacccagcagatcctgagcgagcacaccagaatgacccaccagggcccccacgacagattcatcgagctgaacagcaccctgttcctgctgagattcatcaacgccaacgtgatcgccgagctgttcttcagacccatcatcggcaccgtgagcatggacgacatgatgctggagatgctgtgcaccaagatctag

SEQ ID NO: 11090 - DNA, 2028 bp, Artificial Sequence
  Description of Artificial Sequence: Synthetic coding sequence
atgctgagagccaccgccccctgctggttcccccccggctaccccgaggccaagaaggtggccgaggaggccgccctggaggccagcagacacctgggcggcgagcagagccaggccggcgcccccgagggcagcaagatgctgagagccaccgccccctgctggttcagacccggctaccccgaggccaagaaggtggccaaggaggccgcccccgaggccagcagacacctgggcgccgagcagagccccgccggcgcccccgagggcagcaagatgctgagagccaccgccccctgctggttcccccccggctaccccgaggccaagaaggtggccgaggaggccgccctggaggcccccgagttccccctgcccagccaccagcccgcccagagcttcggcctgtgggtgccccagatgcacaagcaggccagcgccttcgtggacatccaggccgagccccagaacagaggccccgccgtgccccccgcctggcccaagatggtgaccgagagctgctacttccccgcccagagaggcagcgcctgcagactgcccgccgcccccagactgaccgagagacccagcggcgtgagaatcagcgcccccagaaagagaaagaccatcgcccacagcagcagcccctgcctggtgaccggctacaccgacgccaagagaaccagagtggccagcagcagccagagaagcagaggcagcaaggtgggcagacagcccggcaagaccagaaacagaagcggcatggcctgcaagaccaccgccaccaccagcagcaagagaatcgtgagaagagccagcctgcccagcctgagcctgaagaagcccatcatcctgagaagcagcggctgccaggtgcccaccgtgctgagaagaggctacctgcagctgttcaccgaggagtgcctgaagttctgcgccagcaagcaggaggccgaggagaaggccctgaacgaggagaaggtggcctacgactgcagccccaacaagaacagatacctgaacgtggtgctgaacaccctgaagagactgaagggcctgacccccagcagcatgcccggcctgagcagagccgccctgtacagcagactgcaggagttcctgctgacccaggaccagctgaaggagaacggctaccccttcccccaccccgagagacccggcggcgccgtgctgttcaccggccagggcaagggccccggcgacagcagctgcagagtgtgctgcagatgcggcaccgagtacctggtgagcagcagcggcagatgcgtgagagaccagctgtgctactaccactggggcagagtgagaagcagccaggtggccggcggcagagtgagccagtacacctgctgcgccgccgcccccggcagcgtgggctgccaggtggccaagcagcacgtgagagacggcagaaaggagagcctggacggcttcgtggagaccttcaagaaggagctgagcagagacgcctaccccggcatctacgccctggactgcgagatgtgctacaccacccacggcctggagctgaccagagtgaccgtggtggacgccgacatgagagtggtgtacgacaccttcgtgaagcccgacaacgagatcgtggactacaacaccagattcagcggcgtgaccgaggccgacgtggccaagaccagcatcaccctgccccaggtgcaggccatcctgctgagcttcttcagcgcccagaccatcctgatcggccacagcctggagagcgacctgctggccctgaagctgatccacagcaccgtggtggacaccgccgtgctgttcccccactacctgggcttcccctacaagagaagcctgagaaacctggccgccgactacctggcccagatcatccaggacagccaggacggccacaacagcagcgaggacgccagcgcctgcctgcagctggtgatgtggaaggtgagacagagagcccagatccagcccagacacagaagcgccagccccgccgccctggcctgcccctag

SEQ ID NO: 11091 - DNA, 711 bp, Artificial Sequence
  Description of Artificial Sequence: Synthetic coding sequence
atgcacaccacccagaaggacaccacctacaccaagatcttcgtgggcggcctgccctaccacaccaccgacgccagcctgagaaagtacttcgaggtgttcggcgagatcgaggaggccgtggtgatcaccgacagacagaccggcaagagcagaggctacggcttcgtgaccatggccgacagagccgccgccgagagagcctgcaaggaccccaaccccatcatcgacggcagaaaggccaacgtgaacctggcctacctgggcgccaagcccagaatcatgcagcccggcttcgccttcggcgtgcagcagctgcaccccgccctgatccagagacccttcggcatccccgcccactacgtgtacccccaggccttcgtgcagcccggcgtggtgatcccccacgtgcagcccaccgccgccgccgccagcaccaccccctacatcgactacaccggcgccgcctacgcccagtacagcgccgccgccgccgccgccgccgccgccgccgcctacgaccagtacccctacgccgccagccccgccgccgccggctacgtgaccgccggcggctacggctacgccgtgcagcagcccatcaccgccgccgcccccggcaccgccgccgccgccgccgccgccgccgccgccgccgccgccttcggccagtaccagccccagcagctgcagaccgacagaatgcagtag

SEQ ID NO: 11092 - DNA, 4389 bp, Artificial Sequence
  Description of Artificial Sequence: Synthetic coding sequence
atggcccccgtgcacggcgacgacagcctgagcgacagcggcagcttcgtgagcagcagagccagaagagagaagaagagcaagaagggcagacaggaggccctggagagactgaagaaggccaaggccggcgagaagtacaagtacgaggtggaggacttcaccggcgtgtacgaggaggtggacgaggagcagtacagcaagctggtgcaggccagacaggacgacgactggatcgtggacgacgacggcatcggctacgtggaggacggcagagagatcttcgacgacgacctggaggacgacgccctggacgccgacgagaagggcaaggacggcaaggccagaaacaaggacaagagaaacgtgaagaagctggccgtgaccaagcccaacaacatcaagagcatgttcatcgcctgcgccggcaagaagaccgccgacaaggccgtggacctgagcaaggacggcctgctgggcgacatcctgcaggacctgaacaccgagaccccccagatcacccccccccccgtgatgatcctgaagaagaagagaagcatcggcgccagccccaaccccttcagcgtgcacaccgccaccgccgtgcccagcggcaagatcgccagccccgtgagcagaaaggagccccccctgacccccgtgcccctgaagagagccgagttcgccggcgacgacgtgcaggtggagagcaccgaggaggagcaggagagcggcgccatggagttcgaggacggcgacttcgacgagcccatggaggtggaggaggtggacctggagcccatggccgccaaggcctgggacaaggagagcgagcccgccgaggaggtgaagcaggaggccgacagcggcaagggcaccgtgagctacctgggcagcttcctgcccgacgtgagctgctgggacatcgaccaggagggcgacagcagcttcagcgtgcaggaggtgcaggtggacagcagccacctgcccctggtgaagggcgccgacgaggagcaggtgttccacttctactggctggacgcctacgaggaccagtacaaccagcccggcgtggtgttcctgttcggcaaggtgtggatcgagagcgccgagacccacgtgagctgctgcgtgatggtgaagaacatcgagagaaccctgtacttcctgcccagagagatgaagatcgacctgaacaccggcaaggagaccggcacccccatcagcatgaaggacgtgtacgaggagttcgacgagaagatcgccaccaagtacaagatcatgaagttcaagagcaagcccgtggagaagaactacgccttcgagatccccgacgtgcccgagaagagcgagtacctggaggtgaagtacagcgccgagatgccccagctgccccaggacctgaagggcgagaccttcagccacgtgttcggcaccaacaccagcagcctggagctgttcctgatgaacagaaagatcaagggcccctgctggctggaggtgaagagcccccagctgctgaaccagcccgtgagctggtgcaaggtggaggccatggccctgaagcccgacctggtgaacgtgatcaaggacgtgagccccccccccctggtggtgatggccttcagcatgaagaccatgcagaacgccaagaaccaccagaacgagatcatcgccatggccgccctggtgcaccacagcttcgccctggacaaggccgcccccaagccccccttccagagccacttctgcgtggtgagcaagcccaaggactgcatcttcccctacgccttcaaggaggtgatcgagaagaagaacgtgaaggtggaggtggccgccaccgagagaaccctgctgggcttcttcctggccaaggtgcacaagatcgaccccgacatcatcgtgggccacaacatctacggcttcgagctggaggtgctgctgcagagaatcaacgtgtgcaaggccccccactggagcaagatcggcagactgaagagaagcaacatgcccaagctgggcggcagaagcggcttcggcgagagaaacgccacctgcggcagaatgatctgcgacgtggagatcagcgccaaggagctgatcagatgcaagagctaccacctgagcgagctggtgcagcagatcctgaagaccgagagagtggtgatccccatggagaacatccagaacatgtacagcgagagcagccagctgctgtacctgctggagcacacctggaaggacgccaagttcatcctgcagatcatgtgcgagctgaacgtgctgcccctggccctgcagatcaccaacatcgccggcaacatcatgagcagaaccctgatgggcggcagaagcgagagaaacgagttcctgctgctgcacgccttctacgagaacaactacatcgtgcccgacaagcagatcttcagaaagccccagcagaagctgggcgacgaggacgaggagatcgacggcgacaccaacaagtacaagaagggcagaaagaaggccgcctacgccggcggcctggtgctggaccccaaggtgggcttctacgacaagttcatcctgctgctggacttcaacagcctgtaccccagcatcatccaggagttcaacatctgcttcaccaccgtgcagagagtggccagcgaggcccagaaggtgaccgaggacggcgagcaggagcagatccccgagctgcccgaccccagcctggagatgggcatcctgcccagagagatcagaaagctggtggagagaagaaagcaggtgaagcagctgatgaagcagcaggacctgaaccccgacctgatcctgcagtacgacatcagacagaaggccctgaagctgaccgccaacagcatgtacggctgcctgggcttcagctacagcagattctacgccaagcccctggccgccctggtgacctacaagggcagagagatcctgatgcacaccaaggagatggtgcagaagatgaacctggaggtgatctacggcgacaccgacagcatcatgatcaacaccaacagcaccaacctggaggaggtgttcaagctgggcaacaaggtgaagagcgaggtgaacaagctgtacaagctgctggagatcgacatcgacggcgtgttcaagagcctgctgctgctgaagaagaagaagtacgccgccctggtggtggagcccaccagcgacggcaactacgtgaccaagcaggagctgaagggcctggacatcgtgagaagagactggtgcgacctggccaaggacaccggcaacttcgtgatcggccagatcctgagcgaccagagcagagacaccatcgtggagaacatccagaagagactgatcgagatcggcgagaacgtgctgaacggcagcgtgcccgtgagccagttcgagatcaacaaggccctgaccaaggacccccaggactaccccgacaagaagagcctgccccacgtgcacgtggccctgtggatcaacagccagggcggcagaaaggtgaaggccggcgacaccgtgagctacgtgatctgccaggacggcagcaacctgaccgccagccagagagcctacgcccccgagcagctgcagaagcaggacaacctgaccatcgacacccagtactacctggcccagcagatccaccccgtggtggccagaatctgcgagcccatcgacggcatcgacgccgtgctgatcgccacctggctgggcctggaccccacccagttcagagtgcaccactaccacaaggacgaggagaacgacgccctgctgggcggccccgcccagctgaccgacgaggagaagtacagagactgcgagagattcaagtgcccctgccccacctgcggcaccgagaacatctacgacaacgtgttcgacggcagcggcaccgacatggagcccagcctgtacagatgcagcaacatcgactgcaaggccagccccctgaccttcaccgtgcagctgagcaacaagctgatcatggacatcagaagattcatcaagaagtactacgacggctggctgatctgcgaggagcccacctgcagaaacagaaccagacacctgcccctgcagttcagcagaaccggccccctgtgccccgcctgcatgaaggccaccctgcagcccgagtacagcgacaagagcctgtacacccagctgtgcttctacagatacatcttcgacgccgagtgcgccctggagaagctgaccaccgaccacgagaaggacaagctgaagaagcagttcttcacccccaaggtgctgcaggactacagaaagctgaagaacaccgccgagcagttcctgagcagaagcggctacagcgaggtgaacctgagcaagctgttcgccggctgcgccgtgaagagctag

SEQ ID NO: 11093 - DNA, 2673 bp, Artificial Sequence
  Description of Artificial Sequence: Synthetic coding sequence
atgagcgccaacaacagcccccccagcgcccagaagagcgtgctgcccaccgccatccccgccgtgctgcccgccgccagcccctgcagcagccccaagaccggcctgagcgccagactgagcaacggcagcttcagcgcccccagcctgaccaacagcagaggcagcgtgcacaccgtgagcttcctgctgcagatcggcctgaccagagagagcgtgaccatcgaggcccaggagctgagcctgagcgccgtgaaggacctggtgtgcagcatcgtgtaccagaagttccccgagtgcggcttcttcggcatgtacgacaagatcctgctgttcagacacgacatgaacagcgagaacatcctgcagctgatcaccagcgccgacgagatccacgagggcgacctggtggaggtggtgctgagcgccctggccaccgtggaggacttccagatcagaccccacaccctgtacgtgcacagctacaaggcccccaccttctgcgactactgcggcgagatgctgtggggcctggtgagacagggcctgaagtgcgagggctgcggcctgaactaccacaagagatgcgccttcaagatccccaacaactgcagcggcgtgagaaagagaagactgagcaacgtgagcctgcccggccccggcctgagcgtgcccagacccctgcagcccgagtacgtggccctgcccagcgaggagagccacgtgcaccaggagcccagcaagagaatccccagctggagcggcagacccatctggatggagaagatggtgatgtgcagagtgaaggtgccccacaccttcgccgtgcacagctacaccagacccaccatctgccagtactgcaagagactgctgaagggcctgttcagacagggcatgcagtgcaaggactgcaagttcaactgccacaagagatgcgccagcaaggtgcccagagactgcctgggcgaggtgaccttcaacggcgagcccagcagcctgggcaccgacaccgacatccccatggacatcgacaacaacgacatcaacagcgacagcagcagaggcctggacgacaccgaggagcccagcccccccgaggacaagatgttcttcctggaccccagcgacctggacgtggagagagacgaggaggccgtgaagaccatcagccccagcaccagcaacaacatccccctgatgagagtggtgcagagcatcaagcacaccaagagaaagagcagcaccatggtgaaggagggctggatggtgcactacaccagcagagacaacctgagaaagagacactactggagactggacagcaagtgcctgaccctgttccagaacgagagcggcagcaagtactacaaggagatccccctgagcgagatcctgagaatcagcagccccagagacttcaccaacatcagccagggcagcaacccccactgcttcgagatcatcaccgacaccatggtgtacttcgtgggcgagaacaacggcgacagcagccacaaccccgtgctggccgccaccggcgtgggcctggacgtggcccagagctgggagaaggccatcagacaggccctgatgcccgtgaccccccaggccagcgtgtgcaccagccccggccagggcaaggaccacaaggacctgagcaccagcatcagcgtgagcaactgccagatccaggagaacgtggacatcagcaccgtgtaccagatcttcgccgacgaggtgctgggcagcggccagttcggcatcgtgtacggcggcaagcacagaaagaccggcagagacgtggccatcaaggtgatcgacaagatgagattccccaccaagcaggagagccagctgagaaacgaggtggccatcctgcagaacctgcaccaccccggcatcgtgaacctggagtgcatgttcgagacccccgagagagtgttcgtggtgatggagaagctgcacggcgacatgctggagatgatcctgagcagcgagaagagcagactgcccgagagaatcaccaagttcatggtgacccagatcctggtggccctgagaaacctgcacttcaagaacatcgtgcactgcgacctgaagcccgagaacgtgctgctggccagcgccgagcccttcccccaggtgaagctgtgcgacttcggcttcgccagaatcatcggcgagaagagcttcagaagaagcgtggtgggcacccccgcctacctggcccccgaggtgctgagaagcaagggctacaacagaagcctggacatgtggagcgtgggcgtgatcatctacgtgagcctgagcggcaccttccccttcaacgaggacgaggacatcaacgaccagatccagaacgccgccttcatgtacccccccaacccctggagagagatcagcggcgaggccatcgacctgatcaacaacctgctgcaggtgaagatgagaaagagatacagcgtggacaagagcctgagccacccctggctgcaggactaccagacctggctggacctgagagagttcgagaccagaatcggcgagagatacatcacccacgagagcgacgacgccagatgggagatccacgcctacacccacaacctggtgtaccccaagcacttcatcatggcccccaaccccgacgacatggaggaggacccctag

SEQ ID NO: 11094 - DNA, 4407 bp, Artificial Sequence
  Description of Artificial Sequence: Synthetic coding sequence
atggcccccgtgcacggcgacgactgcgagatcggcgccagcgccctgagcgacagcggcagcttcgtgagcagcagagccagaagagagaagaagagcaagaagggcagacaggaggccctggagagactgaagaaggccaaggccggcgagaagtacaagtacgaggtggaggacttcaccggcgtgtacgaggaggtggacgaggagcagtacagcaagctggtgcaggccagacaggacgacgactggatcgtggacgacgacggcatcggctacgtggaggacggcagagagatcttcgacgacgacctggaggacgacgccctggacgccgacgagaagggcaaggacggcaaggccagaaacaaggacaagagaaacgtgaagaagctggccgtgaccaagcccaacaacatcaagagcatgttcatcgcctgcgccggcaagaagaccgccgacaaggccgtggacctgagcaaggacggcctgctgggcgacatcctgcaggacctgaacaccgagaccccccagatcacccccccccccgtgatgatcctgaagaagaagagaagcatcggcgccagccccaaccccttcagcgtgcacaccgccaccgccgtgcccagcggcaagatcgccagccccgtgagcagaaaggagccccccctgacccccgtgcccctgaagagagccgagttcgccggcgacgacgtgcaggtggagagcaccgaggaggagcaggagagcggcgccatggagttcgaggacggcgacttcgacgagcccatggaggtggaggaggtggacctggagcccatggccgccaaggcctgggacaaggagagcgagcccgccgaggaggtgaagcaggaggccgacagcggcaagggcaccgtgagctacctgggcagcttcctgcccgacgtgagctgctgggacatcgaccaggagggcgacagcagcttcagcgtgcaggaggtgcaggtggacagcagccacctgcccctggtgaagggcgccgacgaggagcaggtgttccacttctactggctggacgcctacgaggaccagtacaaccagcccggcgtggtgttcctgttcggcaaggtgtggatcgagagcgccgagacccacgtgagctgctgcgtgatggtgaagaacatcgagagaaccctgtacttcctgcccagagagatgaagatcgacctgaacaccggcaaggagaccggcacccccatcagcatgaaggacgtgtacgaggagttcgacgagaagatcgccaccaagtacaagatcatgaagttcaagagcaagcccgtggagaagaactacgccttcgagatccccgacgtgcccgagaagagcgagtacctggaggtgaagtacagcgccgagatgccccagctgccccaggacctgaagggcgagaccttcagccacgtgttcggcaccaacaccagcagcctggagctgttcctgatgaacagaaagatcaagggcccctgctggctggaggtgaagagcccccagctgctgaaccagcccgtgagctggtgcaaggtggaggccatggccctgaagcccgacctggtgaacgtgatcaaggacgtgagccccccccccctggtggtgatggccttcagcatgaagaccatgcagaacgccaagaaccaccagaacgagatcatcgccatggccgccctggtgcaccacagcttcgccctggacaaggccgcccccaagccccccttccagagccacttctgcgtggtgagcaagcccaaggactgcatcttcccctacgccttcaaggaggtgatcgagaagaagaacgtgaaggtggaggtggccgccaccgagagaaccctgctgggcttcttcctggccaaggtgcacaagatcgaccccgacatcatcgtgggccacaacatctacggcttcgagctggaggtgctgctgcagagaatcaacgtgtgcaaggccccccactggagcaagatcggcagactgaagagaagcaacatgcccaagctgggcggcagaagcggcttcggcgagagaaacgccacctgcggcagaatgatctgcgacgtggagatcagcgccaaggagctgatcagatgcaagagctaccacctgagcgagctggtgcagcagatcctgaagaccgagagagtggtgatccccatggagaacatccagaacatgtacagcgagagcagccagctgctgtacctgctggagcacacctggaaggacgccaagttcatcctgcagatcatgtgcgagctgaacgtgctgcccctggccctgcagatcaccaacatcgccggcaacatcatgagcagaaccctgatgggcggcagaagcgagagaaacgagttcctgctgctgcacgccttctacgagaacaactacatcgtgcccgacaagcagatcttcagaaagccccagcagaagctgggcgacgaggacgaggagatcgacggcgacaccaacaagtacaagaagggcagaaagaaggccgcctacgccggcggcctggtgctggaccccaaggtgggcttctacgacaagttcatcctgctgctggacttcaacagcctgtaccccagcatcatccaggagttcaacatctgcttcaccaccgtgcagagagtggccagcgaggcccagaaggtgaccgaggacggcgagcaggagcagatccccgagctgcccgaccccagcctggagatgggcatcctgcccagagagatcagaaagctggtggagagaagaaagcaggtgaagcagctgatgaagcagcaggacctgaaccccgacctgatcctgcagtacgacatcagacagaaggccctgaagctgaccgccaacagcatgtacggctgcctgggcttcagctacagcagattctacgccaagcccctggccgccctggtgacctacaagggcagagagatcctgatgcacaccaaggagatggtgcagaagatgaacctggaggtgatctacggcgacaccgacagcatcatgatcaacaccaacagcaccaacctggaggaggtgttcaagctgggcaacaaggtgaagagcgaggtgaacaagctgtacaagctgctggagatcgacatcgacggcgtgttcaagagcctgctgctgctgaagaagaagaagtacgccgccctggtggtggagcccaccagcgacggcaactacgtgaccaagcaggagctgaagggcctggacatcgtgagaagagactggtgcgacctggccaaggacaccggcaacttcgtgatcggccagatcctgagcgaccagagcagagacaccatcgtggagaacatccagaagagactgatcgagatcggcgagaacgtgctgaacggcagcgtgcccgtgagccagttcgagatcaacaaggccctgaccaaggacccccaggactaccccgacaagaagagcctgccccacgtgcacgtggccctgtggatcaacagccagggcggcagaaaggtgaaggccggcgacaccgtgagctacgtgatctgccaggacggcagcaacctgaccgccagccagagagcctacgcccccgagcagctgcagaagcaggacaacctgaccatcgacacccagtactacctggcccagcagatccaccccgtggtggccagaatctgcgagcccatcgacggcatcgacgccgtgctgatcgccacctggctgggcctggaccccacccagttcagagtgcaccactaccacaaggacgaggagaacgacgccctgctgggcggccccgcccagctgaccgacgaggagaagtacagagactgcgagagattcaagtgcccctgccccacctgcggcaccgagaacatctacgacaacgtgttcgacggcagcggcaccgacatggagcccagcctgtacagatgcagcaacatcgactgcaaggccagccccctgaccttcaccgtgcagctgagcaacaagctgatcatggacatcagaagattcatcaagaagtactacgacggctggctgatctgcgaggagcccacctgcagaaacagaaccagacacctgcccctgcagttcagcagaaccggccccctgtgccccgcctgcatgaaggccaccctgcagcccgagtacagcgacaagagcctgtacacccagctgtgcttctacagatacatcttcgacgccgagtgcgccctggagaagctgaccaccgaccacgagaaggacaagctgaagaagcagttcttcacccccaaggtgctgcaggactacagaaagctgaagaacaccgccgagcagttcctgagcagaagcggctacagcgaggtgaacctgagcaagctgttcgccggctgcgccgtgaagagctag

SEQ ID NO: 11095 - DNA, 399 bp, Artificial Sequence
  Description of Artificial Sequence: Synthetic coding sequence
atggtggagcccttcctgggcacctggaagctggtgagcagcgagaacttcgaggactacatgaaggagctgggcgtgaacttcgccgccagaaacatggccggcctggtgaagcccaccgtgaccatcagcgtggacggcaagatgatgaccatcagaaccgagagcagcttccaggacaccaagatcagcttcaagctgggcgaggagttcgacgagaccaccgccgacaacagaaaggtgaagagcaccatcaccctggagaacggcagcatgatccacgtgcagaagtggctgggcaaggagaccaccatcaagagaaagatcgtggacgagaagatggtggtggagtgcaagatgaacaacatcgtgagcaccagaatctacgagaaggtgtag

SEQ ID NO: 11096 - DNA, 555 bp, Artificial Sequence
  Description of Artificial Sequence: Synthetic coding sequence
atggacagaggcgagcagggcctgctgagaaccgaccccgtgcccgaggagggcgaggacgtggccgccaccatcagcgccaccgagaccctgagcgaggaggagcaggaggagctgagaagagagctggccaaggtggaggaggagatccagaccctgagccaggtgctggccgccaaggagaagcacctggccgagatcaagagaaagctgggcatcaacagcctgcaggagctgaagcagaacatcgccaagggctggcaggacgtgaccgccaccagcgcctacaagaagaccagcgagaccctgagccaggccggccagaaggccagcgccgccttcagcagcgtgggcagcgtgatcaccaagaagctggaggacgtgaagaacagccccaccttcaagagcttcgaggagaaggtggagaacctgaagagcaaggtgggcggcaccaagcccgccggcggcgacttcggcgaggtgctgaacagcgccgccaacgccagcgccaccaccaccgagcccctgcccgagaagacccaggagagcctgtag

SEQ ID NO: 11097 - DNA, 675 bp, Artificial Sequence
  Description of Artificial Sequence: Synthetic coding sequence
atggactgcagagagatggacctgtacgaggactaccagagccccttcgacttcgacgccggcgtgaacaagagctacctgtacctgagccccagcggcaacagcagcccccccggcagccccaccctgcagaagttcggcctgctgagaaccgaccccgtgcccgaggagggcgaggacgtggccgccaccatcagcgccaccgagaccctgagcgaggaggagcaggaggagctgagaagagagctggccaaggtggaggaggagatccagaccctgagccaggtgctggccgccaaggagaagcacctggccgagatcaagagaaagctgggcatcaacagcctgcaggagctgaagcagaacatcgccaagggctggcaggacgtgaccgccaccagcgcctacaagaagaccagcgagaccctgagccaggccggccagaaggccagcgccgccttcagcagcgtgggcagcgtgatcaccaagaagctggaggacgtgaagaacagccccaccttcaagagcttcgaggagaaggtggagaacctgaagagcaaggtgggcggcaccaagcccgccggcggcgacttcggcgaggtgctgaacagcgccgccaacgccagcgccaccaccaccgagcccctgcccgagaagacccaggagagcctgtag

SEQ ID NO: 11098 - DNA, 285 bp, Artificial Sequence
  Description of Artificial Sequence: Synthetic coding sequence
cccagagccgccagaagcagaggccccgccgtgagcagacccagagcccccagacccgagctgaccaccgaggccggcgagcccgccagaagatgcgtgcccccctacgagcacagacccggcatgcagtgcgccgtgaccacccccccccccagctactacccctaccccaacctgagatgggacaccagccacttcaagaagagcggcggcccccagagaaacaactacgtgatccaccccgagttcgtgagcgagacctaccccgactacagatgctggtag

SEQ ID NO: 11099 - DNA, 1110 bp, Artificial Sequence
  Description of Artificial Sequence: Synthetic coding sequence
atgcccgtggtgaccaccgacgccgagagcgagaccggcatccccaagagcctgagcaacgagccccccagcgagaccatggaggagatcgagcacacctgcccccagcccagactgaccctgaccgcccccgcccccttcgccgacgagaccaactgccagtgccaggccccccacgagaagctgaccatcgcccaggccagactgggcacccccgccgacagacccgtgagagtgtacgccgacggcatcttcgacctgttccacagcggccacgccagagccctgatgcaggccaagaccctgttccccaacagctacctgctggtgggcgtgtgcagcgacgacctgacccacaagttcaagggcttcaccgtgatgaacgaggccgagagatacgaggccctgagacactgcagatacgtggacgaggtgatcagagacgccccctggaccctgacccccgagttcctggagaagcacaagatcgacttcgtggcccacgacgacatcccctacagcagcgccggcagcgacgacgtgtacaagcacatcaaggaggccggcatgttcgtgcccacccagagaaccgagggcatcagcaccagcgacatcatcaccagaatcgtgagagactacgacgtgtacgccagaagaaacctgcagagaggctacaccgccaaggagctgaacgtgagcttcatcaacgagaagagatacagattccagaaccaggtggacaagatgaaggagaaggtgaagaacgtggaggagagaagcaaggagttcgtgaacagagtggaggagaagagccacgacctgatccagaagtgggaggagaagagcagagagttcatcggcaacttcctggagctgttcggccccgacggcgcctggaagcagatgttccaggagagaagcagcagaatgctgcaggccctgagccccaagcagagccccgtgagcagccccaccagaagcagaagccccagcagaagccccagccccaccttcagctggctgcccctgaagaccagcccccccagcagccccaaggccgccagcgccagcatcagcagcatgagcgagggcgacgaggacgagaagtag

SEQ ID NO: 11100 - DNA, 1056 bp, Artificial Sequence
  Description of Artificial Sequence: Synthetic coding sequence
atggtgggccaccaggagtgcatcatggaggaggacaacagagccccccagctgtggagaaagaccctgaccgcccccgcccccttcgccgacgagaccaactgccagtgccaggccccccacgagaagctgaccatcgcccaggccagactgggcacccccgccgacagacccgtgagagtgtacgccgacggcatcttcgacctgttccacagcggccacgccagagccctgatgcaggccaagaccctgttccccaacagctacctgctggtgggcgtgtgcagcgacgacctgacccacaagttcaagggcttcaccgtgatgaacgaggccgagagatacgaggccctgagacactgcagatacgtggacgaggtgatcagagacgccccctggaccctgacccccgagttcctggagaagcacaagatcgacttcgtggcccacgacgacatcccctacagcagcgccggcagcgacgacgtgtacaagcacatcaaggaggccggcatgttcgtgcccacccagagaaccgagggcatcagcaccagcgacatcatcaccagaatcgtgagagactacgacgtgtacgccagaagaaacctgcagagaggctacaccgccaaggagctgaacgtgagcttcatcaacgagaagagatacagattccagaaccaggtggacaagatgaaggagaaggtgaagaacgtggaggagagaagcaaggagttcgtgaacagagtggaggagaagagccacgacctgatccagaagtgggaggagaagagcagagagttcatcggcaacttcctggagctgttcggccccgacggcgcctggaagcagatgttccaggagagaagcagcagaatgctgcaggccctgagccccaagcagagccccgtgagcagccccaccagaagcagaagccccagcagaagccccagccccaccttcagctggctgcccctgaagaccagcccccccagcagccccaaggccgccagcgccagcatcagcagcatgagcgagggcgacgaggacgagaagtag

SEQ ID NO: 11101 - DNA, 600 bp, Artificial Sequence
  Description of Artificial Sequence: Synthetic coding sequence
atggccgacaagagcaagttcatcgagtacatcgacgaggccctggagaagagcaaggagaccgccctgagccacctgttcttcacctaccagggcatcccctaccccatcaccatgtgcaccagcgagaccttccaggccctggacaccttcgaggccagacacgacgacatcgtgctggccagctaccccaagtgcggcagcaactggatcctgcacatcgtgagcgagctgatctacgccgtgagcaagaagaagtacaagtaccccgagttccccgtgctggagtgcggcgacagcgagaagtaccagaacctggccgccggcatcaagcagatcgccgagttcctgggcttcttcctgaccggcgagcagatccagaccatcagcgtgcagagcaccttccaggccatgagagccaagagccaggacacccacggcgccgtgggccccttcctgttcagaaagggcgaggtgggcgactggaagaacctgttcagcgagatccagaaccaggagatggacgagaagttcaaggagtgcctggccggcaccagcctgggcgccaagctgaagtacgagagctactgccagggctag

SEQ ID NO: 11102 - DNA, 1527 bp, Artificial Sequence
  Description of Artificial Sequence: Synthetic coding sequence
atgagatgccccaagagcgccgtgaccatgagaaacgaggagctgctgctgagcaacggcaccgccaacaagatgaacggcgccctggaccacagcgaccagcccgaccccgacgccatcaagatgttcgtgggccagatccccagaagctggagcgagaaggagctgaaggagctgttcgagccctacggcgccgtgtaccagatcaacgtgctgagagacagaagccagaaccccccccagagcaagggctgctgcttcgtgaccttctacaccagaaaggccgccctggaggcccagaacgccctgcacaacatcaagaccctgcccggcatgcaccaccccatccagatgaagcccgccgacagcgagaagagcaacgccgtggaggacagaaagctgttcatcggcatggtgagcaagaagtgcaacgagaacgacatcagagtgatgttcagccccttcggccagatcgaggagtgcagaatcctgagaggccccgacggcctgagcagaggctgcgccttcgtgaccttcagcaccagagccatggcccagaacgccatcaaggccatgcaccagagccagaccatggagggctgcagcagccccatcgtggtgaagttcgccgacacccagaaggacaaggagcagagaagactgcagcagcagctggcccagcagatgcagcagctgaacaccgccacctggggcaacctgaccggcctgggcggcctgaccccccagtacctggccctgctgcagcaggccaccagcagcagcaacctgggcgccttcagcggcatccagcagatggccggcatgaacgccctgcagctgcagaacctggccaccctggccgccgccgccgccgccgcccagaccagcgccaccagcaccaacgccaaccccctgagcaccaccagcagcgccctgggcgccctgaccagccccgtggccgccagcacccccaacagcaccgccggcgccgccatgaacagcctgaccagcctgggcaccctgcagggcctggccggcgccaccgtgggcctgaacaacatcaacgccctggccggcatggccgccctgaacggcggcctgggcgccaccggcctgaccaacggcaccgccggcaccatggacgccctgacccaggcctacagcggcatccagcagtacgccgccgccgccctgcccaccctgtacagccagagcctgctgcagcagcagagcgccgccggcagccagaaggagggccccgagggcgccaacctgttcatctaccacctgccccaggagttcggcgaccaggacatcctgcagatgttcatgcccttcggcaacgtgatcagcgccaaggtgttcatcgacaagcagaccaacctgagcaagtgcttcggcttcgtgagctacgacaaccccgtgagcgcccaggccgccatccaggccatgaacggcttccagatcggcatgaagagactgaaggtgcagctgaagagaagcaagaacgacagcaagccctactag

SEQ ID NO: 11103 - DNA, 1215 bp, Artificial Sequence
  Description of Artificial Sequence: Synthetic coding sequence
atgggcagcagccaggaggagggcctgagatgccagcccagccagcccgaccacgacgccgacggccactgcggccccgacctggagggcgccgagagagccagcgccacccccggcccccccggcctgctgaacagccacagacccgccgacagcgacgacaccaacgccgccggccccagcgccgccctgctggagggcctgctgctgggcggcggcaagcccagcccccacagcaccagacccggccccttcttctacatcggcggcagcaacggcgccaccatcatcagcagctactgcaagagcaagggctggcagagaatccacgacagcagaagagacgactacaccctgaagtggtgcgaggtgaagagcagagacagctacggcagcttcagagagggcgagcagctgctgtaccagctgcccaacaacaagctgctgaccaccaagatcggcctgctgagcaccctgagaggcagagccagagccatgagcaaggccagcaaggtgcccggcggcgtgcaggccagactggagaaggacgccgccgcccccgccctggaggacctgccctggaccagccccggctacctgagaccccagagagtgctgagaatggaggagttcttccccgagacctacagactggacctgaagcacgagagagaggccttcttcaccctgttcgacgagacccagatctggatctgcaagcccaccgccagcaaccagggcaagggcatcttcctgctgagaaaccaggaggaggtggccgccctgcaggccaagaccagaagcatggaggacgaccccatccaccacaagacccccttcagaggcccccaggccagagtggtgcagagatacatccagaaccccctgctggtggacggcagaaagttcgacgtgagaagctacctgctgatcgcctgcaccaccccctacatgatcttcttcggccacggctacgccagactgaccctgagcctgtacgacccccacagcagcgacctgggcggccacctgaccaaccagttcatgcagaagaagagccccctgtacatgctgctgaaggagcacaccgtgtggagcatggagcacctgaacagatacatcagcgacaccttctggaaggccagaggcctggccaaggactgggtgttcaccaccctgaaggtgagacccctgtgcccccccgtgtgggagtag

SEQ ID NO: 11104 - DNA, 2022 bp, Artificial Sequence
  Description of Artificial Sequence: Synthetic coding sequence
atggaccacagctgcaccagattcatccacagaagaggcccccccaccagaaccagagccggcttcaagagaggcaagagacccagaatccagcagagacccagagccagagtgagcggcaccatccccgccagcagactgcaccccgcccccgccagccagcccggcccctgccccgcccccggccactgccccgtgggccccgcccacgagagacccatgggcagcagccaggaggagggcctgagatgccagcccagccagcccgaccacgacgccgacggccactgcggccccgacctggagggcgccgagagagccagcgccacccccggcccccccggcctgctgaacagccacagacccgccgacagcgacgacaccaacgccgccggccccagcgccgccctgctggagggcctgctgctgggcggcggcaagcccagcccccacagcaccagacccggccccttcttctacatcggcggcagcaacggcgccaccatcatcagcagctactgcaagagcaagggctggcagagaatccacgacagcagaagagacgactacaccctgaagtggtgcgaggtgaagagcagagacagctacggcagcttcagagagggcgagcagctgctgtaccagctgcccaacaacaagctgctgaccaccaagatcggcctgctgagcaccctgagaggcagagccagagccatgagcaaggccagcaaggtgcccggcggcgtgcaggccagactggagaaggacgccgccgcccccgccctggaggacctgccctggaccagccccggctacctgagaccccagagagtgctgagaatggaggagttcttccccgagacctacagactggacctgaagcacgagagagaggccttcttcaccctgttcgacgagacccagatctggatctgcaagcccaccgccagcaaccagggcaagggcatcttcctgctgagaaaccaggaggaggtggccgccctgcaggccaagaccagaagcatggaggacgaccccatccaccacaagacccccttcagaggcccccaggccagagtggtgcagagatacatccagaaccccctgctggtggacggcagaaagttcgacgtgagaagctacctgctgatcgcctgcaccaccccctacatgatcttcttcggccacggctacgccagactgaccctgagcctgtacgacccccacagcagcgacctgggcggccacctgaccaaccagttcatgcagaagaagagccccctgtacatgctgctgaaggagcacaccgtgtggagcatggagcacctgaacagatacatcagcgacaccttctggaaggccagaggcctggccaaggactgggtgttcaccaccctgaagaagagaatgcagcagatcatggcccactgcttcctggccgccaagcccaagctggactgcaagctgggctacttcgacctgatcggctgcgacttcctgatcgacgacaacttcaaggtgtggctgctggagatgaacagcaaccccgccctgcacaccaactgcgaggtgctgaaggaggtgatccccggcgtggtgatcgagaccctggacctggtgctggagaccttcagaaagagcctgagaggccagaagatgctgcccctgctgagccagagaagattcgtgctgctgcacaacggcgaggccgaccccagaccccacctgggcggcagctgcagcctgagaagatggccccccctgcccaccagacaggccaagagcagcggcccccccatgccccacgcccccgaccagcccggcgccagaagacccgcccccccccccctggtgccccagagacccagaccccccggccccgacctggacagcgcccacgacggcgagccccaggcccccggcaccgagcagagcggcaccggcaacagacaccccgcccaggagcccagccccggcaccgccaaggaggagagagaggagcccgagaacgccagaccctag

SEQ ID NO: 11105 - DNA, 2022 bp, Artificial Sequence; identical to SEQ ID NO: 11104
  Description of Artificial Sequence: Synthetic coding sequence

SEQ ID NO: 11106 - DNA, 393 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactggacaccgagaagctgtgcaccttcagccagagattccccctgcccagcatgtacagagccctggtgtggaaggtgctgctgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgactag

SEQ ID NO: 11107 - DNA, 882 bp, Artificial Sequence; identical to SEQ ID NO: 10415
  Description of Artificial Sequence: Synthetic coding sequence

SEQ ID NO: 11108 - DNA, 801 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagagagtgtgggacaaggtggtgagcggcagctgcaagatcctggtgttcgtggccgtggagatcctgctgaccttcaagatcaaggtgatggccctgaacagcgccgagaagatcaccaagttcctggagaacatcccccaggacagcagcgacgccatcgtgagcaaggccatcgacctgtggcacaagcactgcggcacccccgtgcacagcagctag

SEQ ID NO: 11109 - DNA, 3672 bp, Artificial Sequence
  Description of Artificial Sequence: Synthetic coding sequence
atgatgagcctgagcgtgagaccccagagaagactgctgagcgccagagtgaacagaagccagagcttcgccggcgtgctgggcagccacgagagaggccccagcctgagcttcagaagcttccccgtgttcagcccccccggcccccccagaaagccccccgccctgagcagagtgagcagaatgttcagcgtggcccaccccgccgccaaggtgccccagcccgagagactggacctggtgtacaccgccctgaagagaggcctgaccgcctacctggaggtgcaccagcaggagcaggagaagctgcagggccagatcagagagagcaagagaaacagcagactgggcttcctgtacgacctggacaagcaggtgaagagcatcgagagattcctgagaagactggagttccacgccagcaagatcgacgagctgtacgaggcctactgcgtgcagagaagactgagagacggcgcctacaacatggtgagagcctacaccaccggcagccccggcagcagagaggccagagacagcctggccgaggccaccagaggccacagagagtacaccgagagcatgtgcctgctggagagcgagctggaggcccagctgggcgagttccacctgagaatgaagggcctggccggcttcgccagactgtgcgtgggcgaccagtacgagatctgcatgaagtacggcagacagagatggaagctgagaggcagaatcgagggcagcggcaagcaggtgtgggacagcgaggagaccatcttcctgcccctgctgaccgagttcctgagcatcaaggtgaccgagctgaagggcctggccaaccacgtggtggtgggcagcgtgagctgcgagaccaaggacctgttcgccgccctgccccaggtggtggccgtggacatcaacgacctgggcaccatcaagctgagcctggaggtgacctggagccccttcgacaaggacgaccagcccagcgccgccagcagcgtgaacaaggccagcaccgtgaccaagagattcagcacctacagccagagcccccccgacacccccagcctgagagagcaggccttctacaacatgctgagaagacaggaggagctggagaacggcaccgcctggagcctgagcagcgagagcagcgacgacagcagcagcccccagctgagcggcaccgccagacacagccccgcccccagacccctggtgcagcagcccgagcccctgcccatccaggtggccttcagaagacccgagacccccagcagcggccccctggacgaggagggcgccgtggcccccgtgctggccaacggccacgccccctacagcagaaccctgagccacatcagcgaggccagcgtggacgccgccctggccgaggccagcgtggaggccgtgggccccgagagcctggcctggggccccagcccccccacccaccccgcccccacccacggcgagcaccccagccccgtgccccccgccctggaccccggccacagcgccaccagcagcaccctgggcaccaccggcagcgtgcccaccagcaccgaccccgcccccagcgcccacctggacagcgtgcacaagagcaccgacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccccgtgcagaccaccaccagccccacccacaccatgcccagccccacccacaccaccgccagccccacccacaccagcaccagccccacccacacccccaccagccccacccacaagaccagcatgagcccccccaccaccaccagccccacccccagcggcatgggcctggtgcagaccgccaccagccccacccaccccaccaccagccccacccaccccaccaccagccccatcctgatcaacgtgagccccagcaccagcctggagctggccaccctgagcagccccagcaagcacagcgaccccaccctgcccggcaccgacagcctgccctgcagcccccccgtgagcaacagctacacccaggccgaccccatggcccccagaaccccccaccccagccccgcccacagcagcagaaagcccctgaccagccccgcccccgaccccagcgagagcaccgtgcagagcctgagccccacccccagcccccccacccccgccccccagcacagcgacctgtgcctggccatggccgtgcagacccccgtgcccaccgccgccggcggcagcggcgacagaagcctggaggaggccctgggcgccctgatggccgccctggacgactacagaggccagttccccgagctgcagggcctggagcaggaggtgaccagactggagagcctgctgatgcagagacagggcctgaccagaagcagagccagcagcctgagcatcaccgtggagcacgccctggagagcttcagcttcctgaacgaggacgaggacgaggacaacgacgtgcccggcgacagaccccccagcagccccgaggccggcgccgaggacagcatcgacagccccagcgccagacccctgagcaccggctgccccgccctggacgccgccctggtgagacacctgtaccactgcagcagactgctgctgaagctgggcaccttcggccccctgagatgccaggaggcctgggccctggagagactgctgagagaggccagagtgctggaggccgtgtgcgagttcagcagaagatgggagatccccgccagcagcgcccaggaggtggtgcagttcagcgccagcagacccggcttcctgaccttctgggaccagtgcaccgagagactgagctgcttcctgtgccccgtggagagagtgctgctgaccttctgcaaccagtacggcgccagactgagcctgagacagcccggcctggccgaggccgtgtgcgtgaagttcctggaggacgccctgggccagaagctgcccagaagaccccagcccggccccggcgagcagctgaccgtgttccagttctggagcttcgtggagaccctggacagccccaccatggaggcctacgtgaccgagaccgccgaggaggtgctgctggtgagaaacctgaacagcgacgaccaggccgtggtgctgaaggccctgagactggcccccgagggcagactgagaagagacggcctgagagccctgagcagcctgctggtgcacggcaacaacaaggtgatggccgccgtgagcacccagctgagaagcctgagcctgggccccaccttcagagagagagccctgctgtgcttcctggaccagctggaggacgaggacgtgcagaccagagtggccggctgcctggccctgggctgcatcaaggcccccgagggcatcgagcccctggtgtacctgtgccagaccgacaccgaggccgtgagagaggccgccagacagagcctgcagcagtgcggcgaggagggccagagcgcccacagaagactggaggagagcctggacgccctgcccagaatcttcggccccggcagcatggccagcaccgccttctag

SEQ ID NO: 11110 - DNA, 123 bp, Artificial Sequence
  Description of Artificial Sequence: Synthetic coding sequence
atggccgacgaggagctggaggccctgagaagacagagactggccgagctgcaggccaagcacggcgaccccggcgacgccgcccagcaggaggccaagcacagcagcaccgaggagaagtag

SEQ ID NO: 11111 - DNA, 414 bp, Artificial Sequence
  Description of Artificial Sequence: Synthetic coding sequence
atgaagccccccgccgcccagggcagccccgccgccgccgccgccgccgcccccgccctggacagcgccgccgccgaggacctgagcgacgccctgtgcgagttcgacgccgtgctggccgacttcgccagccccttccacgagagacacttccactacgaggagcacctggagagaatgaagagaagaagcagcgccagcgtgagcgacagcagcggcttcagcgacagcgagagcgccgacagcctgtacagaaacagcttcagcttcagcgacgagaagctgaacagccccaccgacagcacccccgccctgctgagcgccaccgtgaccccccagaaggccaagctgggcgacaccaaggagctggaggccttcatcgccgacctggacaagaccctggccagcatgtag

SEQ ID NO: 11112 - DNA, 1593 bp, Artificial Sequence
  Description of Artificial Sequence: Synthetic coding sequence
atgcccaacgtgctgctgccccccaaggagagcaacctgttcaagagaatcctgaagtgctacgagcagaagcagtacaagaacggcctgaagttctgcaagatgatcctgagcaaccccaagttcgccgagcacggcgagaccctggccatgaagggcctgaccctgaactgcctgggcaagaaggaggaggcctacgagttcgtgagaaagggcctgagaaacgacgtgaagagccacgtgtgctggcacgtgtacggcctgctgcagagaagcgacaagaagtacgacgaggccatcaagtgctacagaaacgccctgaagctggacaaggacaacctgcagatcctgagagacctgagcctgctgcagatccagatgagagacctggagggctacagagagaccagataccagctgctgcagctgagacccacccagagagccagctggatcggctacgccatcgcctaccacctgctgaaggactacgacatggccctgaagctgctggaggagttcagacagacccagcaggtgccccccaacaagatcgactacgagtacagcgagctgatcctgtaccagaaccaggtgatgagagaggccgacctgctgcaggagagcctggagcacatcgagatgtacgagaagcagatctgcgacaagctgctggtggaggagatcaagggcgagatcctgctgaagctgggcagactgaaggaggccagcgaggtgttcaagaacctgatcgacagaaacgccgagaactggtgctactacgagggcctggagaaggccctgcagatcagcaccctggaggagagactgcagatctacgaggagatcagcaagcagcaccccaaggccatcacccccagaagactgcccctgaccctggtgcccggcgagagattcagagagctgatggacaagttcctgagagtgaacttcagcaagggctgcccccccctgttcaccaccctgaagagcctgtactacaacaccgagaaggtgagcatcatccaggagctggtgaccaactacgaggccagcctgaagacctgcgacttcttcagcccctacgagaacggcgagaaggagccccccaccaccctgctgtgggtgcagtacttcctggcccagcacttcgacaagctgggccagtacagcctggccctggactacatcaacgccgccatcgccagcacccccaccctgatcgagctgttctacatgaaggccaagatctacaagcacatcggcaacctgaaggaggccgccaagtggatggacgaggcccagagcctggacaccgccgacagattcatcaacagcaagtgcgccaagtacatgctgagagccaacatgatcaaggaggccgaggagatgtgcagcaagttcaccagagagggcaccagcgccatggagaacctgaacgagatgcagtgcatgtggttccagaccgagtgcatcagcgcctaccagagactgggcagatacggcgacgccctgaagaagtgccacgaggtggagagacacagccccagcacctggaccaccggcggcaaggagccccagatgcacccctag

SEQ ID NO: 11113 - DNA, 2595 bp, Artificial Sequence
  Description of Artificial Sequence: Synthetic coding sequence
atgcccaacgtgctgctgccccccaaggagagcaacctgttcaagagaatcctgaagtgctacgagcagaagcagtacaagaacggcctgaagttctgcaagatgatcctgagcaaccccaagttcgccgagcacggcgagaccctggccatgaagggcctgaccctgaactgcctgggcaagaaggaggaggcctacgagttcgtgagaaagggcctgagaaacgacgtgaagagccacgtgtgctggcacgtgtacggcctgctgcagagaagcgacaagaagtacgacgaggccatcaagtgctacagaaacgccctgaagctggacaaggacaacctgcagatcctgagagacctgagcctgctgcagatccagatgagagacctggagggctacagagagaccagataccagctgctgcagctgagacccacccagagagccagctggatcggctacgccatcgcctaccacctgctgaaggactacgacatggccctgaagctgctggaggagttcagacagacccagcaggtgccccccaacaagatcgactacgagtacagcgagctgatcctgtaccagaaccaggtgatgagagaggccgacctgctgcaggagagcctggagcacatcgagatgtacgagaagcagatctgcgacaagctgctggtggaggagatcaagggcgagatcctgctgaagctgggcagactgaaggaggccagcgaggtgttcaagaacctgatcgacagaaacgccgagaactggtgctactacgagggcctggagaaggccctgcagatcagcaccctggaggagagactgcagatctacgaggagatcagcaagcagcaccccaaggccatcacccccagaagactgcccctgaccctggtgcccggcgagagattcagagagctgatggacaagttcctgagagtgaacttcagcaagggctgcccccccctgttcaccaccctgaagagcctgtactacaacaccgagaaggtgagcatcatccaggagctggtgaccaactacgaggccagcctgaagacctgcgacttcttcagcccctacgagaacggcgagaaggagccccccaccaccctgctgtgggtgcagtacttcctggcccagcacttcgacaagctgggccagtacagcctggccctggactacatcaacgccgccatcgccagcacccccaccctgatcgagctgttctacatgaaggccaagatctacaagcacatcggcaacctgaaggaggccgccaagtggatggacgaggcccagagcctggacaccgccgacagattcatcaacagcaagtgcgccaagtacatgctgagagccaacatgatcaaggaggccgaggagatgtgcagcaagttcaccagagagggcaccagcgccatggagaacctgaacgagatgcagtgcatgtggttccagaccgagtgcatcagcgcctaccagagactgggcagatacggcgacgccctgaagaagtgccacgaggtggagagacacttcttcgagatcaccgacgaccagttcgacttccacacctactgcatgagaaagatgaccctgagagcctacgtggacctgctgagactggaggacatcctgagaagacacgccttctacttcaaggccgccagaagcgccatcgagatctacctgaagctgtacgacaaccccctgaccaacgagagcaagcagcaggagatcaacagcgagaacctgagcgccaaggagctgaagaagatgctgagcaagcagagaagagcccagaagaaggccaagctggaggaggagagaaagcacgccgagagagagagacagcagaagaaccagaagaagaagagagacgaggaggaggaggaggccagcggcctgaaggaggagctgatccccgagaagctggagagagtggagaaccccctggaggaggccgtgaagttcctgatccccctgaagaacctggtggccgacaacatcgacacccacctgctggccttcgagatctacttcagaaagggcaagttcctgctgatgctgcagagcgtgaagagagccttcgccatcaacagcaacaacccctggctgcacgagtgcctgatcagattcagcaagagcgtgagcaaccacagcaacctgcccgacatcgtgagcaaggtgctgagccaggagatgcagaagatcttcgtgaagaaggacctggagagcttcaacgaggacttcctgaagagaaacgccaccagcctgcagcacctgctgagcggcgccaagatgatgtacttcctggacaagagcagacaggagaaggccatcgccatcgccaccagactggacgagaccatcaaggacaaggacgtgaagaccctgatcaaggtgagcgaggccctgctggacggcagcttcggcaactgcagcagccagtacgaggagtacagaatggcctgccacaacctgctgcccttcaccagcgccttcctgcccgccgtgaacgaggtggacaaccccaacgtggccctgaaccacaccgccaactacgacgtgctggccaacgagatctag

SEQ ID NO: 11114 - DNA, 1668 bp, Artificial Sequence; identical to SEQ ID NO: 9775
  Description of Artificial Sequence: Synthetic coding sequence

SEQ ID NO: 11115 - DNA, 630 bp, Artificial Sequence
  Description of Artificial Sequence: Synthetic coding sequence
atggcccccgtgggcgtggagaagaagctgctgctgggccccaacggccccgccgtggccgccgccggcgacctgaccagcgaggaggaggagggccagagcctgtggagcagcatcctgagcgaggtgagcaccagagccagaagcaagctgcccagcggcaagaacatcctggtgttcggcgaggacggcagcggcaagaccaccctgatgaccaagctgcagggcgccgagcacggcaagaagggcagaggcctggagtacctgtacctgagcgtgcacgacgaggacagagacgaccacaccagatgcaacgtgtggatcctggacggcgacctgtaccacaagggcctgctgaagttcgccgtgagcgccgagagcctgcccgagaccctggtgatcttcgtggccgacatgagcagaccctggaccgtgatggagagcctgcagaagtgggccagcgtgctgagagagcacatcgacaagatgaagatcccccccgagaagatgagagagctggagagaaagttcgtgaaggacttccaggactacatggagcccgaggagggctgccaggagggccccctgagcaacagagtggagcagatgagacccagaaaccactggtag

SEQ ID NO: 11116 - DNA, 858 bp, Artificial Sequence
  Description of Artificial Sequence: Synthetic coding sequence
aactggaacctggccagctggaaccccagcaaccccgagtgcctgctgctggtggtgaaggagctggtgcagcagtaccaccagttccagtgcagcagactgagagagagcagcagactgatgttcgagtaccagaccctgctggaggagccccagtacggcgagaacatggagatctacgccggcaagaagaacaactggaccggcgagttcagcgccagattcctgctgaagctgcccgtggacttcagcaacatccccacctacctgctgaaggacgtgaacgaggaccccggcgaggacgtggccctgctgagcgtgagcttcgaggacaccgaggccacccaggtgtaccccaagctgtacctgagccccagaatcgagcacgccctgggcggcagcagcgccctgcacatccccgccttccccggcggcggctgcctgatcgactacgtgccccaggtgtgccacctgctgaccaacaaggtgcagtacgtgatccagggctaccacaagagaagagagtacatcgccgccttcctgagccacttcggcaccggcgtggtggagtacgacgccgagggcttcaccaagctgaccctgctgctgatgtggaaggacttctgcttcctggtgcacatcgacctgcccctgttcttccccagagaccagcccaccctgaccttccagagcgtgtaccacttcaccaacagcggccagctgtacagccaggcccagaagaactacccctacagccccagatgggacggcaacgagatggccaagagagccaaggcctacttcaagaccttcgtgccccagttccaggaggccgccttcgccaacggcaagctgtag

SEQ ID NO: 11117 - DNA, 1152 bp, Artificial Sequence; identical to SEQ ID NO: 10250
  Description of Artificial Sequence: Synthetic coding sequence

SEQ ID NO: 11118 - DNA, 1131 bp, Artificial Sequence; identical to SEQ ID NO: 10569
  Description of Artificial Sequence: Synthetic coding sequence

SEQ ID NO: 11119 - DNA, 312 bp, Artificial Sequence
  Description of Artificial Sequence: Synthetic coding sequence
atgatcagagccttccccaccaccacccccagaagcctgcacctgttcaccagcagcaccttcctggccagagccctgcccggcgccttccccaccggcgcctgcgaggagagactgagcgtgcccgagagcacccccttcaccgccgtgctgaagttcgccgccgaggagttcaaggtgcccgccgccaccagcgccatcatcaccaacgacggcatcggcatcaaccccgcccagaccgccggcaacgtgttcctgaagcacggcagcgagctgagaatcatccccagagacagagtgggcagctgctag

SEQ ID NO: 11120 - DNA, 1968 bp, Artificial Sequence
  Description of Artificial Sequence: Synthetic coding sequence
atggccacccccgtggtgaccaagaccgcctggaagctgcaggagatcgtggcccacgccagcaacgtgagcagcctggtgctgggcaaggccagcggcagactgctggccaccggcggcgacgactgcagagtgaacctgtggagcatcaacaagcccaactgcatcatgagcctgaccggccacaccagccccgtggagagcgtgagactgaacacccccgaggagctgatcgtggccggcagccagagcggcagcatcagagtgtgggacctggaggccgccaagatcctgagaaccctgatgggccacaaggccaacatctgcagcctggacttccacccctacggcgagttcgtggccagcggcagccaggacaccaacatcaagctgtgggacatcagaagaaagggctgcgtgttcagatacagaggccacagccaggccgtgagatgcctgagattcagccccgacggcaagtggctggccagcgccgccgacgaccacaccgtgaagctgtgggacctgaccgccggcaagatgatgagcgagttccccggccacaccggccccgtgaacgtggtggagttccaccccaacgagtacctgctggccagcggcagcagcgacagaaccatcagattctgggacctggagaagttccaggtggtgagctgcatcgagggcgagcccggccccgtgagaagcgtgctgttcaaccccgacggctgctgcctgtacagcggctgccaggacagcctgagagtgtacggctgggagcccgagagatgcttcgacgtggtgctggtgaactggggcaaggtggccgacctggccatctgcaacgaccagctgatcggcgtggccttcagccagagcaacgtgagcagctacgtggtggacctgaccagagtgaccagaaccggcaccgtggccagagaccccgtgcaggaccacagacccctggcccagcccctgcccaaccccagcgcccccctgagaagaatctacgagagacccagcaccacctgcagcaagccccagagagtgaagcagaacagcgagagcgagagaagaagccccagcagcgaggacgacagagacgagagagagagcagagccgagatccagaacgccgaggactacaacgagatcttccagcccaagaacagcatcagcagaaccccccccagaagaagcgagcccttccccgccccccccgaggacgacgccgccaccgccaaggaggccgccaagcccagccccgccatggacgtgcagttccccgtgcccaacctggaggtgctgcccagaccccccgtggtggccagcacccccgcccccaaggccgagcccgccatcatccccgccaccagaaacgagcccatcggcctgaaggccagcgacttcctgcccgccgtgaagatcccccagcaggccgagctggtggacgaggacgccatgagccagatcagaaagggccacgacaccatgtgcgtggtgctgaccagcagacacaagaacctggacaccgtgagagccgtgtggaccatgggcgacatcaagaccagcgtggacagcgccgtggccatcaacgacctgagcgtggtggtggacctgctgaacatcgtgaaccagaaggccagcctgtggaagctggacctgtgcaccaccgtgctgccccagatcgagaagctgctgcagagcaagtacgagagctacgtgcagaccggctgcaccagcctgaagctgatcctgcagagattcctgcccctgatcaccgacatgctggccgccccccccagcgtgggcgtggacatcagcagagaggagagactgcacaagtgcagactgtgctacaagcagctgaagagcatcagcggcctggtgaagagcaagagcggcctgagcggcagacacggcagcaccttcagagagctgcacctgctgatggccagcctggactag

SEQ ID NO: 11121 - DNA, 165 bp, Artificial Sequence
  Description of Artificial Sequence: Synthetic coding sequence
atgttcctgagcgccgtgttcttcgccaagagcaagagcaacgagaccaagagccccctgagaggcaaggagaagaacaccctgcccctgaacggcggcctgaagatgaccctgatctacaaggagaagaccgagggcggcgacaccgacagcgagatcctgtag

SEQ ID NO: 11122 - DNA, 2457 bp, Artificial Sequence
  Description of Artificial Sequence: Synthetic coding sequence
atgaagaagcagttcaacagaatgagacagctggccaaccagaccgtgggcagagccgagaagaccgaggtgctgagcgaggacctgctgcaggtggagaagagactggagctggtgaagcaggtgagccacagcacccacaagaagctgaccgcctgcctgcagggccagcagggcgccgaggccgacaagagaagcaagaagctgcccctgaccaccctggcccagtgcctgatggagggcagcgccatcctgggcgacgacaccctgctgggcaagatgctgaagctgtgcggcgagaccgaggacaagctggcccaggagctgatccacttcgagctgcaggtggagagagacgtgatcgagcccctgttcctgctggccgaggtggagatccccaacatccagaagcagagaaagcacctggccaagctggtgctggacatggacagcagcagaaccagatggcagcagaccagcaagagcagcggcctgagcagcagcctgcagcccgccggcgccaaggccgacgccctgagagaggagatggaggaggccgccaacagagtggagatctgcagagaccagctgagcgccgacatgtacagcttcgtggccaaggagatcgactacgccaactacttccagaccctgatcgaggtgcaggccgagtaccacagaaagagcctgaccctgctgcaggccgtgctgccccagatcaaggcccagcaggaggcctgggtggagaagcccagcttcggcaagcccctggaggagcacctgaccatcagcggcagagagatcgccttccccatcgaggcctgcgtgaccatgctgctggagtgcggcatgcaggaggagggcctgttcagagtggcccccagcgccagcaagctgaagaagctgaaggccgccctggactgctgcgtggtggacgtgcaggagtacagcgccgacccccacgccatcgccggcgccctgaagagctacctgagagagctgcccgagcccctgatgaccttcgagctgtacgacgagtggatccaggccagcaacgtgcaggagcaggacaagaagctgcaggccctgtggaacgcctgcgagaagctgcccaaggccaaccacaacaacatcagatacctgatcaagttcctgagcaagctgagcgagtaccaggacgtgaacaagatgacccccagcaacatggccatcgtgctgggccccaacctgctgtggccccaggccgagggcaacatcaccgagatgatgaccaccgtgagcctgcagatcgtgggcatcatcgagcccatcatccagcacgccgactggttcttccccggcgagatcgagttcaacatcaccggcaactacggcagccccgtgcacgtgaaccacaacgccaactacagcagcatgcccagccccgacatggaccccgccgacagaagacagcccgagcaggccagaagacccctgagcgtggccaccgacaacatgatgctggagttctacaagaaggacggcctgagaaagatccagagcatgggcgtgagagtgatggacaccaactgggtggccagaagaggcagcagcgccggcagaaaggtgagctgcgccccccccagcatgcagccccccgccccccccgccgagctggccgcccccctgcccagccccctgcccgagcagcccctggacagccccgccgcccccgccctgagccccagcggcctgggcctgcagcccggccccgagagaaccagcaccaccaagagcaaggagctgagccccggcagcgcccagaagggcagccccggcagcagccagggcaccgcctgcgccggcacccagcccggcgcccagcccggcgcccagcccggcgccagccccagccccagccagccccccgccgaccagagcccccacaccctgagaaaggtgagcaagaagctggcccccatcccccccaaggtgcccttcggccagcccggcgccatggccgaccagagcgccggccagcccagccccgtgagcctgagccccaccccccccagcacccccagcccctacggcctgagctacccccagggctacagcctggccagcggccagctgagccccgccgccgccccccccctggccagccccagcgtgttcaccagcaccctgagcaagagcagacccacccccaagcccagacagagacccaccctgccccccccccagccccccaccgtgaacctgagcgccagcagcccccagagcaccgaggcccccatgctggacggcatgagccccggcgagagcatgagcaccgacctggtgcacttcgacatccccagcatccacatcgagctgggcagcaccctgagactgagccccctggagcacatgagaagacacagcgtgaccgacaagagagacagcgaggaggagagcgagagcaccgccctgtag

SEQ ID NO: 11123 - DNA, 1014 bp, Artificial Sequence
  Description of Artificial Sequence: Synthetic coding sequence
atgaccaacaacagcggcagcaaggccgagctggtggtgggcggcaagtacaagctggtgagaaagatcggcagcggcagcttcggcgacgtgtacctgggcatcaccaccaccaacggcgaggacgtggccgtgaagctggagagccagaaggtgaagcacccccagctgctgtacgagagcaagctgtacaccatcctgcagggcggcgtgggcatcccccacatgcactggtacggccaggagaaggacaacaacgtgctggtgatggacctgctgggccccagcctggaggacctgttcaacttctgcagcagaagattcaccatgaagaccgtgctgatgctggccgaccagatgatcagcagaatcgagtacgtgcacaccaagaacttcctgcacagagacatcaagcccgacaacttcctgatgggcaccggcagacactgcaacaagctgttcctgatcgacttcggcctggccaagaagtacagagacaacagaaccagacagcacatcccctacagagaggacaagcacctgatcggcaccgtgagatacgccagcatcaacgcccacctgggcatcgagcagagcagaagagacgacatggagagcctgggctacgtgttcatgtacttcaacagaaccagcctgccctggcagggcctgagagccatgaccaagaagcagaagtacgagaagatcagcgagaagaagatgagcacccccgtggaggtgctgtgcaagggcttccccgccgagttcgccatgtacctgaactactgcagaggcctgagattcgaggaggtgcccgactacatgtacctgagacagctgttcagaatcctgttcagaaccctgaaccaccagtacgactacaccttcgactggaccatgctgaagcagaaggccgcccagcaggccgccagcagcagcggccagggccagcaggcccagacccagaccggcaagcagaccgagaagaacaagaacaacgtgaaggacaactag

SEQ ID NO: 11124 - DNA, 1608 bp, Artificial Sequence
  Description of Artificial Sequence: Synthetic coding sequence
atgagcgagggcgagagccagaccgtgctgagcagcggcagcgaccccaaggtggagagcagcagcagcgcccccggcctgaccagcgtgagcccccccgtgaccagcaccaccagcgccgccagccccgaggaggaggaggagagcgaggacgagagcgagatcctggaggagagcccctgcggcagatggcagaagagaagagaggaggtgaaccagagaaacgtgcccggcatcgacagcgcctacctggccatggacaccgaggagggcgtggaggtggtgtggaacgaggtgcagttcagcgagagaaagaactacaagctgcaggaggagaaggtgagagccgtgttcgacaacctgatccagctggagcacctgaacatcgtgaagttccacaagtactgggccgacatcaaggagaacaaggccagagtgatcttcatcaccgagtacatgagcagcggcagcctgaagcagttcctgaagaagaccaagaagaaccacaagaccatgaacgagaaggcctggaagagatggtgcacccagatcctgagcgccctgagctacctgcacagctgcgacccccccatcatccacggcaacctgacctgcgacaccatcttcatccagcacaacggcctgatcaagatcggcagcgtggcccccgacaccatcaacaaccacgtgaagacctgcagagaggagcagaagaacctgcacttcttcgcccccgagtacggcgaggtgaccaacgtgaccaccgccgtggacatctacagcttcggcatgtgcgccctggagatggccgtgctggagatccagggcaacggcgagagcagctacgtgccccaggaggccatcagcagcgccatccagctgctggaggaccccctgcagagagagttcatccagaagtgcctgcagagcgagcccgccagaagacccaccgccagagagctgctgttccaccccgccctgttcgaggtgcccagcctgaagctgctggccgcccactgcatcgtgggccaccagcacatgatccccgagaacgccctggaggagatcaccaagaacatggacaccagcgccgtgctggccgagatccccgccggccccggcagagagcccgtgcagaccctgtacagccagagccccgccctggagctggacaagttcctggaggacgtgagaaacggcatctaccccctgaccgccttcggcctgcccagaccccagcagccccagcaggaggaggtgaccagccccgtggtgccccccagcgtgaagacccccacccccgagcccgccgaggtggagaccagaaaggtggtgctgatgcagtgcaacatcgagagcgtggaggagggcgtgaagcaccacctgaccctgctgctgaagctggaggacaagctgaacagacacctgagctgcgacctgatgcccaacgagaacatccccgagctggccgccgagctggtgcagctgggcttcatcagcgaggccgaccagagcagactgaccagcctgctggaggagaccctgaacaagttcaacttcgccagaaacagcaccctgaacagcgccgccgtgaccgtgagcagctag

SEQ ID NO: 11125 - DNA, 2169 bp, Artificial Sequence
  Description of Artificial Sequence: Synthetic coding sequence
atggagaccagcgacatccagatcttctaccaggaggaccccgagtgccagaacctgagcgagaacagctgcccccccagcgaggtgagcgacaccaacctgtacagccccttcaagcccagaaactaccagctggagctggccctgcccgccatgaagggcaagaacaccatcatctgcgcccccaccggctgcggcaagaccttcgtgagcctgctgatctgcgagcaccacctgaagaagttcccccagggccagaagggcaaggtggtgttcttcgccaaccagatccccgtgtacgagcagcagaagagcgtgttcagcaagtacttcgagagacacggctacagagtgaccggcatcagcggcgccaccgccgagaacgtgcccgtggagcagatcgtggagaacaacgacatcatcatcctgaccccccagatcctggtgaacaacctgaagaagggcaccatccccagcctgagcatcttcaccctgatgatcttcgacgagtgccacaacaccagcaagcagcacccctacaacatgatcatgttcaactacctggaccagaagctgggcggcagcagcggccccctgccccaggtgatcggcctgaccgccagcgtgggcgtgggcgacgccaagaacaccgacgaggccctggactacatctgcaagctgtgcgccagcctggacgccagcgtgatcgccaccgtgaagcacaacctggaggagctggagcaggtggtgtacaagccccagaagttcttcagaaaggtggagagcagaatcagcgacaagttcaagtacatcatcgcccagctgatgagagacaccgagagcctggccaagagaatctgcaaggacctggagaacctgagccagatccagaacagagagttcggcacccagaagtacgagcagtggatcgtgaccgtgcagaaggcctgcatggtgttccagatgcccgacaaggacgaggagagcagaatctgcaaggccctgttcctgtacaccagccacctgagaaagtacaacgacgccctgatcatcagcgagcacgccagaatgaaggacgccctggactacctgaaggacttcttcagcaacgtgagagccgccggcttcgacgagatcgagcaggacctgacccagagattcgaggagaagctgcaggagctggagagcgtgagcagagaccccagcaacgagaaccccaagctggaggacctgtgcttcatcctgcaggaggagtaccacctgaaccccgagaccatcaccatcctgttcgtgaagaccagagccctggtggacgccctgaagaactggatcgagggcaaccccaagctgagcttcctgaagcccggcatcctgaccggcagaggcaagaccaaccagaacaccggcatgaccctgcccgcccagaagtgcatcctggacgccttcaaggccagcggcgaccacaacatcctgatcgccaccagcgtggccgacgagggcatcgacatcgcccagtgcaacctggtgatcctgtacgagtacgtgggcaacgtgatcaagatgatccagaccagaggcagaggcagagccagaggcagcaagtgcttcctgctgaccagcaacgccggcgtgatcgagaaggagcagatcaacatgtacaaggagaagatgatgaacgacagcatcctgagactgcagacctgggacgaggccgtgttcagagagaagatcctgcacatccagacccacgagaagttcatcagagacagccaggagaagcccaagcccgtgcccgacaaggagaacaagaagctgctgtgcagaaagtgcaaggccctggcctgctacaccgccgacgtgagagtgatcgaggagtgccactacaccgtgctgggcgacgccttcaaggagtgcttcgtgagcagaccccaccccaagcccaagcagttcagcagcttcgagaagagagccaagatcttctgcgccagacagaactgcagccacgactggggcatccacgtgaagtacaagaccttcgagatccccgtgatcaagatcgagagcttcgtggtggaggacatcgccaccggcgtgcagaccctgtacagcaagtggaaggacttccacttcgagaagatccccttcgaccccgccgagatgagcaagtag

SEQ ID NO: 11126 - DNA, 2643 bp, Artificial Sequence
  Description of Artificial Sequence: Synthetic coding sequence
atgaccaccgagcagagaagaagcctgcaggccttccaggactacatcagaaagaccctggaccccacctacatcctgagctacatggccccctggttcagagagggctacagcggcctgtacgaggccatcgagagctgggacttcaagaagatcgagaagctggaggagtacagactgctgctgaagagactgcagcccgagttcaagaccagaatcatccccaccgacatcatcagcgacctgagcgagtgcctgatcaaccaggagtgcgaggagatcctgcagatctgcagcaccaagggcatgatggccggcgccgagaagctggtggagtgcctgctgagaagcgacaaggagaactggcccaagaccctgaagctggccctggagaaggagagaaacaagttcagcgagctgtggatcgtggagaagggcatcaaggacgtggagaccgaggacctggaggacaagatggagaccagcgacatccagatcttctaccaggaggaccccgagtgccagaacctgagcgagaacagctgcccccccagcgaggtgagcgacaccaacctgtacagccccttcaagcccagaaactaccagctggagctggccctgcccgccatgaagggcaagaacaccatcatctgcgcccccaccggctgcggcaagaccttcgtgagcctgctgatctgcgagcaccacctgaagaagttcccccagggccagaagggcaaggtggtgttcttcgccaaccagatccccgtgtacgagcagcagaagagcgtgttcagcaagtacttcgagagacacggctacagagtgaccggcatcagcggcgccaccgccgagaacgtgcccgtggagcagatcgtggagaacaacgacatcatcatcctgaccccccagatcctggtgaacaacctgaagaagggcaccatccccagcctgagcatcttcaccctgatgatcttcgacgagtgccacaacaccagcaagcagcacccctacaacatgatcatgttcaactacctggaccagaagctgggcggcagcagcggccccctgccccaggtgatcggcctgaccgccagcgtgggcgtgggcgacgccaagaacaccgacgaggccctggactacatctgcaagctgtgcgccagcctggacgccagcgtgatcgccaccgtgaagcacaacctggaggagctggagcaggtggtgtacaagccccagaagttcttcagaaaggtggagagcagaatcagcgacaagttcaagtacatcatcgcccagctgatgagagacaccgagagcctggccaagagaatctgcaaggacctggagaacctgagccagatccagaacagagagttcggcacccagaagtacgagcagtggatcgtgaccgtgcagaaggcctgcatggtgttccagatgcccgacaaggacgaggagagcagaatctgcaaggccctgttcctgtacaccagccacctgagaaagtacaacgacgccctgatcatcagcgagcacgccagaatgaaggacgccctggactacctgaaggacttcttcagcaacgtgagagccgccggcttcgacgagatcgagcaggacctgacccagagattcgaggagaagctgcaggagctggagagcgtgagcagagaccccagcaacgagaaccccaagctggaggacctgtgcttcatcctgcaggaggagtaccacctgaaccccgagaccatcaccatcctgttcgtgaagaccagagccctggtggacgccctgaagaactggatcgagggcaaccccaagctgagcttcctgaagcccggcatcctgaccggcagaggcaagaccaaccagaacaccggcatgaccctgcccgcccagaagtgcatcctggacgccttcaaggccagcggcgaccacaacatcctgatcgccaccagcgtggccgacgagggcatcgacatcgcccagtgcaacctggtgatcctgtacgagtacgtgggcaacgtgatcaagatgatccagaccagaggcagaggcagagccagaggcagcaagtgcttcctgctgaccagcaacgccggcgtgatcgagaaggagcagatcaacatgtacaaggagaagatgatgaacgacagcatcctgagactgcagacctgggacgaggccgtgttcagagagaagatcctgcacatccagacccacgagaagttcatcagagacagccaggagaagcccaagcccgtgcccgacaaggagaacaagaagctgctgtgcagaaagtgcaaggccctggcctgctacaccgccgacgtgagagtgatcgaggagtgccactacaccgtgctgggcgacgccttcaaggagtgcttcgtgagcagaccccaccccaagcccaagcagttcagcagcttcgagaagagagccaagatcttctgcgccagacagaactgcagccacgactggggcatccacgtgaagtacaagaccttcgagatccccgtgatcaagatcgagagcttcgtggtggaggacatcgccaccggcgtgcagaccctgtacagcaagtggaaggacttccacttcgagaagatccccttcgaccccgccgagatgagcaagtag

SEQ ID NO: 11127 - DNA, 2778 bp, Artificial Sequence
  Description of Artificial Sequence: Synthetic coding sequence
atgaccaccgagcagagaagaagcctgcaggccttccaggactacatcagaaagaccctggaccccacctacatcctgagctacatggccccctggttcagagaggaggaggtgcagtacatccaggccgagaagaacaacaagggccccatggaggccgccaccctgttcctgaagttcctgctggagctgcaggaggagggctggttcagaggcttcctggacgccctggaccacgccggctacagcggcctgtacgaggccatcgagagctgggacttcaagaagatcgagaagctggaggagtacagactgctgctgaagagactgcagcccgagttcaagaccagaatcatccccaccgacatcatcagcgacctgagcgagtgcctgatcaaccaggagtgcgaggagatcctgcagatctgcagcaccaagggcatgatggccggcgccgagaagctggtggagtgcctgctgagaagcgacaaggagaactggcccaagaccctgaagctggccctggagaaggagagaaacaagttcagcgagctgtggatcgtggagaagggcatcaaggacgtggagaccgaggacctggaggacaagatggagaccagcgacatccagatcttctaccaggaggaccccgagtgccagaacctgagcgagaacagctgcccccccagcgaggtgagcgacaccaacctgtacagccccttcaagcccagaaactaccagctggagctggccctgcccgccatgaagggcaagaacaccatcatctgcgcccccaccggctgcggcaagaccttcgtgagcctgctgatctgcgagcaccacctgaagaagttcccccagggccagaagggcaaggtggtgttcttcgccaaccagatccccgtgtacgagcagcagaagagcgtgttcagcaagtacttcgagagacacggctacagagtgaccggcatcagcggcgccaccgccgagaacgtgcccgtggagcagatcgtggagaacaacgacatcatcatcctgaccccccagatcctggtgaacaacctgaagaagggcaccatccccagcctgagcatcttcaccctgatgatcttcgacgagtgccacaacaccagcaagcagcacccctacaacatgatcatgttcaactacctggaccagaagctgggcggcagcagcggccccctgccccaggtgatcggcctgaccgccagcgtgggcgtgggcgacgccaagaacaccgacgaggccctggactacatctgcaagctgtgcgccagcctggacgccagcgtgatcgccaccgtgaagcacaacctggaggagctggagcaggtggtgtacaagccccagaagttcttcagaaaggtggagagcagaatcagcgacaagttcaagtacatcatcgcccagctgatgagagacaccgagagcctggccaagagaatctgcaaggacctggagaacctgagccagatccagaacagagagttcggcacccagaagtacgagcagtggatcgtgaccgtgcagaaggcctgcatggtgttccagatgcccgacaaggacgaggagagcagaatctgcaaggccctgttcctgtacaccagccacctgagaaagtacaacgacgccctgatcatcagcgagcacgccagaatgaaggacgccctggactacctgaaggacttcttcagcaacgtgagagccgccggcttcgacgagatcgagcaggacctgacccagagattcgaggagaagctgcaggagctggagagcgtgagcagagaccccagcaacgagaaccccaagctggaggacctgtgcttcatcctgcaggaggagtaccacctgaaccccgagaccatcaccatcctgttcgtgaagaccagagccctggtggacgccctgaagaactggatcgagggcaaccccaagctgagcttcctgaagcccggcatcctgaccggcagaggcaagaccaaccagaacaccggcatgaccctgcccgcccagaagtgcatcctggacgccttcaaggccagcggcgaccacaacatcctgatcgccaccagcgtggccgacgagggcatcgacatcgcccagtgcaacctggtgatcctgtacgagtacgtgggcaacgtgatcaagatgatccagaccagaggcagaggcagagccagaggcagcaagtgcttcctgctgaccagcaacgccggcgtgatcgagaaggagcagatcaacatgtacaaggagaagatgatgaacgacagcatcctgagactgcagacctgggacgaggccgtgttcagagagaagatcctgcacatccagacccacgagaagttcatcagagacagccaggagaagcccaagcccgtgcccgacaaggagaacaagaagctgctgtgcagaaagtgcaaggccctggcctgctacaccgccgacgtgagagtgatcgaggagtgccactacaccgtgctgggcgacgccttcaaggagtgcttcgtgagcagaccccaccccaagcccaagcagttcagcagcttcgagaagagagccaagatcttctgcgccagacagaactgcagccacgactggggcatccacgtgaagtacaagaccttcgagatccccgtgatcaagatcgagagcttcgtggtggaggacatcgccaccggcgtgcagaccctgtacagcaagtggaaggacttccacttcgagaagatccccttcgaccccgccgagatgagcaagtag

SEQ ID NO: 11128 - DNA, 987 bp, Artificial Sequence
  Description of Artificial Sequence: Synthetic coding sequence
atggacggcgaggacatccccgacttcagcagcctgaaggaggagaccgcctactggaaggagctgagcctgaagtacaagcagagcttccaggaggccagagacgagctggtggagttccaggagggcagcagagagctggaggccgagctggaggcccagctggtgcaggccgagcagagaaacagagacctgcaggccgacaaccagagactgaagtacgaggtggaggccctgaaggagaagctggagcaccagtacgcccagagctacaagcaggtgagcgtgctggaggacgacctgagccagaccagagccatcaaggagcagctgcacaagtacgtgagagagctggagcaggccaacgacgacctggagagagccaagagagccaccatcgtgagcctggaggacttcgagcagagactgaaccaggccatcgagagaaacgccttcctggagagcgagctggacgagaaggagagcctgctggtgagcgtgcagagactgaaggacgaggccagagacctgagacaggagctggccgtgagagagagacagcaggaggtgaccagaaagagcgcccccagcagccccaccctggactgcgagaagatggacagcgccgtgcaggccagcctgagcctgcccgccacccccgtgggcaagggcaccgagaacaccttccccagccccaaggccatccccaacggcttcggcaccagccccctgacccccagcgccagaatcagcgccctgaacatcgtgggcgacctgctgagaaaggtgggcgccctggagagcaagctggccgcctgcagaaacttcgccaaggaccaggccagcagaaagagctacatcagcggcaacgtgaactgcggcgtgctgaacggcaacggcaccaagttcagcagaagcggccacaccagcttcttcgacaagggccaggagaaggtgatcttccccaccctgttcatgggccagtag

SEQ ID NO: 11129 - DNA, 2898 bp, Artificial Sequence
  Description of Artificial Sequence: Synthetic coding sequence
atggccctgctgtgcggcctgggccaggtgaccctgagaatctgggtgagcctgcccagccagagcgagaacggcatcggcttcctggccgccagagccttcctgagaagcggcggcatggaggccctgaccacccagctgggccccggcagagagggcagcagcagccccaacagcaagcaggagctgcagccctacagcggcagcagcgccctgaagcccaaccaggtgggcgagaccagcctgtacggcgtgcccatcgtgagcctggtgatcgacggccaggagagactgtgcctggcccagatcagcaacaccctgctgaagaactacagctacaacgagatccacaacagaagagtggccctgggcatcacctgcgtgcagtgcacccccgtgcagctggagatcctgagaagagccggcgccatgcccatcagcagcagaagatgcggcatgatcaccaagagagaggccgagagactgtgcaagagcttcctgggcgagcacaagccccccaagctgcccgagaacttcgccttcgacgtggtgcacgagtgcgcctggggcagcagaggcagcttcatccccgccagatacaacagcagcagagccaagtgcatcaagtgcggctactgcagcatgtacttcagccccaacaagttcatcttccacagccacagaacccccgacgccaagtacacccagcccgacgccgccaacttcaacagctggagaagacacctgaagctgagcgacaagagcgccaccgacgagctgagccacgcctgggaggacgtgaaggccatgttcaacggcggcaccagaaagagaaccttcagcctgcagggcggcggcggcggcggcgccaacggcggcagcggcggccagggcaagggcggcgccggcggcggcggcggcggcggccccggctgcggcgccgagatggcccccggcccccccccccacaagagcctgagatgcggcgaggacgaggccgccggcccccccggccccccccccccccacccccagagaggcctgggcctggccaccggcgccagcggccccgccggccccggcggccccggcggcggcgccggcgtgagaagctaccccgtgatccccgtgcccagcaagggcttcggcctgctgcagaagctgcccccccccctgttcccccacccctacggcttccccaccgccttcggcctgtgccccaagaaggacgaccccgtgctgggcgccggcgagcccaagggcggccccggcaccggcagcggcggcggcggcgccggcaccggcggcggcgccggcggccccggcgccagccacctgccccccggcgccggcgccggccccggcggcggcgccatgttctggggccaccagcccagcggcgccgccaaggacgccgccgccgtggccgccgccgccgccgccgccaccgtgtaccccaccttccccatgttctggcccgccgccggcagcctgcccgtgcccagctaccccgccgcccagagccaggccaaggccgtggccgccgccgtggccgccgccgccgccgccgccgccgccgccgccggcagcggcgcccccgagcccctggacggcgccgagcccgccaaggagagcggcctgggcgccgaggagagatgccccagcgccctgagcagaggccccctggacgaggacggcaccgacgaggccctgcccccccccctggcccccctgcccccccccccccccccccccgccagaaagggcagctacgtgagcgccttcagacccgtggtgaaggacaccgagagcatcgccaagctgtacggcagcgccagagaggcctacggcgccggccccgccagaggccccggccccggcgccggcagcggcggctacgtgagccccgacttcctgagcgagggcagcagcagctacaacagcgccagccccgacgtggacaccgccgacgagcccgaggtggacgtggagagcaacagattccccgacgacgaggacgcccaggaggagaccgagcccagcgcccccagcgccggcggcggccccgacggcgagcagcccaccggcccccccagcgccaccagcagcggcgccgacggccccgccaacagccccgacggcggcagccccagacccagaagaagactgggccccccccccgccggcagacccgccttcggcgacctggccgccgaggacctggtgagaagacccgagagaagcccccccagcggcggcggcggctacgagctgagagagccctgcggccccctgggcggccccgcccccgccaaggtgttcgcccccgagagagacgagcacgtgaagagcgccgccgtggccctgggccccgccgccagctacgtgtgcacccccgaggcccacgagcccgacaaggaggacaaccacagccccgccgacgacctggagaccagaaagagctaccccgaccagagaagcatcagccagcccagccccgccaacaccgacagaggcgaggacggcctgaccctggacgtgaccggcacccacctggtggagaaggacatcgagaacctggccagagaggagctgcagaagctgctgctggagcagatggagctgagaaagaagctggagagagagttccagagcctgaaggacaacttccaggaccagatgaagagagagctggcctacagagaggagatggtgcagcagctgcagatcgtgagagacaccctgtgcaacgagctggaccaggagagaaaggccagatacgccatccagcagaagctgaaggaggcccacgacgccctgcaccacttcagctgcaagatgctgacccccagacactgcaccggcaactgcagcttcaagccccccctgctgccctag

SEQ ID NO: 11130 - DNA, 1803 bp, Artificial Sequence
  Description of Artificial Sequence: Synthetic coding sequence
atggccagcaaccacaagagcagcgccgccagacccgtgagcagaggcggcgtgggcctgaccggcagaccccccagcggcatcagacccctgagcggcaacatcagagtggccaccgccatgccccccggcaccgccagacccggcagcagaggctgccccatcggcaccggcggcgtgctgagcagccagatcaaggtggcccacagacccgtgacccagcagggcctgaccggcatgaagaccggcaccaagggcccccagagacagatcctggacaagagctactacctgggcctgctgagaagcaagatcagcgagctgaccaccgaggtgaacaagctgcagaagggcatcgagatgtacaaccaggagaacagcgtgtacctgagctacgagaagagagccgagaccctggccgtggagatcaaggagctgcagggccagctggccgactacaacatgctggtggacaagctgaacaccaacaccgagatggaggaggtgatgaacgactacaacatgctgaaggcccagaacgacagagagacccagagcctggacgtgatcttcaccgagagacaggccaaggagaagcagatcagaagcgtggaggaggagatcgagcaggagaagcaggccaccgacgacatcatcaagaacatgagcttcgagaaccaggtgaagtacctggagatgaagaccaccaacgagaagctgctgcaggagctggacaccctgcagcagcagctggacagccagaacatgaagaaggagagcctggaggccgagatcgcccacagccaggtgaagcaggaggccgtgctgctgcacgagaagctgtacgagctggagagccacagagaccagatgatcgccgaggacaagagcatcggcagccccatggaggagagagagaagctgctgaagcagatcaaggacgacaaccaggagatcgccagcatggagagacagctgaccgacaccaaggagaagatcaaccagttcatcgaggagatcagacagctggacatggacctggaggagcaccagggcgagatgaaccagaagtacaaggagctgaagaagagagaggagcacatggacaccttcatcgagaccttcgaggagaccaagaaccaggagctgaagagaaaggcccagatcgaggccaacatcgtggccctgctggagcactgcagcagaaacatcaacagaatcgagcagatcagcagcatcaccaaccaggagctgaagatgatgcaggacgacctgaacttcaagagcaccgaggtgcagaagagccagagcaccgcccagaacctgaccagcgacatccagagactgcagctggacctgcagaagatggagctgctggagagcaagatgaccgaggagcagcacagcctgaagagcaagatcaagcagatgaccaccgacctggagatctacaacgacctgcccgccctgaagagcagcggcgaggagaagatcaagaagctgcaccaggagagaatgatcctgagcacccacagaaacgccttcaagaagatcatggagaagcagaacatcgagtacgaggccctgaagacccagctgcaggagaacgagacccacagccagctgaccaacctggagagaaagtggcagcacctggagcagaacaacttcgccatgaaggagttcatcgccaccaagagccaggagagcgactaccagcccatcaagaagaacgtgaccaagcagatcgccgagtacaacaagaccatcgtggacgccctgcacagcaccagcggcaactag

SEQ ID NO: 11131 - DNA, 582 bp, Artificial Sequence
  Description of Artificial Sequence: Synthetic coding sequence
atgctggtggccggcaacgacagagtgcaggccgtgatcacccagatggaggaggtgtgccagaccatcgaggacaacagcagaagacagaagcagctgctgaaccagagattcgagagcctgtgcgccgtgctggaggagagaaagggcgagctgctgcaggccctggccagagagcaggaggagaagctgcagagagtgagaggcctgatcagacagtacggcgaccacctggaggccagcagcaagctggtggagagcgccatccagagcatggaggagccccagatggccctgtacctgcagcaggccaaggagctgatcaacaaggtgggcgccatgagcaaggtggagctggccggcagacccgagcccggctacgagagcatggagcagttcaccgtgagagtggagcacgtggccgagatgctgagaaccatcgacttccagcccggcgccagcggcgaggaggaggaggtggcccccgacggcgaggagggcagcgccggccccgaggaggagagacccgacggccccctgggcccctacagcgcctacgtgagcctgtgcggcgccccctag

SEQ ID NO: 11132 - DNA, 1077 bp, Artificial Sequence
  Description of Artificial Sequence: Synthetic coding sequence
atgaacttcaccgtgggcttcaagcccctgctgggcgacgcccacagcatggacaacctggagaagcagctgatctgccccatctgcctggagatgttcagcaagcccgtggtgatcctgccctgccagcacaacctgtgcagaaagtgcgccaacgacgtgttccaggccagcaaccccctgtggcagagcagaggcagcaccaccgtgagcagcggcggcagattcagatgccccagctgcagacacgaggtggtgctggacagacacggcgtgtacggcctgcagagaaacctgctggtggagaacatcatcgacatctacaagcaggagagcagcagacccctgcacagcaaggccgagcagcacctgatgtgcgaggagcacgaggaggagaagatcaacatctactgcctgagctgcgaggtgcccacctgcagcctgtgcaaggtgttcggcgcccacaaggactgcgaggtggcccccctgcccaccatctacaagagacagaagagcgagctgagcgacggcatcgccatgctggtggccggcaacgacagagtgcaggccgtgatcacccagatggaggaggtgtgccagaccatcgaggacaacagcagaagacagaagcagctgctgaaccagagattcgagagcctgtgcgccgtgctggaggagagaaagggcgagctgctgcaggccctggccagagagcaggaggagaagctgcagagagtgagaggcctgatcagacagtacggcgaccacctggaggccagcagcaagctggtggagagcgccatccagagcatggaggagccccagatggccctgtacctgcagcaggccaaggagctgatcaacaaggtgggcgccatgagcaaggtggagctggccggcagacccgagcccggctacgagagcatggagcagttcaccgtgagagtggagcacgtggccgagatgctgagaaccatcgacttccagcccggcgccagcggcgaggaggaggaggtggcccccgacggcgaggagggcagcgccggccccgaggaggagagacccgacggcccctag

SEQ ID NO: 11133 - DNA, 756 bp, Artificial Sequence
  Description of Artificial Sequence: Synthetic coding sequence
atggccgccagcaccatgagcatctgcagcagcgcctgcaccgacagctggagagtggtggactgccccgagagctgctgcgagccctgctgctgcgcccccgcccccagcctgaccctggtgtgcacccccgtgagctgcgtgagcagcccctgctgccagaccgcctgcgagcccagcgcctgccagagcggctacaccagcagctgcaccaccccctgctaccagcagagcagctgccagcccgactgctgcaccagcagcccctgccagcaggcctgctgcgtgcccgtgtgctgcgtgcccgtgtgctgcgtgcccgtgtgcaacaagcccgtgtgcttcgtgcccacctgcagcgagagcagccccagctgctgccagcagagcagctgccagcccacctgctgcaccagcagcccctgccagcaggcctgctgcgtgcccgtgtgcagcaagagcgtgtgctacgtgcccgtgtgcagcggcgccagcaccagctgctgccagcagagcagctgccagcccgcctgctgcaccgccagctgctgcagacccagcagcagcgtgagcctgctgtgccaccccgtgtgcaagagcacctgctgcgtgcccgtgcccagctgcggcgccagcgccagcagctgccagcccagctgctgcagaaccgccagctgcgtgagcctgctgtgcagacccgtgtgcagcagacccgcctgctacagcctgtgcagcggccagaagagcagctgctag

SEQ ID NO: 11134 - DNA, 1128 bp, Artificial Sequence
  Description of Artificial Sequence: Synthetic coding sequence
atggccgccagcaccatgagcgtgtgcagcagcgacctgagctacggcagcagagtgtgcctgcccggcagctgcgacagctgcagcgacagctggcaggtggacgactgccccgagagctgctgcgagcccccctgctgcgcccccagctgctgcgcccccgccccctgcctgagcctggtgtgcacccccgtgagcagagtgagcagcccctgctgccccgtgacctgcgagcccagcccctgccagagcggctgcaccagcagctgcacccccagctgctgccagcagagcagctgccagctggcctgctgcgccagcagcccctgccagcaggcctgctgcatgcccgtgtgctgcaagaccgtgtgctgcaagcccgtgtactgcgtgcccgtgtgcagcggcgacagcagctgctgccagcagagcagctgccagagcgcctgctgcaccagcagcccctgccagcaggcctgctgcgtgcccatctgctgcaagcccgtgtgcagcggcatcagcagcagctgctgccagcagagcagctgcgtgagctgcgtgagcagcccctgctgccaggccgtgtgcgagcccagcccctgccagagcggctgcatcagcagctgcacccccagctgctgccagcagagcagctgccagcccgcctgctgcaccagcagcccctgccagcaggcctgctgcgtgcccgtgtgctgcaagcccgtgtgctgcgtgcccacctgcagcgacgacagcggcagctgctgccagcccgcctgctgcaccagcagccagagccagcagggctgctgcgtgcccgtgtgctgcaagcccgtgtgctgcgtgcccgtgtgcagcggcgccagcagcagctgctgccagcagagcagctgccagcccgcctgctgcaccaccagctgctgcagacccagcagcagcgtgagcctgctgtgcagacccgtgtgcagacccacctgctgcgtgcccgtgcccagctgctgcgcccccaccagcagctgccaggccagctgctgcagacccgccagctgcgtgagcctgctgtgcagacccgcctgcagcagacccgcctgctgcggccccaccagcacccagaagagcagctgctag

SEQ ID NO: 11135 - DNA, 1587 bp, Artificial Sequence
  Description of Artificial Sequence: Synthetic coding sequence
atggccaccagagtggaggaggccgccagaggcagaggcggcggcgccgaggaggccaccgaggccggcagaggcggcagaagaagaagccccagacagaagttcgagatcggcaccatggaggaggccggcatctgcggcctgggcgtgaaggccgacatgctgtgcaacagccagagcaacgacatcctgcagcaccagggcagcaactgcggcggcaccagcaacaagcacagcctggaggaggacgagggcagcgacttcatcaccgagaacagaaacctggtgagccccgcctactgcacccaggagagcagagaggagatccccggcggcgaggccagaaccgacccccccgacggccagcaggacagcgagtgcaacagaaacaaggagaagaccctgggcaaggaggtgctgctgctgatgcaggccctgaacaccctgagcacccccgaggagaagctggccgccctgtgcaagaagtacgccgacctgctggaggagagcagaagcgtgcagaagcagatgaagatcctgcagaagaagcaggcccagatcgtgaaggagaaggtgcacctgcagagcgagcacagcaaggccatcctggccagaagcaagctggagagcctgtgcagagagctgcagagacacaacaagaccctgaaggaggagaacatgcagcaggccagagaggaggaggagagaagaaaggaggccaccgcccacttccagatcaccctgaacgagatccaggcccagctggagcagcacgacatccacaacgccaagctgagacaggagaacatcgagctgggcgagaagctgaagaagctgatcgagcagtacgccctgagagaggagcacatcgacaaggtgttcaagcacaaggagctgcagcagcagctggtggacgccaagctgcagcagaccacccagctgatcaaggaggccgacgagaagcaccagagagagagagagttcctgctgaaggaggccaccgagagcagacacaagtacgagcagatgaagcagcaggaggtgcagctgaagcagcagctgagcctgtacatggacaagttcgaggagttccagaccaccatggccaagagcaacgagctgttcaccaccttcagacaggagatggagaagatgaccaagaagatcaagaagctggagaaggagaccatcatctggagaaccaagtgggagaacaacaacaaggccctgctgcagatggccgaggagaagaccgtgagagacaaggagtacaaggccctgcagatcaagctggagagactggagaagctgtgcagagccctgcagaccgagagaaacgagctgaacgagaaggtggaggtgctgaaggagcaggtgagcatcaaggccgccatcaaggccgccaacagagacctggccacccccgtgatgcagccctgcaccgccctggacagccacaaggagctgaacaccagcagcaagagagccctgggcgcccacctggaggccgagcccaagagccagagaagcgccgtgcagaagccccccagcaccggcagcgcccccgccatcgagagcgtggactag

SEQ ID NO: 11136 - DNA, 399 bp, Artificial Sequence
  Description of Artificial Sequence: Synthetic coding sequence
atgagagccagcccctgcatcagccagcccgccgccagctggcaccccagacccagcgccctgagacccaccgccggcagcggccccgacaccagaacccccggcaccgtggaggacggcagcgccccctgccccgccttcagaagccccgccgtgagcccctgcggcgaggagccctgctgcttccagatcagccccgccgaggagaccctggagctgggcagactggtgagccccggcaactgcgacaccctgagccccagagccgccggcttctacgcctgccacgtgagaagcctgatcccctgcagaagcaccaagggcagatggcccctgaccgccagcgccgccggcctgagcagacacgcccagtgcggccccagcctgggcctgggctag

SEQ ID NO: 11137 - DNA, 1944 bp, Artificial Sequence
  Description of Artificial Sequence: Synthetic coding sequence
atggccgagttcagagtgagagtgagcaccggcgaggccttcggcgccggcacctgggacaaggtgagcgtgagcatcgtgggcaccagaggcgagagcccccccctgcccctggacaacctgggcaaggagttcaccgccggcgccgaggaggacttccaggtgaccctgcccgaggacgtgggcagagtgctgctgctgagagtgcacaaggccccccccgtgctgcccctgctgggccccctggcccccgacgcctggttctgcagatggttccagctgaccccccccagaggcggccacctgctgttcccctgctaccagtggctggagggcgccggcaccctggtgctgcaggagggcaccgccaaggtgagctgggccgaccaccaccccgtgctgcagcagcagagacaggaggagctgcaggccagacaggagatgtaccagtggaaggcctacaaccccggctggccccactgcctggacgagaagaccgtggaggacctggagctgaacatcaagtacagcaccgccaagaacgccaacttctacctgcaggccggcagcgccttcgccgagatgaagatcaagggcctgctggacagaaagggcctgtggagaagcctgaacgagatgaagagaatcttcaacttcagaagaacccccgccgccgagcacgccttcgagcactggcaggaggacgccttcttcgccagccagttcctgaacggcctgaaccccgtgctgatcagaagatgccactacctgcccaagaacttccccgtgaccgacgccatggtggccagcgtgctgggccccggcaccagcctgcaggccgagctggagaagggcagcctgttcctggtggaccacggcatcctgagcggcatccagaccaacgtgatcaacggcaagccccagttcagcgccgcccccatgaccctgctgtaccagagccccggctgcggccccctgctgcccctggccatccagctgagccagacccccggccccaacagccccatcttcctgcccaccgacgacaagtgggactggctgctggccaagacctgggtgagaaacgccgagttcagcttccacgaggccctgacccacctgctgcacagccacctgctgcccgaggtgttcaccctggccaccctgagacagctgccccactgccaccccctgttcaagagcaccggcatcggcatcgagggcttcagcgagctgatccagagaaacatgaagcagctgaactacagcctgctgtgcctgcccgaggacatcagaaccagaggcgtggaggacatccccggctactactacagagacgacggcatgcagatctggggcgccgtggagagattcgtgagcgagatcatcggcatctactaccccagcgacgagagcgtgcaggacgacagagagctgcaggcctgggtgagagagatcttcagcaagggcttcctgaaccaggagagcagcggcatccccagcagcctggagaccagagaggccctggtgcagtacgtgaccatggtgatcttcacctgcagcgccaagcacgccgccgtgagcgccggccagttcgacagctgcgcctggatgcccaacctgccccccagcatgcagctgcccccccccaccagcaagggcctggccacctgcgagggcttcatcgccaccctgccccccgtgaacgccacctgcgacgtgatcctggccctgtggctgctgagcaaggagcccggcgaccagagacccctgggcacctaccccgacgagcacttcaccgaggaggcccccagaagaagcatcgccaccttccagagcagactggcccagatcagcagaggcatccaggagagaaaccagggcctggtgctgccctacacctacctggacccccccctgatcgagaacagcgtgagcatctag

SEQ ID NO: 11138 - DNA, 2031 bp, Artificial Sequence
  Description of Artificial Sequence: Synthetic coding sequence
atggccgagttcagagtgagagtgagcaccggcgaggccttcggcgccggcacctgggacaaggtgagcgtgagcatcgtgggcaccagaggcgagagcccccccctgcccctggacaacctgggcaaggagttcaccgccggcgccgaggaggacttccaggtgaccctgcccgaggacgtgggcagagtgctgctgctgagagtgcacaaggccccccccgtgctgcccctgctgggccccctggcccccgacgcctggttctgcagatggttccagctgaccccccccagaggcggccacctgctgttcccctgctaccagtggctggagggcgccggcaccctggtgctgcaggagggcaccgccaaggtgagctgggccgaccaccaccccgtgctgcagcagcagagacaggaggagctgcaggccagacaggagatgtaccagtggaaggcctacaaccccggctggccccactgcctggacgagaagaccgtggaggacctggagctgaacatcaagtacagcaccgccaagaacgccaacttctacctgcaggccggcagcgccttcgccgagatgaagatcaagggcctgctggacagaaagggcctgtggagaagcctgaacgagatgaagagaatcttcaacttcagaagaacccccgccgccgagcacgccttcgagcactggcaggaggacgccttcttcgccagccagttcctgaacggcctgaaccccgtgctgatcagaagatgccactacctgcccaagaacttccccgtgaccgacgccatggtggccagcgtgctgggccccggcaccagcctgcaggccgagctggagaagggcagcctgttcctggtggaccacggcatcctgagcggcatccagaccaacgtgatcaacggcaagccccagttcagcgccgcccccatgaccctgctgtaccagagccccggctgcggccccctgctgcccctggccatccagctgagccagacccccggccccaacagccccatcttcctgcccaccgacgacaagtgggactggctgctggccaagacctgggtgagaaacgccgagttcagcttccacgaggccctgacccacctgctgcacagccacctgctgcccgaggtgttcaccctggccaccctgagacagctgccccactgccaccccctgttcaagctgctgatcccccacaccagatacaccctgcacatcaacaccctggccagagagctgctgatcgtgcccggccaggtggtggacagaagcaccggcatcggcatcgagggcttcagcgagctgatccagagaaacatgaagcagctgaactacagcctgctgtgcctgcccgaggacatcagaaccagaggcgtggaggacatccccggctactactacagagacgacggcatgcagatctggggcgccgtggagagattcgtgagcgagatcatcggcatctactaccccagcgacgagagcgtgcaggacgacagagagctgcaggcctgggtgagagagatcttcagcaagggcttcctgaaccaggagagcagcggcatccccagcagcctggagaccagagaggccctggtgcagtacgtgaccatggtgatcttcacctgcagcgccaagcacgccgccgtgagcgccggccagttcgacagctgcgcctggatgcccaacctgccccccagcatgcagctgcccccccccaccagcaagggcctggccacctgcgagggcttcatcgccaccctgccccccgtgaacgccacctgcgacgtgatcctggccctgtggctgctgagcaaggagcccggcgaccagagacccctgggcacctaccccgacgagcacttcaccgaggaggcccccagaagaagcatcgccaccttccagagcagactggcccagatcagcagaggcatccaggagagaaaccagggcctggtgctgccctacacctacctggacccccccctgatcgagaacagcgtgagcatctag

SEQ ID NO: 11139 - DNA, 1665 bp, Artificial Sequence
  Description of Artificial Sequence: Synthetic coding sequence
atggccaccagcgccgacagccccagcagccccctgggcgccgaggacctgctgagcgacagcagcgagccccccggcctgaaccaggtgagcagcgaggtgaccagccagctgtacgccagcctgagactgagcagacaggccgaggccaccgccagagcccagctgtacctgcccagcaccagccccccccacgagggcctggacggcttcgcccaggagctgagcagaagcctgagcgtgggcctggagaagaacctgaagaagaaggacggcagcaagcacatcttcgagatggagagcgtgagaggccagctgcagaccatgctgcagaccagcagagacaccgcctacagagaccccctgatccccggcgccggcagcgagagaagagaggaggacagcttcgacagcgacagcaccgccaccctgctgaacaccagacccctgcaggacctgagccccagcagcagcgcccaggccctggaggagctgttccccagatacaccagcctgagacccggcccccccctgaacccccccgacttccagggcctgagagacgccctggacagcgagcacaccagaagaaagcactgcgagagacacatccagagcctgcagaccagagtgctggagctgcagcagcagctggccgtggccgtggccgccgacagaaagaaggacaccatgatcgagcagctggacaagaccctggccagagtggtggagggctggaacagacacgaggccgagagaaccgaggtgctgagaggcctgcaggaggagcaccaggccgccgagctgaccagaagcaagcagcaggagaccgtgaccagactggagcagagcctgagcgaggccatggaggccctgaacagagagcaggagagcgccagactgcagcagagagagagagagaccctggaggaggagagacaggccctgaccctgagactggaggccgagcagcagagatgctgcgtgctgcaggaggagagagacgccgccagagccggccagctgagcgagcacagagagctggagaccctgagagccgccctggaggaggagagacagacctgggcccagcaggagcaccagctgaaggagcactaccaggccctgcaggaggagagccaggcccagctggagagagagaaggagaagagccagagagaggcccaggccgcctgggagacccagcaccagctggccctggtgcagagcgaggtgagaagactggagggcgagctggacaccgccagaagagagagagacgccctgcagctggagatgagcctggtgcaggccagatacgagagccagagaatccagctggagagcgagctggccgtgcagctggagcagagagtgaccgagagactggcccaggcccaggagagcagcctgagacaggccgccagcctgagagagcaccacagaaagcagctgcaggacctgagcggccagcaccagcaggagctggccagccagctggcccagttcaaggtggagatggccgagagagaggagagacagcagcaggtggccgaggactacgagctgagactgctgctgctggacccccccgcccccggcctgagaagccccagaagaagaagaggcggcagcggcctgtgcctgccctggccctggccctag

SEQ ID NO: 11140 - DNA, 2778 bp, Artificial Sequence
  Description of Artificial Sequence: Synthetic coding sequence
atggccaccagcgccgacagccccagcagccccctgggcgccgaggacctgctgagcgacagcagcgagccccccggcctgaaccaggtgagcagcgaggtgaccagccagctgtacgccagcctgagactgagcagacaggccgaggccaccgccagagcccagctgtacctgcccagcaccagccccccccacgagggcctggacggcttcgcccaggagctgagcagaagcctgagcgtgggcctggagaagaacctgaagaagaaggacggcagcaagcacatcttcgagatggagagcgtgagaggccagctgcagaccatgctgcagaccagcagagacaccgcctacagagaccccctgatccccggcgccggcagcgagagaagagaggaggacagcttcgacagcgacagcaccgccaccctgctgaacaccagacccctgcaggacctgagccccagcagcagcgcccaggccctggaggagctgttccccagatacaccagcctgagacccggcccccccctgaacccccccgacttccagggcctgagagacgccctggacagcgagcacaccagaagaaagcactgcgagagacacatccagagcctgcagaccagagtgctggagctgcagcagcagctggccgtggccgtggccgccgacagaaagaaggacaccatgatcgagcagctggacaagaccctggccagagtggtggagggctggaacagacacgaggccgagagaaccgaggtgctgagaggcctgcaggaggagcaccaggccgccgagctgaccagaagcaagcagcaggagaccgtgaccagactggagcagagcctgagcgaggccatggaggccctgaacagagagcaggagagcgccagactgcagcagagagagagagagaccctggaggaggagagacaggccctgaccctgagactggaggccgagcagcagagatgctgcgtgctgcaggaggagagagacgccgccagagccggccagctgagcgagcacagagagctggagaccctgagagccgccctggaggaggagagacagacctgggcccagcaggagcaccagctgaaggagcactaccaggccctgcaggaggagagccaggcccagctggagagagagaaggagaagagccagagagaggcccaggccgcctgggagacccagcaccagctggccctggtgcagagcgaggtgagaagactggagggcgagctggacaccgccagaagagagagagacgccctgcagctggagatgagcctggtgcaggccagatacgagagccagagaatccagctggagagcgagctggccgtgcagctggagcagagagtgaccgagagactggcccaggcccaggagagcagcctgagacaggccgccagcctgagagagcaccacagaaagcagctgcaggacctgagcggccagcaccagcaggagctggccagccagctggcccagttcaaggtggagatggccgagagagaggagagacagcagcaggtggccgaggactacgagctgagactggccagagagcaggccagagtgtgcgagctgcagagcggcaaccagcagctggaggagcagagagtggagctggtggagagactgcaggccatgctgcaggcccactgggacgaggccaaccagctgctgagcaccaccctgcccccccccaacccccccgccccccccgccggccccagcagccccggcccccaggagcccgagaaggaggagagaagagtgtggaccatgccccccatggccgtggccctgaagcccgtgctgcagcagagcagagaggccagagacgagctgcccggcgccccccccgtgctgtgcagcagcagcagcgacctgagcctgctgctgggccccagcttccagagccagcacagcttccagcccctggagcccaagcccgacctgaccagcagcaccgccggcgccttcagcgccctgggcgccttccaccccgaccacagagccgagagacccttccccgaggaggaccccggccccgacggcgagggcctgctgaagcagggcctgccccccgcccagctggagggcctgaagaacttcctgcaccagctgctggagaccgtgccccagaacaacgagaaccccagcgtggacctgctgccccccaagagcggccccctgaccgtgcccagctgggaggaggccccccaggtgcccagaatccccccccccgtgcacaagaccaaggtgcccctggccatggccagcagcctgttcagagtgcccgagccccccagcagccacagccagggcagcggccccagcagcggcagccccgagagaggcggcgacggcctgaccttccccagacagctgatggaggtgagccagctgctgagactgtaccaggccagaggctggggcgccctgcccgccgaggacctgctgctgtacctgaagagactggagcacagcggctacaagcccggcagaaaggaggagggcttcagcggctggaagctggactacggcgagtggagcggcaccgacggcagaggcgacaacgtgcccagaagaaacaccgacagcagactgggcgagatccccagaaaggagatccccagccaggccgtgcccagaagactggccaccgcccccaagaccgagaagccccccgccagaaagaagagcggccaccccgcccccagcagcatgagaagcagaggcggcgtgtggagatag

SEQ ID NO: 11141 - DNA, 2961 bp, Artificial Sequence
  Description of Artificial Sequence: Synthetic coding sequence
atgtacttctgctggggcgccgacagcagagagctgcagagaagaagaaccgccggcagccccggcgccgagctgctgcaggccgccagcggcgagagacacagcctgctgctgctgaccaaccacagagtgctgagctgcggcgacaacagcagaggccagctgggcagaagaggcgcccagagaggcgagctgcccgagcccatccaggccctggagaccctgatcgtggacctggtgagctgcggcaaggagcacagcctggccgtgtgccacaagggcagagtgttcgcctggggcgccggcagcgagggccagctgggcatcggcgagttcaaggagatcagcttcacccccaagaagatcatgaccctgaacgacatcaagatcatccaggtgagctgcggccactaccacagcctggccctgagcaaggacagccaggtgttcagctggggcaagaacagccacggccagctgggcctgggcaaggagttccccagccaggccagcccccagagagtgagaagcctggagggcatccccctggcccaggtggccgccggcggcgcccacagcttcgccctgagcctgtgcggcaccagcttcggctggggcagcaacagcgccggccagctggccctgagcggcagaaacgtgcccgtgcagagcaacaagcccctgagcgtgggcgccctgaagaacctgggcgtggtgtacatcagctgcggcgacgcccacaccgccgtgctgacccaggacggcaaggtgttcaccttcggcgacaacagaagcggccagctgggctacagccccacccccgagaagagaggcccccagctggtggagagaatcgacggcctggtgagccagatcgactgcggcagctaccacaccctggcctacgtgcacaccaccggccaggtggtgagcttcggccacggccccagcgacaccagcaagcccacccaccccgaggccctgaccgagaacttcgacatcagctgcctgatcagcgccgaggacttcgtggacgtgcaggtgaagcacatcttcgccggcacctacgccaacttcgtgaccacccaccaggacaccagcagcaccagagcccccggcaagaccctgcccgagatcagcagaatcagccagagcatggccgagaagtggatcgccgtgaagagaagaagcaccgagcacgagatggccaagagcgagatcagaatgatcttcagcagccccgcctgcctgaccgccagcttcctgaagaagagaggcaccggcgagaccaccagcatcgacgtggacctggagatggccagagacaccttcaagaagctgaccaagaaggagtggatcagcagcatgatcaccacctgcctggaggacgacctgctgagagccctgccctgccacagcccccaccaggaggccctgagcgtgttcctgctgctgcccgagtgccccgtgatgcacgacagcaagaactggaagaacctggtggtgcccttcgccaaggccgtgtgcgagatgagcaagcagagcctgcaggtgctgaagaagtgctgggccttcctgcaggagagcagcctgaaccccctgatccagatgctgaaggccgccatcatcagccagctgctgcaccagaccaagaccgagcaggaccactgcaacgtgaaggccctgctgggcatgatgaaggagctgcacaaggtgaacaaggccaactgcagactgcccgagaacaccttcaacatcaacgagctgagcaacctgctgaacttctacatcgacagaggcagacagctgttcagagacaaccacctgatgagcgagaagaaggcctacatgctgatgcacgagaccatcctgcagaagaaggacgagttcccccccagccccagattcatcctgagagtgagaagaagcagactggtgaaggacgccctgagacagctgagccaggccgaggccaccgacttctgcaaggtgctggtggtggagttcatcaacgagatctgccccgagagcggcggcgtgagcagcgagttcttccactgcatgttcgaggagatgaccaagcccgagtacggcatgttcatgtaccccgagatgggcagctgcatgtggttccccgccaagcccaagcccgagaagaagagatacttcctgttcggcatgctgtgcggcctgagcctgttcaacctgaacgtggccaacctgcccttccccctggccctgtacaagaagctgctggaccagaagcccagcctggaggacctgaaggagctgagccccagactgggcaagagcctgcaggaggtgctggacgacgccgccgacgacatcggcgacgccctgtgcatcagattcagcatccactgggaccagaacgacgtggacctgatccccaacggcatcagcatccccgtggaccagaccaacaagagagactacgtgagcaagtacatcgactacatcttcaacgtgagcgtgaaggccgtgtacgaggagttccagagaggcttctacagagtgtgcgagaaggagatcctgagacacttctaccccgaggagctgatgaccgccatcatcggcaacaccgactacgactggaagcagttcgagcagaacagcaagtacgagcagggctaccagaagagccaccccaccatccagctgttctggaaggccttccacaagctgaccctggacgagaagaagaagttcctgttcttcctgaccggcagagacagactgcacgccagaggcatccagaagatggagatcgtgttcagatgccccgagaccttcagcgagagagaccaccccaccagcatcacctgccacaacatcctgagcctgcccaagtacagcaccatggagagaatggaggaggccctgcaggtggccatcaacaacaacagaggcttcgtgagccccatgctgacccagagctag

SEQ ID NO: 11142 - DNA, 435 bp, Artificial Sequence
  Description of Artificial Sequence: Synthetic coding sequence
atgaccaccagacaggccaccaaggaccccctgctgagaggcgtgagccccacccccagcaagatccccgtgagaagccagaagagaacccccttccccaccgtgaccagctgcgccgtggaccaggagaaccaggaccccagaagatgggtgcagaagccccccctgaacatccagagacccctggtggacagcgccggccccagacccaaggccagacaccaggccgagaccagccagagactggtgggcatcagccagcccagaaaccccctggaggagctgagacccagccccagaggccagaacgtgggccccggcccccccgcccagaccgtgctggtgcccgcccccggcaagctgttcgccctgagaagaagccccttcccccccgccaagtgccacctggccagatgccacggcctgtacctgtag

SEQ ID NO: 11143 - DNA, 327 bp, Artificial Sequence
  Description of Artificial Sequence: Synthetic coding sequence
atggccgaccccagagtgagacagatcaagatcaagaccggcgtggtgaagagactggtgaaggagaaggtgatgtacgagaaggaggccaagcagcaggaggagaagatcgagaagatgagagccgaggacggcgagaactacgacatcaagaagcaggccgagatcctgcaggagagcagaatgatgatccccgactgccagagaagactggaggccgcctacctggacctgcagagaatcctggagaacgagaaggacctggaggaggccgaggagtacaaggaggccagactggtgctggacagcgtgaagctggaggcctag

SEQ ID NO: 11144 - DNA, 1341 bp, Artificial Sequence
  Description of Artificial Sequence: Synthetic coding sequence
atgagagagtgcctgagcatccacatcggccaggccggcatccagatcggcgacgcctgctgggagctgtactgcctggagcacggcatccagcccaacggcgtggtgctggacacccagcaggaccagctggagaacgccaagatggagcacaccaacgccagcttcgacaccttcttctgcgagaccagagccggcaagcacgtgcccagagccctgttcgtggacctggagcccaccgtgatcgacggcatcagaaccggccagcacagaagcctgttccaccccgagcagctgctgagcggcaaggaggacgccgccaacaactacgccagaggcagatacagcgtgggcagcgaggtgatcgacctggtgctggagagaaccagaaagctggccgagcagtgcggcggcctgcagggcttcctgatcttcagaagcttcggcggcggcaccggcagcggcttcaccagcctgctgatggagagactgaccggcgagtacagcagaaagaccaagctggagttcagcgtgtaccccgcccccagaatcagcaccgccgtggtggagccctacaacagcgtgctgaccacccacagcaccaccgagcacaccgactgcaccttcatggtggacaacgaggccgtgtacgacatctgccacagaaagctgggcgtggagtgccccagccacgccagcatcaacagactggtggtgcaggtggtgagcagcatcaccgccagcctgagattcgagggccccctgaacgtggacctgatcgagttccagaccaacctggtgccctaccccagaatccacttccccatgaccgccttcgcccccatcgtgagcgccgacaaggcctaccacgagcagttcagcgtgagcgacatcaccaccgcctgcttcgagagcagcaaccagctggtgaagtgcgaccccagactgggcaagtacatggcctgctgcctgctgtacagaggcgacgtggtgcccaaggaggtgaacgccgccatcgccgccaccaagagcagacacagcgtgcagttcgtggactggtgccccaccggcttcaaggtgggcatcaacaacagaccccccaccgtgatgcccggcggcgacctggccaaggtgcacagaagcatctgcatgctgagcaacaccaccgccatcgtggaggcctgggccagactggaccacaagttcgacctgatgtacgccaagagagccttcctgcactggtacctgagagagggcatggaggaggccgagttcctggaggccagagaggacctggccgccctggagagagactacgaggaggtggcccagagcttctag

SEQ ID NO: 11145 - DNA, 873 bp, Artificial Sequence
  Description of Artificial Sequence: Synthetic coding sequence
atgggcagcagcaagaaggtgaccctgagcgtgctgagcagagagcagagcgagggcgtgggcgccagagtgagaagaagcatcggcagacccgagctgaagaacctggaccccttcctgctgttcgacgagttcaagggcggcagacccggcggcttccccgaccacccccacagaggcttcgagaccgtgagctacctgctggagggcggcagcatggcccacgaggacttctgcggccacaccggcaagatgaaccccggcgacctgcagtggatgaccgccggcagaggcatcctgcacgccgagatgccctgcagcgaggagcccgcccacggcctgcagctgtgggtgaacctgagaagcagcgagaagatggtggagccccagtaccaggagctgaagagcgaggagatccccaagcccagcaaggacggcgtgaccgtggccgtgatcagcggcgaggccctgggcatcaagagcaaggtgtacaccagaacccccaccctgtacctggacttcaagctggaccccggcgccaagcacagccagcccatccccaagggctggaccagcttcatctacaccatcagcggcgacgtgtacatcggccccgacgacgcccagcagaagatcgagccccaccacaccgccgtgctgggcgagggcgacagcgtgcaggtggagaacaaggaccccaagagaagccacttcgtgctgatcgccggcgagcccctgagagagcccgtgatccagcacggccccttcgtgatgaacaccaacgaggagatcagccaggccatcctggacttcagaaacgccaagaacggcttcgagagagccaagacctggaagagcaagatcggcaactag

SEQ ID NO: 11146 - DNA, 873 bp, Artificial Sequence; identical to SEQ ID NO: 11145
  Description of Artificial Sequence: Synthetic coding sequence

SEQ ID NO: 11147 - DNA, 1200 bp, Artificial Sequence
  Description of Artificial Sequence: Synthetic coding sequence
atggacttcttcagcagccacctgctggccgacagcagcagccccgccaccaacagcagccacaccgacgcccacgagatcctggtgagcgacttcctggtgagcgacgagaacctgcagaagatggagaacgtgctggacctgtggagcagcggcctgaagaccaacatcatcagcgagctgagcaagtggagactgaacttcatcgactggcacagaatggagatgagaaaggagaaggagaagcacgccgcccacctgaagcagctgtgcaaccagatcaacgagctgaaggagctgcagaagaccttcgagatcagcatcggcagaaaggacgaggtgatcagcagcctgagccacgccatcggcaagcagaaggagaagatcgagctgatgagaaccttcttccactggagaatcggccacgtgagagccagacaggacgtgtacgagggcaagctggccgaccagtactaccagagaaccctgctgaagaaggtgtggaaggtgtggagaagcgtggtgcagaagcagtggaaggacgtggtggagagagcctgccaggccagagccgaggaggtgtgcatccagatcagcaacgactacgaggccaaggtggccatgctgagcggcgccctggagaacgccaaggccgagatccagagaatgcagcacgagaaggagcacttcgaggacagcatgaagaaggccttcatgagaggcgtgtgcgccctgaacctggaggccatgaccatcttccagaacagaaacgacgccggcatcgacagcaccaacaacaagaaggaggagtacggccccggcgtgcagggcaaggagcacagcgcccacctggaccccagcgccccccccatgcccctgcccgtgaccagccccctgctgcccagcccccccgccgccgtgggcggcgccagcgccaccgccgtgcccagcgccgccagcatgaccagcaccagagccgccagcgccagcagcgtgcacgtgcccgtgagcgccctgggcgccggcagcgccgccaccgccgccagcgaggagatgcagaccatcccccaggccaccgccgccaagtaccccagaaccatccaccccgagagcagcaccagcgccagcagaagcctgggcaccagaagcgcccacacccagagcctgaccagcgtgcacagcatcaaggtggtggactag

SEQ ID NO: 11148 - DNA, 729 bp, Artificial Sequence
  Description of Artificial Sequence: Synthetic coding sequence
atggccgccgtgaaggccagcaccagcaaggccaccagaccctggtacagccaccccgtgtacgccagatactggcagcactaccaccaggccatggcctggatgcagagccaccacaacgcctacagaaaggccgtggagagctgcttcaacctgccctggtacctgcccagcgccctgctgccccagagcagctacgacaacgaggccgcctacccccagagcttctacgaccaccacgtggcctggcaggactacccctgcagcagcagccacttcagaagaagcggccagcaccccagatacagcagcagaatccaggccagcaccaaggaggaccaggccctgagcaaggaggaggagatggagaccgagagcgacgccgaggtggagtgcgacctgagcaacatggagatcaccgaggagctgagacagtacttcgccgagaccgagagacacagagaggagagaagaagacagcagcagctggacgccgagagactggacagctacgtgaacgccgaccacgacctgtactgcaacaccagaagaagcgtggaggcccccaccgagagacccggcgagagaagacaggccgagatgaagagactgtacggcgacagcgccgccaagatccaggccatggaggccgccgtgcagctgagcttcgacaagcactgcgacagaaagcagcccaagtactggcccgtgatccccctgaagttctag

SEQ ID NO: 11149 - DNA, 1482 bp, Artificial Sequence
  Description of Artificial Sequence: Synthetic coding sequence
atggagagaagccccgacgtgagccccggccccagcagaagcttcaaggaggagctgctgtgcgccgtgtgctacgaccccttcagagacgccgtgaccctgagatgcggccacaacttctgcagaggctgcgtgagcagatgctgggaggtgcaggtgagccccacctgccccgtgtgcaaggacagagccagccccgccgacctgagaaccaaccacaccctgaacaacctggtggagaagctgctgagagaggaggccgagggcgccagatggaccagctacagattcagcagagtgtgcagactgcacagaggccagctgagcctgttctgcctggaggacaaggagctgctgtgctgcagctgccaggccgaccccagacaccagggccacagagtgcagcccgtgaaggacaccgcccacgacttcagagtgagaagcctgatcgccgaggagagaagaaacttcctgcccacccaccagtggatcgtgaccaagaccagactgcagaccagcagccccaacctgcagagcagaagacagggccaggtgcaggagcacggcgcctgcaccgccggcgagggccagggcctgctgggccacgccgccctgctggacgccatggccgaggagaccagacagaagcagctgctggccgacgagaagatgaagcagctgaccgaggagaccgaggtgctggcccacgagatcgagagactgcagatggagatgaaggaggacgacgtgagcttcctgatgaagcacaagagcagaaagagaagactgttctgcaccatggagcccgagcccgtgcagcccggcatgctgatcgacgtgtgcaagtacctgggcagcctgcagtacagagtgtggaagaagatgctggccagcgtggagagcgtgcccttcagcttcgaccccaacaccgccgccggctggctgagcgtgagcgacgacctgaccagcgtgaccaaccacggctacagagtgcaggtggagaaccccgagagattcagcagcgccccctgcctgctgggcagcagagtgttcagccagggcagccacgcctgggaggtggccctgggcggcctgcagagctggagagtgggcgtggtgagagtgagacaggacagcggcgccgagggccacagccacagctgctaccacgacaccagaagcggcttctggtacgtgtgcagaacccagggcgtggagggcgaccactgcgtgaccagcgaccccgccaccagccccctggtgctggccatccccagaagactgagagtggagctggagtgcgaggagggcgagctgagcttctacgacgccgagagacactgccacctgtacaccttccacgccagattcggcgaggtgagaccctacttctacctgggcggcgccagaggcgccggcccccccgagcccctgagaatctgccccctgcacatcagcgtgaaggaggagctggacggctag

SEQ ID NO: 11150 - DNA, 1473 bp, Artificial Sequence
  Description of Artificial Sequence: Synthetic coding sequence
atgaacctggccgagatctgcgacaacgccaagaagggcagagagtacgccctgctgggcaactacgacagcagcatggtgtactaccagggcgtgatgcagcagatccagagacactgccagagcgtgagagaccccgccatcaagggcaagtggcagcaggtgagacaggagctgctggaggagtacgagcaggtgaagagcatcgtgagcaccctggagagcttcaagatcgacaagccccccgacttccccgtgagctgccaggacgagcccttcagagaccccgccgtgtggcccccccccgtgcccgccgagcacagagcccccccccagatcagaagacccaacagagaggtgagacccctgagaaaggagatggccggcgtgggcgccagaggccccgtgggcagagcccaccccatcagcaagagcgagaagcccagcaccagcagagacaaggactacagagccagaggcagagacgacaagggcagaaagaacatgcaggacggcgccagcgacggcgagatgcccaagttcgacggcgccggctacgacaaggacctggtggaggccctggagagagacatcgtgagcagaaaccccagcatccactgggacgacatcgccgacctggaggaggccaagaagctgctgagagaggccgtggtgctgcccatgtggatgcccgacttcttcaagggcatcagaagaccctggaagggcgtgctgatggtgggcccccccggcaccggcaagaccatgctggccaaggccgtggccaccgagtgcggcaccaccttcttcaacgtgagcagcagcaccctgaccagcaagtacagaggcgagagcgagaagctggtgagactgctgttcgagatggccagattctacgcccccaccaccatcttcatcgacgagatcgacagcatctgcagcagaagaggcaccagcgacgagcacgaggccagcagaagagtgaagagcgagctgctgatccagatggacggcgtgggcggcgccctggagaacgacgaccccagcaagatggtgatggtgctggccgccaccaacttcccctgggacatcgacgaggccctgagaagaagactggagaagagaatctacatccccctgcccaccgccaagggcagagccgagctgctgaagatcaacctgagagaggtggagctggaccccgacatccagctggaggacatcgccgagaagatcgagggctacagcggcgccgacatcaccaacgtgtgcagagacgccagcctgatggccatgagaagaagaatcaacggcctgagccccgaggagatcagagccctgagcaaggaggagctgcagatgcccgtgaccaagggcgacttcgagctggccctgaagaagatcgccaagagcgtgagcgccgccgacctggagaagtacgagaagtggatggtggagttcggcagcgcctag

SEQ ID NO: 11151 - DNA, 1473 bp, Artificial Sequence; identical to SEQ ID NO: 11150
  Description of Artificial Sequence: Synthetic coding sequence

SEQ ID NO: 11152 - DNA, 1068 bp, Artificial Sequence
  Description of Artificial Sequence: Synthetic coding sequence
atggacttcatcttccacgagaagcaggagggcttcctgtgcgcccagcactgcctgaacaacctgctgcagggcgagtacttcagccccgtggagctggccagcatcgcccaccagctggacgaggaggagagaatgagaatggccgagggcggcgtgaccagcgaggagtacctggccttcctgcagcagcccagcgagaacatggacgacaccggcttcttcagcatccaggtgatcagcaacgccctgaagttctggggcctggagatcatccacttcaacaaccccgagtaccagaagctgggcatcgaccccatcaacgagagaagcttcatctgcaactacaagcagcactggttcaccatcagaaagttcggcaagcactggttcaacctgaacagcctgctggccggccccgagctgatcagcgacacctgcctggccaacttcctggccagactgcagcagcaggcctacagcgtgttcgtggtgaagggcgacctgcccgactgcgaggccgaccagctgctgcagatcatcagcgtggaggagatggacacccccaagctgaacggcaagaagctggtgaagcagaaggagcacagagtgtacaagaccgtgctggagaaggtgagcgaggagagcgacgagagcggcaccagcgaccaggacgaggaggacttccagagagccctggagctgagcagacaggagaccaacagagaggacgagcacctgagaagcaccatcgagctgagcatgcagggcagcagcggcaacaccagccaggacctgcccaagaccagctgcgtgacccccgccagcgagcagcccaagaagatcaaggaggactacttcgagaagcaccagcaggagcagaagcagcagcagcagcagagcgacctgcccggccacagcagctacctgcacgagagacccaccaccagcagcagagccatcgagagcgacctgagcgacgacatcagcgagggcaccgtgcaggccgccgtggacaccatcctggagatcatgagaaagaacctgaagatcaagggcgagaagtag

SEQ ID NO: 11153 - DNA, 5910 bp, Artificial Sequence
  Description of Artificial Sequence: Synthetic coding sequence
atggccgccagaagcgcccccagctgccacctgagactggagtgggtgtacggctacagaggccaccagtgcagaaacaacctgtactacaccgccgccaaggagatcgtgtacttcgtggccggcgtgggcgtggtgtacagccccagagagcacagacagaagttctacagaggccacagcgacgacatcatcagcctggccctgcaccccgagagagtgctggtggccaccggccaggtgggcaaggagccctacatctgcatctgggacagctacaccgtgcagaccatcagcgtgctgaaggacgtgcacacccacggcatcgcctgcctggccttcgacctggacggccagagactggtgagcgtgggcctggacagcaagaacgccgtgtgcgtgtgggactggaagagaggcaagatgctgagcatggcccccggccacaccgacagaatcttcgacatcagctgggacctgtaccagcccaacaagctggtgagctgcggcgtgaagcacatcaagttctggagcctgtgcggcaacgccctgacccccaagagaggcgtgttcggcaagaccggcgacctgcagaccatcctgtgcctggcctgcgccagagacgagctgacctacagcggcgccctgaacggcgacatctacgtgtggaagggcatcaacctgatcagaaccatccagggcgcccacgccgccggcatcttcagcatgaacgcctgcgaggagggcttcgccaccggcggcagagacggctgcatcagactgtgggacctgaccttcaagcccatcaccgtgatcgacctgagagagaccgaccagggctacaagggcctgagcgtgagaagcgtgtgctggagaggcgaccacatcctggtgggcacccaggacagcgagatcttcgagatcgtggtgcaggagagaaacaagcccttcctgatcatgcagggccactgcgagggcgagctgtgggccctggccgtgcaccccaccaagcccctggccgtgaccggcagcgacgacagaagcgtgagaatctggagcctggtggaccacgccctgatcgccagatgcaacatggaggagcccatcagatgcgccgccgtgaacgccgacggcatccacctggccctgggcatgaaggacggcagcttcaccgtgctgagagtgagagacatgaccgaggtggtgcacatcaaggacagaaaggaggccatccacgagctgaagtacagccccgacggcacctacctggccgtgggctgcaacgacagcagcgtggacatctacggcgtggcccagagatacaagaaggtgggcgagtgcctgggcagcctgagcttcatcacccacctggactggagcagcgacagcagatacctgcagaccaacgacggcaacggcaagagactgttctacagaatgcccggcggcaaggaggtgaccagcaccgaggagatcaagggcgtgcactgggccagctggacctgcgtgagcggcctggaggtgaacggcatctggcccaagtacagcgacatcaacgacatcaacagcgtggacggcaactacatcggccaggtgctggtgaccgccgacgactacggcatcatcaagctgttcagatacccctgcctgagaaagggcgccaagttcagaaagtacatcggccacagcgcccacgtgaccaacgtgagatggagccacgactaccagtgggtgatcagcatcggcggcgccgaccacagcgtgttccagtggaagttcatccccgagagaaagctgaaggacgccgtgcacatcgccccccaggagagcctggccgacagccacagcgacgagagcgacagcgacctgagcgacgtgcccgagctggacagcgagatcgagcaggagacccagctgacctacagaagacaggtgtacaaggaggacctgccccagctgaaggagcagtgcaaggagaagcagaagagcgccaccagcaagagaagagagagagcccccggcaacagcatcagactgcacttcgtgcacggctacagaggctacgactgcagaagcaacctgttctacacccagatcggcgagatcgtgtaccacgtggccgccgtgggcgtgatctacaacagacagcagaacacccagagattctacctgggccacgacgacgacatcctgtgcctgaccatccaccccctgaaggactacgtggccaccggccaggtgggcagagaccccagcatccacatctgggacaccgagaccatcaagcccctgagcatcctgaagggccaccaccagtacggcgtgagcgccgtggacttcagcgccgacggcaagagactggccagcgtgggcatcgacgacagccacaccgtggtgctgtgggactggaagaagggcgagaagctgagcatcgccagaggcagcaaggacaagatcttcgtggtgaagatgaacccctacgtgcccgacaagctgatcaccgccggcatcaagcacatgaagttctggagaaaggccggcggcggcctgatcggcagaaagggctacatcggcaccctgggcaagaacgacaccatgatgtgcgccgtgtacggctggaccgaggagatggccttcagcggcaccagcaccggcgacgtgtgcatctggagagacatcttcctggtgaagaccgtgaaggcccacgacggccccgtgttcagcatgcacgccctggagaagggcttcgtgaccggcggcaaggacggcatcgtggccctgtgggacgacagcttcgagagatgcctgaagacctacgccatcaagagagccgccctggcccccggcagcaagggcctgctgctggaggacaaccccagcatcagagccatcagcctgggccacggccacatcctggtgggcaccaagaacggcgagatcctggaggtggacaagagcggccccatcaccctgctggtgcagggccacatggagggcgaggtgtggggcctggccacccacccctacctgcccatctgcgccaccgtgagcgacgacaagaccctgagaatctgggacctgagccccagccactgcatgctggccgtgagaaagctgaagaagggcggcagatgctgctgcttcagccccgacggcaaggccctggccgtgggcctgaacgacggcagcttcctgatggccaacgccgacaccctggaggacctggtgagcttccaccacagaaaggacatgatcagcgacatcagattcagccccggcagcggcaagtacctggccgtggccagccacgacagcttcatcgacatctacaacgtgatgagcagcaagagagtgggcatctgcaagggcgccaccagctacatcacccacatcgactgggacatcagaggcaagctgctgcaggtgaacaccggcgccaaggagcagctgttcttcgaggcccccagaggcaagaagcagaccatccccagcgtggaggtggagaagatcgcctgggccagctggaccagcgtgctgggcctgtgctgcgagggcatctggcccgtgatcggcgaggtgaccgacgtgaccgccagctgcctgaccagcgacaagatggtgctggccaccggcgacgacctgggcttcgtgaagctgttcagataccccaccaagggcaagttcggcaagttcaagagatacgtggcccacagcacccacgtgaccaacgtgagatggacctacgacgacagcatgctggtgaccctgggcggcaccgacatgagcctgatggtgtggaccaacgagatggagggctacagagagaagagaccctgcgacagcgaggagagcgacatcgacagcgaggaggacggcggctacgacagcgacgtgaccagagagaacgagatcagctacaccatcagagccctgagcaccaacatcagacccatgctgggcatcaagccccacctgcagcagaaggagcccagcatcgacgagagaccccccgtgagcagagcccccccccagcccgagaagctgcagaccaacaacgtgggcaagaagaagagacccatcgaggacctggtgctggagctgatcttcggctacagaggcagagactgcagaaacaacgtgcactacctgaacgacggcgacgacatcatctaccacaccgccagcgtgggcatcctgcacaacgtggccaccggcagccagagcttctaccaggagcacaacgacgacatcctgtgcctgaccgtgaaccagcaccccaagttcatcaacatcgtggccaccggccaggtgggcgacagcgccgacatgagcgccaccgcccccagcatccacatctgggacgccatgaacaagcagaccctgagcatcctgagatgctaccacagcaagggcgtgtgcagcgtgagcttcagcgccaccggcaagctgctgctgagcgtgggcctggaccccgagcacaccatcaccatctggagatggcaggagggcgccaagatcgccagcagagccggccacaaccagagaatcttcgtggccgagttcagacccgacagcgacacccagttcgtgagcgtgggcgtgaagcacgtgaagttctggaccctggccggcagagccctgctgagcaagaagggcctgctgagcaccctggaggacgccagaatgcagaccatgctggccatcgccttcggcgccaacaacctgaccttcaccggcaccatcagcggcgacgtgtgcgtgtggaaggaccacatcctgtgcagaatcgtggccagagcccacaacggccccgtgttcgccatgtacaccaccctgagagacggcctgatcgtgaccggcggcaaggagagacccagcaaggagggcggcgccgtgaagctgtgggaccaggagctgagaagatgcagagccttcagactggagaccggccaggccaccgactgcgtgagaagcgtgtgcagaggcaagggcaagatcctggtgggcaccagaaacgccgagatcatcgaggtgggcgagaagaacgccgcctgcaacatcctggtgaacggccacgtggacggccccatctggggcctggccacccaccccagcagagacttcttcctgagcgccgccgaggacggcaccgtgagactgtgggacatcgccgacaagaagatgctgaacaaggtgaacctgggccacgccgccagaaccgtgtgctacagccccgagggcgacatggtggccatcggcatgaagaacggcgagttcatcatcctgctggtgagcagcctgaagatctggggcaagaagagagacagaagatgcgccatccacgacatcagattcagccccgacagcagatacctggccgtgggcagcagcgagaacagcgtggacttctacgacctgaccctgggccccaccctgaacagaatcagctactgcaaggacatccccagcttcgtgatccagatggacttcagcgccgacagcagctacctgcaggtgagcagcggctgctacaagagacacgtgtacgaggtgcccagcggcaagcacctgatggaccacgccgccatcgacagaatcacctgggccacctggaccagcatcctgggcgacgaggtgctgggcatctggagcagacacgccgagaaggccgacgtgaactgcgcctgcgtgagccacagcggcatcagcctggtgaccggcgacgacttcggcatggtgaagctgttcgacttcccctgccccgagaagttcgccaagcacaagagattcctgggccacagcccccacgtgaccaacatcagattcaccagcggcgacagacacgtggtgagcgccggcggcgacgactgcagcctgttcgtgtggaagtgcgtgcacaccccccactag

SEQ ID NO: 11154 - DNA, 1146 bp, Artificial Sequence
  Description of Artificial Sequence: Synthetic coding sequence
atgcccctgcaggtgagcgactacagctggcagcagaccaagaccgccgtgttcctgagcctgcccctgaagggcgtgtgcgtgagagacaccgacgtgttctgcaccgagaactacctgaaggtgaacttcccccccttcctgttcgaggccttcctgtacgcccccatcgacgacgagagcagcaaggccaagatcggcaacgacaccatcgtgttcaccctgtacaagaaggaggccgccatgtgggagaccctgagcgtgaccggcgtggacaaggagatgatgcagagaatcagagagaagagcatcctgcaggcccaggagagagccaaggaggccaccgaggccaaggccgccgccaagagagaggaccagaagtacgccctgagcgtgatgatgaagatcgaggaggaggagagaaagaagatcgaggacatgaaggagaacgagagaatcaaggccaccaaggccctggaggcctggaaggagtaccagagaaaggccgaggagcagaagaagatccagagagaggagaagctgtgccagaaggagaagcagatcaaggaggagagaaagaagatcaagtacaagagcctgaccagaaacctggccagcagaaacctggcccccaagggcagaaacagcgagaacatcttcaccgagaagctgaaggaggacagcatccccgcccccagaagcgtgggcagcatcaagatcaacttcacccccagagtgttccccaccgccctgagagagagccaggtggccgaggaggaggagtggctgcacaagcaggccgaggccagaagagccatgaacaccgacatcgccgagctgtgcgacctgaaggaggaggagaagaaccccgagtggctgaaggacaagggcaacaagctgttcgccaccgagaactacctggccgccatcaacgcctacaacctggccatcagactgaacaacaagatgcccctgctgtacctgaacagagccgcctgccacctgaagctgaagaacctgcacaaggccatcgaggacagcagcaaggagttctgcagcctggagggcatcgagtgccaggccagcgagcccaagctgagccaccacatccccagcgacctgcacgtgtacatccagatggcctag

SEQ ID NO: 11155 - DNA, 1344 bp, Artificial Sequence
  Description of Artificial Sequence: Synthetic coding sequence
atggccggcgccggcggcggcaacgacatccagtggtgcttcagccaggtgaagggcgccgtggacgacgacgtggccgaggccgacatcatcagcaccgtggagttcaaccacagcggcgagctgctggccaccggcgacaagggcggcagagtggtgatcttccagcaggagcaggagaacaagatccagagccacagcagaggcgagtacaacgtgtacagcaccttccagagccacgagcccgagttcgactacctgaagagcctggagatcgaggagaagatcaacaagatcagatggctgccccagaagaacgccgcccagttcctgctgagcaccaacgacaagaccatcaagctgtggaagatcagcgagagagacaagagacccgagggctacaacctgaaggaggaggacggcagatacagagaccccaccaccgtgaccaccctgagagtgcccgtgttcagacccatggacctgatggtggaggccagccccagaagaatcttcgccaacgcccacacctaccacatcaacagcatcagcatcaacagcgactacgagacctacctgagcgccgacgacctgagaatcaacctgtggcacctggagatcaccgacagaagcttcaacatcgtggacatcaagcccgccaacatggaggagctgaccgaggtgatcaccgccgccgagttccaccccaacagctgcaacaccttcgtgtacagcagcagcaagggcaccatcagactgtgcgacatgagagccagcgccctgtgcgacagacacagcaagctgttcgaggagcccgaggaccccagcaacagaagcttcttcagcgagatcatcagcagcatcagcgacgtgaagttcagccacagcggcagatacatgatgaccagagactacctgagcgtgaagatctgggacctgaacatggagaacagacccgtggagacctaccaggtgcacgagtacctgagaagcaagctgtgcagcctgtacgagaacgactgcatcttcgacaagttcgagtgctgctggaacggcagcgacagcgtggtgatgaccggcagctacaacaacttcttcagaatgttcgacagaaacaccaagagagacatcaccctggaggccagcagagagaacaacaagcccagaaccgtgctgaagcccagaaaggtgtgcgccagcggcaagagaaagaaggacgagatcagcgtggacagcctggacttcaacaagaagatcctgcacaccgcctggcaccccaaggagaacatcatcgccgtggccaccaccaacaacctgtacatcttccaggacaaggtgaactag

SEQ ID NO: 11156 - DNA, 1413 bp, Artificial Sequence
  Description of Artificial Sequence: Synthetic coding sequence
atggacctgagagaccaggagctggtgaagatcgtgggcatcagatacgaggtgggcccccccaccctgtgctgcctgaagctggccttcatcgaccccgccaccggcaagctgatggacaagagcttcagcatcagataccacgacatgcccgacgtgatcgacttcctggtgctgagacagttctacgacgaggccagacagagaaactggcagagctgcgacagattcagaagcatcatcgacgacgcctggtggttcggcaccgtgctgagccaggagccctaccagccccagtaccccgacagccacttccagtgctacatcgtgagatgggacaacaccgagatcgagaagctgagcccctgggacatggagcccatccccgacaacgtggacccccccgaggagctgggcgccagcatcagcgtgaccaccgacgagctggagaagctgctgtacaagccccaggccggcgagtggggccagaagagcagagacgaggagtgcgacagaatcatcagcggcatcgaccagctgctgaacctggacatcgccgccgccttcgccggccccgtggacctgtgcacctaccccaagtactgcaccgtggtggcctaccccaccgacctgtacaccatcagaatgagactggtgaacagattctacagaagactgagcgccctggtgtgggaggtgagatacatcgagcacaacgccagaaccttcaacgagcccgagagcgtgatcgccagaagcgccaagaagatcaccgaccagctgctgaagttcatcaagaaccagcactgcaccaacatcagcgagctgagcaacaccagcgagaacgacgagcagaacgccgaggacctggacgacagcgacctgcccaagaccagcagcggcagaagaagagactacagagacatcatcgacacccccatggacttcggcaccgtgagagagaccctggacgccggcaactacgacagccccctggagttctgcaaggacatcagactgatcttcagcaacgccaaggcctacacccccaacaagagaagcaagatctacagcatgaccctgagactgagcgccctgttcgaggagaagatgaagaagatcagcagcgacttcaagatcggccagaagttcaacgagaagctgagaagaagccagagattcaagcagagacagaactgcaagggcgacagccagcccaacaagagcatcagaaacctgaagcccaagagactgaagagccagaccaagatcatccccgagctggtgggcagccccacccagagcaccagcagcagaaccgcctacctgggcacccacaagaccagcgccggcatcagcagcggcgtgaccagcggcctgttcagattcagcagaatcatcagaaaggagtag

SEQ ID NO: 11157 - DNA, 516 bp, Artificial Sequence
  Description of Artificial Sequence: Synthetic coding sequence
atgtgcggcagagcccccccccccgagatcaccggcagagagcccggctaccacctggtggagcagagctgctggctgaagcccctgcccagaaacctgggccacagcctgttctggaccgtgtggaagcccagacccgtgagccagctggtggcccagcaggtgacccagcagttcgtgccccccacccagagcaagaaggagaagaaggacaaggtggagaaggagaagagcgagaaggagaccaccagcaagaagaacagccacaagaagaccagacccagactgaagaacgtggacagaagcagcgcccagcacctggaggtgaccgtgggcgacctgaccgtgatcatcaccgacttcaaggagaagaccaagagcccccccgccagcagcgccgccagcgccgaccagcacagccagagcggcagcagcagcgacaacaccgagagaggcatgagcagaagcagcagccccagaggcgaggccagcagcctgaacggcgagagccactag

SEQ ID NO: 11158 - DNA, 417 bp, Artificial Sequence
  Description of Artificial Sequence: Synthetic coding sequence
atgggcgacaagaagagccccaccagaaagcccagacccgtgagccagctggtggcccagcaggtgacccagcagttcgtgccccccacccagagcaagaaggagaagaaggacaaggtggagaaggagaagagcgagaaggagaccaccagcaagaagaacagccacaagaagaccagacccagactgaagaacgtggacagaagcagcgcccagcacctggaggtgaccgtgggcgacctgaccgtgatcatcaccgacttcaaggagaagaccaagagcccccccgccagcagcgccgccagcgccgaccagcacagccagagcggcagcagcagcgacaacaccgagagaggcatgagcagaagcagcagccccagaggcgaggccagcagcctgaacggcgagagccactag

SEQ ID NO: 11159 - DNA, 1047 bp, Artificial Sequence
  Description of Artificial Sequence: Synthetic coding sequence
atgggccactgctgctgcaagccctacaactgcctgcagtgcctggacaagaccaacgagagcgccctggtgaaggagaaggagctgagcatcgagctggccaacatcagagacgaggtggccttccacaccgccaagtgcgagaagctgcagaaggagaaggaggagctggagagaagattcgaggacgaggtgaagagactgggctggcagcagcaggccgagctgcaggagctggaggagagactgcagctgcagttcgaggccgagatggccagactgcaggaggagcacggcgaccagctgctgagcatcagatgccagcaccaggagcaggtggaggacctgaccgccagccacgacgccgccctgctggagatggagaacaaccacaccgtggccatcaccatcctgcaggacgaccacgaccacaaggtgcaggagctgatgagcacccacgagctggagaagaaggagctggaggagaacttcgagaagctgagactgagcctgcaggaccaggtggacaccctgaccttccagagccagagcctgagagacagagccagaagattcgaggaggccctgagaaagaacaccgaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaacgaggacctgaaggccagaatcgaccagaacaccgtggtgaccagacagctgagcgaggagaacgccaacctgcaggagtacgtggagaaggagacccaggagaagaagagactgagcagaaccaacgaggagctgctgtggaagctgcagaccggcgaccccaccagccccatcaagctgagccccaccagccccgtgtacagaggcagcagcagcggccccagcagccccgccagagtgagcaccacccccagatag

SEQ ID NO: 11160 - DNA, 2664 bp, Artificial Sequence
  Description of Artificial Sequence: Synthetic coding sequence
atgaacagcggcggcggcctgcccccccccagcgccgccgccagccccagcagcagcagcctggccgccgccgtggccgtggtggccccccccggcgtgggcggcgtgcccggcggcgccgccgtgggcgtgaagctgaagtactgcagatactacgccaaggacaagacctgcttctacggcgaggagtgccagttcctgcacgaggaccccgccgccggcgccgcccccggcctgggcctgcacagcaacagcgtgcccctggccctggccggcgcccccgtggccggcttcccccccggcgccgtggccggcggcggcgccggccccccccccggccccaagaagcccgacctgggcgaccccggcaccggcgccgccgccggcggcggcggcagcagcggcggcctggacggccccagactggccatccccggcatggacggcggcgccctgaccgacaccagcctgaccgacagctacttcagcaccagcttcatcggcgtgaacggcttcggcagccccgtggagaccaagtaccccctgatgcagagaatgaccaacagcagcagcagccccagcctgctgaacgacagcgccaagccctacagcgcccacgaccccctgaccagccccgccagcagcctgttcaacgacttcggcgccctgaacatcagccagagaagaaagcccagaaagtacagactgggcatgctggaggagagactggtgcccatgggcagcaaggccagaaaggccaagaaccccatcggctgcctggccgacagatgcaagagcggcgtgcccatcaacatggtgtggtggaacagagtgaccgagaacaacctgcagacccccaaccccaccgccagcgagttcatccccaagggcggcagcaccagcagactgagcaacgtgagccagagcaacatgagcgccttcagccaggtgttcagccaccccagcatgggcagccccgccaccgccggcctggcccccggcatgagcctgagcgccggcagcagccccctgcacagccccaagatcaccccccacaccagccccgcccccagaagaagaagccacacccccaaccccgccagctacatggtgcccagcagcgccagcaccagcgtgaacaaccccgtgagccagacccccagcagcggccaggtgatccagaaggagaccgtgggcggcaccacctacttctacaccgacaccacccccgcccccctgaccggcatggtgttccccaactaccacatctacccccccaccgccccccacgtggcctacatgcagcccaaggccaacgcccccagcttcttcatggccgacgagctgagacaggagctgatcaacagacacctgatcaccatggcccagatcgaccaggccgacatgcccgccgtgcccaccgaggtggacagctaccacagcctgttccccctggagcccctgcccccccccaacagaatccagaagagcagcaacttcggctacatcaccagctgctacaaggccgtgaacagcaaggacgacctgccctactgcctgagaagaatccacggcttcagactggtgaacaccaagtgcatggtgctggtggacatgtggaagaagatccagcacagcaacatcgtgaccctgagagaggtgttcaccaccaaggccttcgccgagcccagcctggtgttcgcctacgacttccacgccggcggcgagaccatgatgagcagacacttcaacgaccccaacgccgacgcctacttcaccaagagaaagtggggccagcacgagggccccctgcccagacagcacgccggcctgctgcccgagagcctgatctgggcctacatcgtgcagctgagcagcgccctgagaaccatccacaccgccggcctggcctgcagagtgatggaccccaccaagatcctgatcaccggcaagaccagactgagagtgaactgcgtgggcgtgttcgacgtgctgaccttcgacaacagccagaacaacaaccccctggccctgatggcccagtaccagcaggccgacctgatcagcctgggcaaggtggtgctggccctggcctgcaacagcctggccggcatccagagagagaacctgcagaaggccatggagctggtgaccatcaactacagcagcgacctgaagaacctgatcctgtacctgctgaccgaccagaacagaatgagaagcgtgaacgacatcatgcccatgatcggcgccagattctacacccagctggacgccgcccagatgagaaacgacgtgatcgaggaggacctggccaaggaggtgcagaacggcagactgttcagactgctggccaagctgggcaccatcaacgagagacccgagttccagaaggaccccacctggagcgagaccggcgacagatacctgctgaagctgttcagagaccacctgttccaccaggtgaccgaggccggcgccccctggatcgacctgagccacatcatcagctgcctgaacaagctggacgccggcgtgcccgagaagatcagcctgatcagcagagacgagaagagcgtgctggtggtgacctacagcgacctgaagagatgcttcgagaacaccttccaggagctgatcgccgccgccaacggccagctgtag

SEQ ID NO: 11161 - DNA, 1710 bp, Artificial Sequence
  Description of Artificial Sequence: Synthetic coding sequence
atggccaccctggtggtgaacaagctgggcgccggcgtggacagcggcagacagggcagcagaggcaccgccgtggtgaaggtgctggagtgcggcgtgtgcgaggacgtgttcagcctgcagggcgacaaggtgcccagactgctgctgtgcggccacaccgtgtgccacgactgcctgaccagactgcccctgcacggcagagccatcagatgccccttcgacagacaggtgaccgacctgggcgacagcggcgtgtggggcctgaagaagaacttcgccctgctggagctgctggagagactgcagaacggccccatcggccagtacggcgccgccgaggagagcatcggcatcagcggcgagagcatcatcagatgcgacgaggacgaggcccacctggccagcgtgtactgcaccgtgtgcgccacccacctgtgcagcgagtgcagccaggtgacccacagcaccaagaccctggccaagcacagaagagtgcccctggccgacaagccccacgagaagaccatgtgcagccagcaccaggtgcacgccatcgagttcgtgtgcctggaggagggctgccagaccagccccctgatgtgctgcgtgtgcaaggagtacggcaagcaccagggccacaagcacagcgtgctggagcccgaggccaaccagatcagagccagcatcctggacatggcccactgcatcagaaccttcaccgaggagatcagcgactacagcagaaagctggtgggcatcgtgcagcacatcgagggcggcgagcagatcgtggaggacggcatcggcatggcccacaccgagcacgtgcccggcaccgccgagaacgccagaagctgcatcagagcctacttctacgacctgcacgagaccctgtgcagacaggaggagatggccctgagcgtggtggacgcccacgtgagagagaagctgatctggctgagacagcagcaggaggacatgaccatcctgctgagcgaggtgagcgccgcctgcctgcactgcgagaagaccctgcagcaggacgactgcagagtggtgctggccaagcaggagatcaccagactgctggagaccctgcagaagcagcagcagcagttcaccgaggtggccgaccacatccagctggacgccagcatccccgtgaccttcaccaaggacaacagagtgcacatcggccccaagatggagatcagagtggtgaccctgggcctggacggcgccggcaagaccaccatcctgttcaagctgaagcaggacgagttcatgcagcccatccccaccatcggcttcaacgtggagaccgtggagtacaagaacctgaagttcaccatctgggacgtgggcggcaagcacaagctgagacccctgtggaagcactactacctgaacacccaggccgtggtgttcgtggtggacagcagccacagagacagaatcagcgaggcccacagcgagctggccaagctgctgaccgagaaggagctgagagacgccctgctgctgatcttcgccaacaagcaggacgtggccggcgccctgagcgtggaggagatcaccgagctgctgagcctgcacaagctgtgctgcggcagaagctggtacatccagggctgcgacgccagaagcgtgttccagatcatctgcgaccagtacaccggcaaggaggtggtgaccgagaagggctag

SEQ ID NO: 11162 - DNA, 2061 bp, Artificial Sequence
  Description of Artificial Sequence: Synthetic coding sequence
atgggcagaatccaccaggccatggtgaccagcctgaacgaggacaacgagagcgtgaccgtggagtggatcgagaacggcgacaccaagggcaaggagatcgacctggagagcatcttcagcctgaaccccgacctggtgcccgacgaggagatcgagcccagccccgagaccccccccccccccgccagcagcgccaaggtgaacaagatcgtgaagaacagaagaaccgtggccagcatcaagaacgacccccccagcagagacaacagagtggtgggcagcgccagagccagacccagccagttccccgagcagagcagcagcgcccagcagaacggcagcgtgagcgacatcagccccgtgcaggccgccaagaaggagttcggcccccccagcagaagaaagagcaactgcgtgaaggaggtggagaagctgcaggagaagagagagaagagaagactgcagcagcaggagctgagagagaagagagcccaggacgtggacgccaccaaccccaactacgagatcatgtgcatgatcagagacttcagaggcagcctggactacagacccctgaccaccgccgaccccatcgacgagcacagaatctgcgtgtgcgtgagaaagagacccctgaacaagaaggagacccagatgaaggacctggacgtgatcaccatccccagcaaggacgtggtgatggtgcacgagcccaagcagaaggtggacctgaccagatacctggagaaccagaccttcagattcgactacgccttcgacgacagcgcccccaacgagatggtgtacagattcaccgccagacccctggtggagaccatcttcgagagaggcatggccacctgcttcgcctacggccagaccggcagcggcaagacccacaccatgggcggcgacttcagcggcaagaaccaggactgcagcaagggcatctacgccctggccgccagagacgtgttcctgatgctgaagaagcccaactacaagaagctggagctgcaggtgtacgccaccttcttcgagatctacagcggcaaggtgttcgacctgctgaacagaaagaccaagctgagagtgctggaggacggcaagcagcaggtgcaggtggtgggcctgcaggagagagaggtgaagtgcgtggaggacgtgctgaagctgatcgacatcggcaacagctgcagaaccagcggccagaccagcgccaacgcccacagcagcagaagccacgccgtgttccagatcatcctgagaagaaagggcaagctgcacggcaagttcagcctgatcgacctggccggcaacgagagaggcgccgacaccagcagcgccgacagacagaccagactggagggcgccgagatcaacaagagcctgctggccctgaaggagtgcatcagagccctgggcagaaacaagccccacacccccttcagagccagcaagctgacccaggtgctgagagacagcttcatcggcgagaacagcagaacctgcatgatcgccaccatcagccccggcatggccagctgcgagaacaccctgaacaccctgagatacgccaacagagtgaaggagctgaccgtggaccccaccgccgccggcgacgtgagacccatcatgcaccacccccccaaccagatcgacgacctggagacccagtggggcgtgggcagcagcccccagagagacgacctgaagctgctgtgcgagcagaacgaggaggaggtgagcccccagctgttcaccttccacgaggccgtgagccagatggtggagatggaggagcaggtggtggaggaccacagagccgtgttccaggagagcatcagatggctggaggacgagaaggccctgctggagatgaccgaggaggtggactacgacgtggacagctacgccacccagctggaggccatcctggagcagaagatcgacatcctgaccgagctgagagacaaggtgaagagcttcagagccgccctgcaggaggaggagcaggccagcaagcagatcaaccccaagagacccagagccctgtag

SEQ ID NO: 11163 - DNA, 618 bp, Artificial Sequence
  Description of Artificial Sequence: Synthetic coding sequence
atgagcgtggaccccatgacctacgaggcccagttcttcggcttcaccccccagacctgcatgctgagaatctacatcgccttccaggactacctgttcgaggtgatgcaggccgtggagcaggtgatcctgaagaagctggacggcatccccgactgcgacatcagccccgtgcagatcagaaagtgcaccgagaagttcctgtgcttcatgaagggccacttcgacaacctgttcagcaagatggagcagctgttcctgcagctgatcctgagaatccccagcaacatcctgctgcccgaggacaagtgcaaggagaccccctacagcgaggaggacttccagcacctgcagaaggagatcgagcagctgcaggagaagtacaagaccgagctgtgcaccaagcaggccctgctggccgagctggaggagcagaagatcgtgcaggccaagctgaagcagaccctgaccttcttcgacgagctgcacaacgtgggcagagaccacggcaccagcgacttcagagagagcctggtgagcctggtgcagaacagcagaaagctgcagaacatcagagacaacgtggagaaggagagcaagagactgaagatcagctag

SEQ ID NO: 11164 - DNA, 1866 bp, Artificial Sequence
  Description of Artificial Sequence: Synthetic coding sequence
atggtgctgtgccccgtgatcggcaagctgctgcacaagagagtggtgctggccagcgccagccccagaagacaggagatcctgagcaacgccggcctgagattcgaggtggtgcccagcaagttcaaggagaagctggacaaggccagcttcgccaccccctacggctacgccatggagaccgccaagcagaaggccctggaggtggccaacagactgtaccagaaggacctgagagcccccgacgtggtgatcggcgccgacaccatcgtgaccgtgggcggcctgatcctggagaagcccgtggacaagcaggacgcctacagaatgctgagcagactgagcggcagagagcacagcgtgttcaccggcgtggccatcgtgcactgcagcagcaaggaccaccagctggacaccagagtgagcgagttctacgaggagaccaaggtgaagttcagcgagctgagcgaggagctgctgtgggagtacgtgcacagcggcgagcccatggacaaggccggcggctacggcatccaggccctgggcggcatgctggtggagagcgtgcacggcgacttcctgaacgtggtgggcttccccctgaaccacttctgcaagcagctggtgaagctgtactacccccccagacccgaggacctgagaagaagcgtgaagcacgacagcatccccgccgccgacaccttcgaggacctgagcgacgtggagggcggcggcagcgagcccacccagagagacgccggcagcagagacgagaaggccgaggccggcgaggccggccaggccaccgccgaggccgagtgccacagaaccagagagaccctgccccccttccccaccagactgctggagctgatcgagggcttcatgctgagcaagggcctgctgaccgcctgcaagctgaaggtgttcgacctgctgaaggacgaggccccccagaaggccgccgacatcgccagcaaggtggacgccagcgcctgcggcatggagagactgctggacatctgcgccgccatgggcctgctggagaagaccgagcagggctacagcaacaccgagaccgccaacgtgtacctggccagcgacggcgagtacagcctgcacggcttcatcatgcacaacaacgacctgacctggaacctgttcacctacctggagttcgccatcagagagggcaccaaccagcaccacagagccctgggcaagaaggccgaggacctgttccaggacgcctactaccagagccccgagaccagactgagattcatgagagccatgcacggcatgaccaagctgaccgcctgccaggtggccaccgccttcaacctgagcagattcagcagcgcctgcgacgtgggcggctgcaccggcgccctggccagagagctggccagagagtaccccagaatgcaggtgaccgtgttcgacctgcccgacatcatcgagctggccgcccacttccagccccccggcccccaggccgtgcagatccacttcgccgccggcgacttcttcagagaccccctgcccagcgccgagctgtacgtgctgtgcagaatcctgcacgactggcccgacgacaaggtgcacaagctgctgagcagagtggccgagagctgcaagcccggcgccggcctgctgctggtggagaccctgctggacgaggagaagagagtggcccagagagccctgatgcagagcctgaacatgctggtgcagaccgagggcaaggagagaagcctgggcgagtaccagtgcctgctggagctgcacggcttccaccaggtgcaggtggtgcacctgggcggcgtgctggacgccatcctggccaccaaggtggccccctag

SEQ ID NO: 11165 - DNA, 2541 bp, Artificial Sequence; identical to SEQ ID NO: 9822
  Description of Artificial Sequence: Synthetic coding sequence

SEQ ID NO: 11166 - DNA, 1818 bp, Artificial Sequence
  Description of Artificial Sequence: Synthetic coding sequence
atggtgctgtgccccgtgatcggcaagctgctgcacaagagagtggtgctggccagcgccagccccagaagacaggagatcctgagcaacgccggcctgagattcgaggtggtgcccagcaagttcaaggagaagctggacaaggccagcttcgccaccccctacggctacgccatggagaccgccaagcagaaggccctggaggtggccaacagactgtaccagaccgtgggcggcctgatcctggagaagcccgtggacaagcaggacgcctacagaatgctgagcagactgagcggcagagagcacagcgtgttcaccggcgtggccatcgtgcactgcagcagcaaggaccaccagctggacaccagagtgagcgagttctacgaggagaccaaggtgaagttcagcgagctgagcgaggagctgctgtgggagtacgtgcacagcggcgagcccatggacaaggccggcggctacggcatccaggccctgggcggcatgctggtggagagcgtgcacggcgacttcctgaacgtggtgggcttccccctgaaccacttctgcaagcagctggtgaagctgtactacccccccagacccgaggacctgagaagaagcgtgaagcacgacagcatccccgccgccgacaccttcgaggacctgagcgacgtggagggcggcggcagcgagcccacccagagagacgccggcagcagagacgagaaggccgaggccggcgaggccggccaggccaccgccgaggccgagtgccacagaaccagagagaccctgccccccttccccaccagactgctggagctgatcgagggcttcatgctgagcaagggcctgctgaccgcctgcaagctgaaggtgttcgacctgctgaaggacgaggccccccagaaggccgccgacatcgccagcaaggtggacgccagcgcctgcggcatggagagactgctggacatctgcgccgccatgggcctgctggagaagaccgagcagggctacagcaacaccgagaccgccaacgtgtacctggccagcgacggcgagtacagcctgcacggcttcatcatgcacaacaacgacctgacctggaacctgttcacctacctggagttcgccatcagagagggcaccaaccagcaccacagagccctgggcaagaaggccgaggacctgttccaggacgcctactaccagagccccgagaccagactgagattcatgagagccatgcacggcatgaccaagctgaccgcctgccaggtggccaccgccttcaacctgagcagattcagcagcgcctgcgacgtgggcggctgcaccggcgccctggccagagagctggccagagagtaccccagaatgcaggtgaccgtgttcgacctgcccgacatcatcgagctggccgcccacttccagccccccggcccccaggccgtgcagatccacttcgccgccggcgacttcttcagagaccccctgcccagcgccgagctgtacgtgctgtgcagaatcctgcacgactggcccgacgacaaggtgcacaagctgctgagcagagtggccgagagctgcaagcccggcgccggcctgctgctggtggagaccctgctggacgaggagaagagagtggcccagagagccctgatgcagagcctgaacatgctggtgcagaccgagggcaaggagagaagcctgggcgagtaccagtgcctgctggagctgcacggcttccaccaggtgcaggtggtgcacctgggcggcgtgctggacgccatcctggccaccaaggtggccccctag

SEQ ID NO: 11167 - DNA, 696 bp, Artificial Sequence
  Description of Artificial Sequence: Synthetic coding sequence
atgaccgtgggcaagagcagcaagatgctgcagcacatcgactacagaatgagatgcatcctgcaggacggcagaatcttcatcggcaccttcaaggccttcgacaagcacatgaacctgatcctgtgcgactgcgacgagttcagaaagatcaagcccaagaacagcaagcaggccgagagagaggagaagagagtgctgggcctggtgctgctgagaggcgagaacctggtgagcatgaccgtggagggccccccccccaaggacaccggcatcgccagagtgcccctggccggcgccgccggcggccccggcatcggcagagccgccggcagaggcatccccgccggcgtgcccatgccccaggcccccgccggcctggccggccccgtgagaggcgtgggcggccccagccagcaggtgatgaccccccagggcagaggcaccgtggccgccgccgccgccgccgccaccgccagcatcgccggcgcccccacccagtacccccccggcagaggcggcccccccccccccatgggcagaggcgcccccccccccggcatgatgggccccccccccggcatgagaccccccatgggcccccccatgggcatcccccccggcagaggcacccccatgggcatgcccccccccggcatgagaccccccccccccggcatgagaggcctgctgtag

SEQ ID NO: 11168 - DNA, 855 bp, Artificial Sequence
  Description of Artificial Sequence: Synthetic coding sequence
atgtggagaggcctggccctggccagagccatcggctgcgccgccagaggcagaggccagtgggccgtgagagccgccgactgcgcccagagcggcagacaccccggccccgccgtggtgtgcggcagaagactgatcagcgtgctggagcagatcagacacttcgtgatgatgcccgagatcaacaccaaccacctggacaagcagcaggtgcagctgctggccgagatgtgcatcctgatcgacgagaacgacaacaagatcggcgccgagaccaagaagaactgccacctgaacgagaacatcgagaagggcctgctgcacagagccttcagcgtgttcctgttcaacaccgagaacaagctgctgctgcagcagagaagcgacgccaagatcaccttccccggctgcttcaccaacacctgctgcagccaccccctgagcaaccccgccgagctggaggagagcgacgccctgggcgtgagaagagccgcccagagaagactgaaggccgagctgggcatccccctggaggaggtgccccccgaggagatcaactacctgaccagaatccactacaaggcccagagcgacggcatctggggcgagcacgagatcgactacatcctgctggtgagaaagaacgtgaccctgaaccccgaccccaacgagatcaagagctactgctacgtgagcaaggaggagctgaaggagctgctgaagaaggccgccagcggcgagatcaagatcaccccctggttcaagatcatcgccgccaccttcctgttcaagtggtgggacaacctgaaccacctgaaccagttcgtggaccacgagaagatctacagaatgtag

SEQ ID NO: 11169 - DNA, 180 bp, Artificial Sequence; identical to SEQ ID NO: 9329
  Description of Artificial Sequence: Synthetic coding sequence

SEQ ID NO: 11170 - DNA, 3039 bp, Artificial Sequence
  Description of Artificial Sequence: Synthetic coding sequence
atggaggagtacgagaagttctgcgagaagagcctggccagaatccaggaggccagcctgagcaccgagagcttcctgcccgcccagagcgagagcatcagcctgatcagattccacggcgtggccatcctgagccccctgctgaacatcgagaagagaaaggagatgcagcaggagaagcagaaggccctggacgtggaggccagaaagcaggtgaacagaaagaaggccctgctgaccagagtgcaggagatcctggacaacgtgcaggtgagaaaggcccccaacgccagcgacttcgaccagtgggagatggagaccgtgtacagcaacagcgaggtgagaaacctgaacgtgcccgccaccttccccaacagcttccccagccacaccgagcacagcaccgccgccaagctggacaagatcgccggcatcctgcccctggacaacgaggaccagtgcaagaccgacggcatcgacctggccagagacagcgagggcttcaacagccccaagcagtgcgacagcagcaacatcagccacgtggagaacgaggccttccccaagaccagcagcgccaccccccaggagaccctgatcagcgacggccccttcagcgtgaacgagcagcaggacctgcccctgctggccgaggtgatccccgacccctacgtgatgagcctgcagaacctgatgaagaagagcaaggagtacatcgagagagagcagagcagaagaagcctgagaggcagcatcaacagaatcgtgaacgagagccacctggacaaggagcacgacgccgtggaggtggccgactgcgtgaaggagaagggccagctgaccggcaagcactgcgtgagcgtgatccccgacaagcccagcctgaacaagagcaacgtgctgctgcagggcgccagcacccaggccagcagcatgagcatgcccgtgctggccagcttcagcaaggtggacatccccatcagaaccggccaccccaccgtgctggagagcaacagcgacttcaaggtgatccccaccttcgtgaccgagaacaacgtgatcaagagcctgaccggcagctacgccaagctgcccagccccgagcccagcatgagccccaagatgcacagaagaagaagcagaaccagcagcgcctgccacatcctgatcaacaaccccatcaacgcctgcgagctgagccccaagggcaaggagcaggccatggacctgatcatccaggacaccgacgagaacaccaacgtgcccgagatcatgcccaagctgcccaccgacctggccggcgtgtgcagcagcaaggtgtacgtgggcaagaacaccagcgaggtgaaggaggacgtggtgctgggcaagagcaaccaggtgtgccagagcagcggcaaccacctggagaacaaggtgacccacggcctggtgaccgtggagggccagctgaccagcgacgagagaggcgcccacatcatgaacagcacctgcgccgccatgcccaagctgcacgagccctacgccagcagccagtgcatcgccagccccaacttcggcaccgtgagcggcctgaagcccgccagcatgctggagaagaactgcagcctgcagaccgagctgaacaagagctacgacgtgaagaaccccagccccctgctgatgcagaaccagaacaccagacagcagatggacacccccatggtgagctgcggcaacgagcagttcctggacaacagcttcgagaaggtgaagagaagactggacctggacatcgacggcctgcagaaggagaactgcccctacgtgatcaccagcggcatcaccgagcaggagagacagcacctgcccgagaagagataccccaagggcagcggcttcgtgaacaagaacaagatgctgggcaccagcagcaaggagagcgaggagctgctgaagagcaagatgctggccttcgaggagatgagaaagagactggaggagcagcacgcccagcagctgagcctgctgatcgccgagcaggagagagagcaggagagactgcagaaggagatcgaggagcaggagaagatgctgaaggagaagaaggccatgaccgccgaggccagcgagctggacatcaacaacgccgtggagctggagtggagaaagatcagcgacagcagcctgctggagaccatgctgagccaggccgacagcctgcacaccagcaacagcaacagcagcggcttcaccaacagcgccatgcagtacagcttcgtgagcgccaacgaggcccccttctacctgtggggcagcagcaccagcggcctgaccaagctgagcgtgaccagacccttcggcagagccaagaccagatggagccaggtgttcagcctggagatccaggccaagttcaacaagatcaccgccgtggccaagggcttcctgaccagaagactgatgcagaccgacaagctgaagcagctgagacagaccgtgaaggacaccatggagttcatcagaagcttccagagcgaggcccccctgaagagaggcatcgtgagcgcccaggacgccagcctgcaggagagagtgctggcccagctgagagccgccctgtacggcatccacgacatcttcttcgtgatggacgccgccgagagaatgagcatcctgcaccacgacagagaggtgagaaaggagaagatgctgagacagatggacaagatgaagagccccagagtggccctgagcgccgccacccagaagagcctggacagaaagaagtacatgaaggccgccgagatgggcatgcccaacaagaagttcctggtgaagcagaaccccagcgagaccagagtgctgcagcccaaccagggccagaacgcccccgtgcacagactgctgagcagacagggcacccccaagaccagcgtgaagggcgtggtgcagaacagacagaagcccagccagagcagagtgcccaacagagtgcccgtgagcggcgtgtacgccggcaagatccagagaaagagacccaacgtggccaccatctag

SEQ ID NO: 11171 - DNA, 267 bp, Artificial Sequence
  Description of Artificial Sequence: Synthetic coding sequence
atggccagcgccagcgccagaggcaaccaggacaaggacgcccacttccccccccccagcaagcagagcctgctgttctgccccaagagcaagctgcacatccacagagccgagatcagcaagatcatgagagagtgccaggaggagagcttctggaagagagccctgcccttcagcctggtgagcatgctggtgacccagggcctggtgtaccagggctacctggccgccaacagcagattcggcagcctgcccaaggtggcctag

SEQ ID NO: 11172 - DNA, 738 bp, Artificial Sequence; identical to SEQ ID NO: 9467
  Description of Artificial Sequence: Synthetic coding sequence

SEQ ID NO: 11173 - DNA, 1551 bp, Artificial Sequence
  Description of Artificial Sequence: Synthetic coding sequence
atgagctaccccgccgacgactacgagagcgaggccgcctacgacccctacgcctaccccagcgactacgacatgcacaccggcgaccccaagcaggacctggcctacgagagacagtacgagcagcagacctaccaggtgatccccgaggtgatcaagaacttcatccagtacttccacaagaccgtgagcgacctgatcgaccagaaggtgtacgagctgcaggccagcagagtgagcagcgacgtgatcgaccagaaggtgtacgagatccaggacatctacgagaacagctggaccaagctgaccgagagattcttcaagaacaccccctggcccgaggccgaggccatcgccccccaggtgggcaacgacgccgtgttcctgatcctgtacaaggagctgtactacagacacatctacgccaaggtgagcttccagagcttcagccagtacagatgcaagaccgccaagaagagcgaggaggagatcgacttcctgagaagcaaccccaagatctggaacgtgcacagcgtgctgaacgtgctgcacagcctggtggacaagagcaacatcaacagacagctggaggtgtacaccagcggcggcgaccccgagagcgtggccggcgagtacggcagacacagcctgtacaagatgctgggctacttcagcctggtgggcctgctgagactgcacagcctgctgggcgactactaccaggccatcaaggtgctggagaacatcgagctgaacaagaagagcatgtacagcagagtgcccgagtgccaggtgaccacctactactacgtgggcttcgcctacctgatgatgagaagataccaggacgccatcagagtgttcgccaacatcctgctgtacatccagagaaccaagagcatgttccagagaaccacctacaagtacgagatgatcaacaagcagaacgagcagatgcacgccctgctggccatcgccctgaccatgtaccccatgagaatcgacgagagcatccacctgcagctgagagagaagtacggcgacaagatgctgagaatgcagaagggcgacccccaggtgtacgaggagctgttcagctacagctgccccaagttcctgagccccgtggtgcccaactacgacaacgtgcaccccaactaccacaaggagcccttcctgcagcagctgaaggtgttcagcgacgaggtgcagcagcaggcccagctgagcaccatcagaagcttcctgaagctgtacaccaccatgcccgtggccaagctggccggcttcctggacctgaccgagcaggagttcagaatccagctgctggtgttcaagcacaagatgaagaacctggtgtggaccagcggcatcagcgccctggacggcgagttccagagcgccagcgaggtggacttctacatcgacaaggacatgatccacatcgccgacaccaaggtggccagaagatacggcgacttcttcatcagacagatccacaagttcgaggagctgaacagaaccctgaagaagatgggccagagaccctag

SEQ ID NO: 11174 - DNA, 2502 bp, Artificial Sequence
  Description of Artificial Sequence: Synthetic coding sequence
ctgagcagaagagtgccctgcgtgagaagaggctgcagaccccccctgccccccctgcccggcagccagagcagagcctggagcagagacagagaggcccccctggaccccggcagacccgcccagagcggcagaagacccaccagcagaagcgtgagccacgcctgcagctggaacggcggcagcctggaccccctggagggcacccccgccctgctgagaagcgccgagagactgatgagaaaggtgaagaagctgagactggacaaggagaacaccggcagctggagaagcttcagcctgaacagcgagggcgccgagagaatcaccagctacgacttccacagcgagagcggcctgttcctgttccaggccagcaacagcctgttccactgcagagacggcggcaagaacggcttcatggtgagccccatgaagcccctggagatcaagacccagtgcagcggccccagaatggaccccaagatctgccccgccgaccccgccttcttcagcttcatcaacaacagcgacctgtgggtggccaacatcgagaccggcgaggagagaagactgaccttctgccaccagggcctgagcaacgtgctggacgaccccaagagcgccggcgtggccaccttcgtgatccaggaggagttcgacagattcaccggctactggtggtgccccaccgccagctgggagggcagcgagggcctgaagaccctgagaatcctgtacgaggaggtggacgagagcgaggtggaggtgatccacgtgcccagccccgccctggaggagagaaagaccgacagctacagataccccagaaccggcagcaagaaccccaagatcgccctgaagctggccgagttccagaccgacagccagggcaagatcgtgagcacccaggagaaggagctggtgcagcccttcagcagcctgttccccaaggtggagtacatcgccagagccggctggaccagagacggcaagtacgcctgggccatgttcctggacagaccccagcagtggctgcagctggtgctgctgccccccgccctgttcatccccagcaccgagaacgaggagcagagactggccagcgccagagccgtgcccagaaacgtgcagccctacgtggtgtacgaggaggtgaccaacgtgtggatcaacgtgcacgacatcttctaccccttcccccagagcgagggcgaggacgagctgtgcttcctgagagccaacgagtgcaagaccggcttctgccacctgtacaaggtgaccgccgtgctgaagagccagggctacgactggagcgagcccttcagccccggcgaggacgagttcaagtgccccatcaaggaggagatcgccctgaccagcggcgagtgggaggtgctggccagacacggcagcaagatctgggtgaacgaggagaccaagctggtgtacttccagggcaccaaggacacccccctggagcaccacctgtacgtggtgagctacgaggccgccggcgagatcgtgagactgaccacccccggcttcagccacagctgcagcatgagccagaacttcgacatgttcgtgagccactacagcagcgtgagcacccccccctgcgtgcacgtgtacaagctgagcggccccgacgacgaccccctgcacaagcagcccagattctgggccagcatgatggaggccgccagctgcccccccgactacgtgccccccgagatcttccacttccacaccagaagcgacgtgagactgtacggcatgatctacaagccccacgccctgcagcccggcaagaagcaccccaccgtgctgttcgtgtacggcggcccccaggtgcagctggtgaacaacagcttcaagggcatcaagtacctgagactgaacaccctggccagcctgggctacgccgtggtggtgatcgacggcagaggcagctgccagagaggcctgagattcgagggcgccctgaagaaccagatgggccaggtggagatcgaggaccaggtggagggcctgcagttcgtggccgagaagtacggcttcatcgacctgagcagagtggccatccacggctggagctacggcggcttcctgagcctgatgggcctgatccacaagccccaggtgttcaaggtggccatcgccggcgcccccgtgaccgtgtggatggcctacgacaccggctacaccgagagatacatggacgtgcccgagaacaaccagcacggctacgaggccggcagcgtggccctgcacgtggagaagctgcccaacgagcccaacagactgctgatcctgcacggcttcctggacgagaacgtgcacttcttccacaccaacttcctggtgagccagctgatcagagccggcaagccctaccagctgcagatctaccccaacgagagacacagcatcagatgccccgagagcggcgagcactacgaggtgaccctgctgcacttcctgcaggagtacctgtag

SEQ ID NO: 11175 - DNA, 5073 bp, Artificial Sequence
  Description of Artificial Sequence: Synthetic coding sequence
atggactgcctgctggagctgagcgccaccgacaccaagatcgaggagagcagcagccagagcttcgtggccagcgagaaccaggtgggcgccgccgagagcaagatcatggagaagagacccgaggaggagagcgaggacagcaagatggacagcttcctggacatgcagctgaccgaggacctggacagcctgatccagaacgccttcgagaagctgaacagcagccccgacgaccaggtgtacagcttcctgcccagccaggacgtgaacagcttcaacgacagcagcgagttcatcaaccccgacagcagcaacatgacccccatcttcagcacccagaacatgaacctgaacggcgagaacctggagaacagcggcagcaccctgagcctgaaccccctgcccagccacagcgtgctgaacgagagcaagtgcttcatcaaggacaacaccctggccctggagagcaactaccccgaggacagcctgctgagcagcagcctgaacgtggccagcgacagcatcgccggctgcagcagcctgaaccagaagcagaaggagctgctggagagcgagtgcgtggaggcccagttcagcgaggcccccgtggacctggacgccagcgagccccaggcctgcctgaacctgcccggcctggacctgcccggcaccggcggcgaccagaagagcaccagagtgagcgacgtgttcctgcccagcgagggcttcaacttcaagccccacaagcaccccgagctgcccaccaagggcaaggacgtgagctactgccccgtgctggcccccctgcccctgctgctgcccccccccccccccccccccatgtggaaccccatgatccccgccttcgacctgttccagggcaaccacggcttcgtggcccccgtggtgaccaccgccgcccactggagaagcgtgaactacaccttcccccccagcgtgatcagccacaccagccccaccaaggtgtggagaaacaaggacggcaccagcgcctaccaggtgcaggagacccccgtgagccaggtggtgagaaagaagaccagctacgtgggcctggtgctggtgctgctgagaggcctgcccggcagcggcaagagcttcctggccagaaccctgcaggaggacaaccccagcggcgtgatcctgagcaccgacgactacttctacatcaacggccagtaccagttcgacgtgaagtacctgggcgaggcccacgagtggaaccagaacagagccaaggaggccttcgagaagaagatcagccccatcatcatcgacaacaccaacctgcaggcctgggagatgaagccctacgtggccctgagccagaagcacaagtacaaggtgctgttcagagagcccgacacctggtggaagttcaagcccaaggagctggccagaagaaacatccacggcgtgagcaaggagaagatcaccagaatgctggagcactaccagagattcgtgagcgtgcccatcatcatgagcagcagcgtgcccgagaagatcgagagaatcgagctgtgcgcctacagctgcgaggacagaagcaccagccccagagacgacgaggacatcatcagcgagaaggaggagaacatcctgagcctgagcctgaagcacctggagttcaccgaggagaagaacctggacgtgaccaaggagaccatgctgcccgagaacgtggcctacctgagcaacgccgacctgaacaagagaagaaaggagatcagcgacatgaaccccagcatccagagcgccctgatcctggagaccccccacatgtacttcagcgacagcgagagcaagctgcaggccaccgacaagagcgagaacgagcagatcgagatggtggccgtgaagggctacagcaagaccgacaccgacagcagcatggagagagtgagccccagcacctgctgcagcgagaacaaccaggaggactgcgacctggccaacagcggccccctgcagaacgagaagagcagccccggcgagatcgtggaggagagagccaccgtgaccaagaaggccttcggcaagcagaagagcaagagcaccctggagaagttccccagacacgagctgagcaacttcgtgggcgactggcccgtggacaagaccatcggccagagaaccaagagaaacagaaagaccgagaagaccagcagcgtgcagagcgacaagaagtacaactacccccagagccacaagctggtgaacagcgtgagcgtgaacaccgactgcgtgcagcagagaggcagcccccacgagagcgtggaggacggcagaaagagccagtgcgacgacgccagcgagcccctgaacagctacaagtacgacgcctacaagaacatcgacaagaacagcttcaacatcatgggcgactggcccagcagcgacagcctggcccagagagagcacagaagcagaatgcccaagaccggcctgagcgagcccaacctggagatcggcaccaacgacaagatgaacgagatcagcctgagcaccgcccacgaggcctgctggggcaccagcagccagaagctgaagaccctgggcagcagcaacctgggcagcagcgagatgctgctgagcgagatgacctgcgagagccagacctgcctgagcaagaagagccacggccagcacaccagcctgcccctgaccttcaccaacagcgcccccaccgtgagcggcgtggtggagccccagaccctggccgagtgccaggagcagatgcccaagagagaccccggcaaggaggtgggcatgtgcacccagaccgagccccaggacttcgccctgctgtggaagatcgagaagaacaagatcagcatcagcgacagcatcaaggtgctgaccggcagactggacggcttcaagcccaaggtgttcaacatcaacaccaagagcgacgtgcaggaggccatcccctacagagtgatgtacgacaagagcaccttcgtggaggagagcgagctgaccagcgccgacgagagcgagaacctgaacatcctgtgcaagctgttcggcagcttcagcctggaggccctgaaggacctgtacgagagatgcaacaaggacatcatctgggccaccagcctgctgctggacagcgagaccaagctgtgcgaggacaccgagttcgagaacttccagaagagctgcgacggcagccagatcggccccttcagcctgggcctgaacctgaaggagatcatcagccagagaggcaccctggagaacagcaacagccccgtgcccgagttcagccacggcatcggcatcagcaacgccgacagccagagcacctgcgacgccgagagaggcaacagcgagcaggccgagatgagagccgtgacccccgagaaccacgagagcatgaccagcatcttccccagcgccgccgtgggcctgaagaacaacaacgacatcctgcccaacagccaggaggagctgctgtacagcagcaagcagagcttccccggcatcctgaaggccaccacccccaaggacatgagcgagaccgagaagaacctggtggtgaccgagaccggcgacaacatccacagccccagccacttcagcgacatcttcaacttcgtgagcagcaccagcaacctggagctgaacgaggagatctacttcaccgacagcctggagatcaagagaaacgagaacttccccaaggactacgtgaagttcagcgacgaggaggagttcatgaacgaggacgagaaggagatgaaggagatcctgatggccggcagcagcctgagcgccggcgtgagcggcgaggacaagaccgagatcctgaaccccacccccgccatggccaagagcctgaccatcgactgcctggagctggccctgccccccgagctggccttccagctgaacgagctgttcggccccgtgggcatcgacagcggcagcctgaccgtggaggactgcgtggtgcacatcgacctgaacctggccaaggtgatccacgagaagtggaaggagagcgtgatggagagacagagacaggaggaggtgagctgcggcaagttcatgcaggaccccagcctggtgggccacaccggcctggacaaccccgagcagaagagcagccagagaaccggcaagaagctgctgaagaccctgaccgccagcgagatgctgcccctgctggaccactggaacacccagaccaagaaggtgagcctgagagagatcatgagcgaggagatcgccctgcaggagaagcacaacctgaagagagagaccctgatgttcgagaaggactgcgccaccaagctgaaggagaagcagctgttcaagatcttccccgccatcaaccagaacttcctggtggacatcttcaaggaccacaactacagcctggagcacaccgtgcagttcctgaactgcgtgctggagggcgaccccgtgaagaccgtggtggcccaggagttcgtgcaccagaacgagaacgtgaccagccacaccggccagaagagcaaggagaagaagcccaagaagctgaaggagaccgaggagacccccagcgagctgagcttccaggacttcgagtaccccgactacgacgactacagagccgaggccttcctgcaccagcagaagagaatggagtgctacagcaaggccaaggaggcctacagaatcggcaagaagaacgtggccaccttctacgcccagcagggcaccctgcacgagcagaagatgaaggaggccaaccacctggccgccatcgagatcttcgagaaggtgaacgccagcctgctgccccagaacgtgctggacctgcacggcctgcacgtggacgaggccctggagcacctgatgagagtgctggagaagaagaccgaggagttcaagcagaacggcggcaagccctacctgagcgtgatcaccggcagaggcaaccacagccagggcggcgtggccagaatcaagcccgccgtgatcaagtacctgatcagccacagcttcagattcagcgagatcaagcccggctgcctgaaggtgatgctgaagtag

SEQ ID NO: 11176 - DNA, 477 bp, Artificial Sequence
  Description of Artificial Sequence: Synthetic coding sequence
atgggcagcggcagcagcagaagcagcagaaccctgagaagaagaagaagccccgagagcctgcccgccggccccggcgccgccgccctggagggcggcaccagaagaagagtgcccgtggccgccgccgaggtgcccggcgccgccgccgaggaggcccccggcagagaccccagccccgtggccccccccgacggcagagacgagaccctgagactgctggacgagctgctggccgagagcgccgcctggggcccccccgagcccgcccccagaagacccgccagactgagacccaccgccgtggccggcagcgccgtgtgcgccgagcagagcaccgagggccaccccggcagcggcaacgtgagcgaggcccccggcagcggcagaaagaagcccgagagacccgccgccatcagctacgaccacagcgaggagggcctgatggccagcatcgagagagagtactgcagatag

SEQ ID NO: 11177 - DNA, 738 bp, Artificial Sequence; identical to SEQ ID NO: 9283
  Description of Artificial Sequence: Synthetic coding sequence

SEQ ID NO: 11178 - DNA, 1014 bp, Artificial Sequence
  Description of Artificial Sequence: Synthetic coding sequence
atggagcagccctggcccccccccggcccctggagcctgcccagagccgagggcgaggccgaggaggagagcgacttcgacgtgttccccagcagccccagatgcccccagctgcccggcggcggcgcccagatgtacagccacggcatcgagctggcctgccagaagcagaaggagttcgtgaagagcagcgtggcctgcaagtggaacctggccgaggcccagcagaagctgggcagcctggccctgcacaacagcgagagcctggaccaggagcacgccaaggcccagaccgccgtgagcgagctgagacagagagaggaggagtggagacagaaggaggaggccctggtgcagagagagaagatgtgcctgtggagcaccgacgccatcagcaaggacgtgttcaacaagagcttcatcaaccaggacaagagaaaggacaccgaggacgaggacaagagcgagagcttcatgcagaagtacgagcagaagatcagacacttcggcatgctgagcagatgggacgacagccagagattcctgagcgaccacccctacctggtgtgcgaggagaccgccaagtacctgatcctgtggtgcttccacctggaggccgagaagaagggcgccctgatggagcagatcgcccaccaggccgtggtgatgcagttcatcatggagatggccaagaactgcaacgtggaccccagaggctgcttcagactgttcttccagaaggccaaggccgaggaggagggctacttcgaggccttcaagaacgagctggaggccttcaagagcagagtgagactgtacagccagagccagagcttccagcccatgaccgtgcagaaccacgtgccccacagcggcgtgggcagcatcggcctgctggagagcctgccccagaaccccgactacctgcagtacagcatcagcaccgccctgtgcagcctgaacagcgtggtgcacaaggaggacgacgagcccaagatgatggacaccgtgtag

SEQ ID NO: 11179 - DNA, 927 bp, Artificial Sequence
  Description of Artificial Sequence: Synthetic coding sequence
atggagcagccctggcccccccccggcccctggagcctgcccagagccgagggcgaggccgaggaggagagcgacttcgacgtgttccccagcagccccagatgcccccagctgcccggcggcggcgcccagatgtacagccacggcatcgagctggcctgccagaagcagaaggagttcgtgaagagcagcgtggcctgcaagtggaacctggccgaggcccagcagaagctgggcagcctggccctgcacaacagcgagagcctggaccaggagcacgccaaggcccagaccgccgtgagcgagctgagacagagagaggaggagtggagacagaaggaggaggccctggtgcagagagagaagatgtgcctgtggagcaccgacgccatcagcaaggacgtgttcaacaagagcttcatcaaccaggacaagagaaaggacaccgaggacgaggacaagagcgagagcttcatgcagaagtacgagcagaagatcagacacttcggcatgctgagcagatgggacgacagccagagattcctgagcgaccacccctacctggtgtgcgaggagaccgccaagtacctgatcctgtggtgcttccacctggaggccgagaagaagggcgccctgatggagcagatcgcccaccaggccgtggtgatgcagttcatcatggagatggccaagaactgcaacgtggaccccagaggctgcttcagactgttcttccagaaggccaaggccgaggaggagggctacttcgaggccttcaagaacgagctggaggccttcaagagcagagtgagactgtacagccagagccagagcttccagcccatgaccgtgcagaaccacgtgccccacagcggcgtgggcagcatcggcctgctggagagcctgccccaggcccccagattctag

SEQ ID NO: 11180 - DNA, 4227 bp, Artificial Sequence; identical to SEQ ID NO: 10132
  Description of Artificial Sequence: Synthetic coding sequence

SEQ ID NO: 11181 - DNA, 528 bp, Artificial Sequence
  Description of Artificial Sequence: Synthetic coding sequence
atgatcctgaacgtgctggagtacggcagccagcaggtggccgacctgaccctgaacctggacgactacatcgacgccgagcacctgggcgacttccacagaacctacaagaacagcgaggagctgagaagcagaatcgtgagcggcatcatcacccccatccacgagcagtgggagaaggccaacgtgagcagcccccacagagagttcccccccgccaccgccagagaggtggaccccctgagaatccccccccaccacccccacaccagcagacagcccccctggtgcgaccccctgggccccttcgtggtgggcggcgaggacctggaccccttcggccccagaagaggcggcatgatcgtggaccccctgagaagcggcttccccagagccctgatcgaccccagcagcggcctgcccaacagactgccccccggcgccgtgccccccggcgccagattcgaccccttcggccccatcggcaccagcccccccggccccagacccgacagaagaggccagtag

SEQ ID NO: 11182 - DNA, 552 bp, Artificial Sequence
  Description of Artificial Sequence: Synthetic coding sequence
atggccggcctggaggtgctgttcgccagcgccgcccccgccatcacctgcagacaggacgccctggtgtgcttcctgcactgggaggtggtgacccacggctacttcggcctgggcgtgggcgaccagcccggccccaacgacaagaagagcgagctgctgcccgccggctggaacaacaacaaggacctgtacgtgctgagatacgagtacaaggacggcagcagaaagctgctggtgaaggccatcaccgtggagagcagcatgatcctgaacgtgctggagtacggcagccagcaggtggccgacctgaccctgaacctggacgactacatcgacgccgagcacctgggcgacttccacagaacctacaagaacagcgaggagctgagaagcagaatcgtgagcggcatcatcacccccatccacgagcagtgggagaaggccaacgtgagcagcccccacagagagttcccccccgccaccgccagagaggtggaccccctgagaatccccccccaccacccccacaccagcagacagcccccctag

SEQ ID NO: 11183 - DNA, 888 bp, Artificial Sequence; identical to SEQ ID NO: 9312
  Description of Artificial Sequence: Synthetic coding sequence

SEQ ID NO: 11184 - DNA, 888 bp, Artificial Sequence; identical to SEQ ID NO: 9312
  Description of Artificial Sequence: Synthetic coding sequence

SEQ ID NO: 11185 - DNA, 414 bp, Artificial Sequence
  Description of Artificial Sequence: Synthetic coding sequence
atgggcctgagagccggcggcaccctgggcagagccggcgccggcagaggcgcccccgagggccccggccccagcggcggcgcccagggcggcagcatccacagcggcagaatcgccgccgtgcacaacgtgcccctgagcgtgctgatcagacccctgcccagcgtgctggaccccgccaaggtgcagagcctggtggacaccatcagagaggaccccgacagcgtgccccccatcgacgtgctgtggatcaagggcgcccagggcggcgactacttctacagcttcggcggctgccacagatacgccgcctaccagcagctgcagagagagaccatccccgccaagctggtgcagagcaccctgagcgacctgagagtgtacctgggcgccagcacccccgacctgcagtag

SEQ ID NO: 11186 - DNA, 1731 bp, Artificial Sequence
  Description of Artificial Sequence: Synthetic coding sequence
atgaagtgccactacgaggccctgggcgtgagaagagacgccagcgaggaggagctgaagaaggcctacagaaagctggccctgaagtggcaccccgacaagaacctggacaacgccgccgaggccgccgagcagttcaagctgatccaggccgcctacgacgtgctgagcgacccccaggagagagcctggtacgacaaccacagagaggccctgctgaagggcggcttcgacggcgagtaccaggacgacagcctggacctgctgagatacttcaccgtgacctgctacagcggctacggcgacgacgagaagggcttctacaccgtgtacagaaacgtgttcgagatgatcgccaaggaggagctggagagcgtgctggaggaggaggtggacgacttccccaccttcggcgacagccagagcgactacgacaccgtggtgcaccccttctacgcctactggcagagcttctgcacccagaagaacttcgcctggaaggaggagtacgacaccagacaggccagcaacagatgggagaagagagccatggagaaggagaacaagaagatcagagacaaggccagaaaggagaagaacgagctggtgagacagctggtggccttcatcagaaagagagacaagagagtgcaggcccacagaaagctggtggaggagcagaacgccgagaaggccagaaaggccgaggagatgagaagacagcagaagctgaagcaggccaagctggtggagcagtacagagagcagagctggatgaccatggccaacctggagaaggagctgcaggagatggaggccagatacgagaaggagttcggcgacggcagcgacgagaacgagatggaggagcacgagctgaaggacgaggaggacggcaaggacagcgacgaggccgaggacgccgagctgtacgacgacctgtactgccccgcctgcgacaagagcttcaagaccgagaaggccatgaagaaccacgagaagagcaagaagcacagagagatggtggccctgctgaagcagcagctggaggaggaggaggagaacttcagcagaccccagatcgacgagaaccccctggacgacaacagcgaggaggagatggaggacgcccccaagcagaagctgagcaagaagcagaagaagaagaagcagaagcccgcccaggacgtgcccggcaaggacagctacctgcccgccgcccacttccagatggcctggggcaagaagtgcgtgctgggcgagagaagagacggcgagagcgagcacaagtgcgccaagatgctgctggagaacagacagaactacgacgacaacttcaacgtgaacggccccggcgagggcgtgaaggtggaccccgaggacaccaacctgaaccaggacagcgccaaggagctggaggacagcccccaggagaacgtgagcgtgaccgagatcatcaagccctgcgacgaccccaagagcgaggccaagagcgtgcccaagcccaagggcaagaagaccaaggacatgaagaagcccgtgagagtgcccgccgagccccagaccatgagcgtgctgatcagctgcaccacctgccacagcgagttccccagcagaaacaagctgttcgaccacctgaaggccaccggccacgccagagcccccagcagcagcagcctgaacagcgccaccagcagccagagcaagaaggagaagagaaagaacagatag

SEQ ID NO: 11187 - DNA, 798 bp, Artificial Sequence
  Description of Artificial Sequence: Synthetic coding sequence
atgctggccctgaccgtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacaccccccagagaaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagagacagaggcctgaccgtgctgcccagactggtgagcaacagctggccccaggccgtgctgcccccctggccccccaaggccctggtgctgcaggcctag

SEQ ID NO: 11188 - DNA, 6273 bp, Artificial Sequence
  Description of Artificial Sequence: Synthetic coding sequence
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaagctggccgagtacgagaacctgaccaacaagctgcagagaaacctggagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagagagaagatggagaccgagtgcaacagaagaaccagccagatcgaggcccagttccagagcgactgccagaaggtgaccgagagatgcgagagcgccctgcagagcctggagggcagatacagacaggagctgaaggacctgcaggagcagcagagagaggagaagagccagtgggagttcgagaaggacgagctgacccaggagtgcgccgaggcccaggagctgctgaaggagaccctgaagagagagaagaccaccagcctggtgctgacccaggagagagagatgctggagaagacctacaaggagcacctgaacagcatggtggtggagagacagcagctgctgcaggacctggaggacctgagaaacgtgagcgagacccagcagagcctgctgagcgaccagatcctggagctgaagagcagccacaagagagagctgagagagagagaggaggtgctgtgccaggccggcgccagcgagcagctggccagccagagactggagagactggagatggagcacgaccaggagagacaggagatgatgagcaagctgctggccatggagaacatccacaaggccacctgcgagaccgccgacagagagagagccgagatgagcaccgagatcagcagactgcagagcaagatcaaggagatgcagcaggccaccagccccctgagcatgctgcagagcggctgccaggtgatcggcgaggaggaggtggagggcgacggcgccctgagcctgctgcagcagggcgagcagctgctggaggagaacggcgacgtgctgctgagcctgcagagagcccacgagcaggccgtgaaggagaacgtgaagatggccaccgagatcagcagactgcagcagagactgcagaagctggagcccggcctggtgatgagcagctgcctggacgagcccgccaccgagttcttcggcaacaccgccgagcagaccgagcagttcctgcagcagaacagaaccaagcaggtggagggcgtgaccagaagacacgtgctgagcgacctggaggacgacgaggtgagagacctgggcagcaccggcaccagcagcgtgcagagacaggaggtgaagatcgaggagagcgaggccagcgtggagggcttcagcgagctggagaacagcgaggagaccagaaccgagagctgggagctgaagaaccagatcagccagctgcaggagcagctgatgatgctgtgcgccgactgcgacagagccagcgagaagaagcaggacctgctgttcgacgtgagcgtgctgaagaagaagctgaagatgctggagagaatccccgaggccagccccaagtacaagctgctgtacgaggacgtgagcagagagaacgactgcctgcaggaggagctgagaatgatggagaccagatacgacgaggccctggagaacaacaaggagctgaccgccgaggtgttcagactgcaggacgagctgaagaagatggaggaggtgaccgagaccttcctgagcctggagaagagctacgacgaggtgaagatcgagaacgagggcctgaacgtgctggtgctgagactgcagggcaagatcgagaagctgcaggagagcgtggtgcagagatgcgactgctgcctgtgggaggccagcctggagaacctggagatcgagcccgacggcaacatcctgcagctgaaccagaccctggaggagtgcgtgcccagagtgagaagcgtgcaccacgtgatcgaggagtgcaagcaggagaaccagtacctggagggcaacacccagctgctggagaaggtgaaggcccacgagatcgcctggctgcacggcaccatccagacccaccaggagagacccagagtgcagaaccaggtgatcctggaggagaacaccaccctgctgggcttccaggacaagcacttccagcaccaggccaccatcgccgagctggagctggagaagaccaagctgcaggagctgaccagaaagctgaaggagagagtgaccatcctggtgaagcagaaggacgtgctgagccacggcgagaaggaggaggagctgaaggccatgatgcacgacctgcagatcacctgcagcgagatgcagcagaaggtggagctgctgagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagatgcagcacctgagaagcaccgccacccccagccccagcccccacgcctgggacctgcagctgctgcagcagcaggcctgccccatggtgcccagagagcagttcctgcagctgcagagacagctgctgcaggccgagagaatcaaccagcacctgcaggaggagctggagaacagaaccagcgagaccaacaccccccagggcaaccaggagcagctggtgaccgtgatggaggagagaatgatcgaggtggagcagaagctgaagctggtgaagagactgctgcaggagaaggtgaaccagctgaaggagcaggtgagcctgcccggccacctgtgcagccccaccagccacagcagcttcaacagcagcttcaccagcctgtactgccactag

SEQ ID NO: 11189 - DNA, 4134 bp, Artificial Sequence
  Description of Artificial Sequence: Synthetic coding sequence
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaagctggccgagtacgagaacctgaccaacaagctgcagagaaacctggagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagatgcagcacctgagaagcaccgccacccccagccccagcccccacgcctgggacctgcagctgctgcagcagcaggcctgccccatggtgcccagagagcagttcctgcagctgcagagacagctgctgcaggccgagagaatcaaccagcacctgcaggaggagctggagaacagaaccagcgagaccaacaccccccagggcaaccaggagcagctggtgaccgtgatggaggagagaatgatcgaggtggagcagaagctgaagctggtgaagagactgctgcaggagaaggtgaaccagctgaaggagcaggtgagcctgcccggccacctgtgcagccccaccagccacagcagcttcaacagcagcttcaccagcctgtactgccactag

SEQ ID NO: 11190 - DNA, 3171 bp, Artificial Sequence
  Description of Artificial Sequence: Synthetic coding sequence
atggccaccggcaactacttcggcttcacccacagcggcgccgccgccgccgccgccgccgcccagtacagccagcagcccgccagcggcgtggcctacagccaccccaccaccgtggccagctacaccgtgcaccaggcccccgtggccgcccacaccgtgaccgccgcctacgcccccgccgccgccaccgtggccgtggccagacccgcccccgtggccgtggccgccgccgccaccgccgccgcctacggcggctaccccaccgcccacaccgccaccgactacggctacacccagagacagcaggaggccccccccccccccccccccgccaccacccagaactaccaggacagctacagctacgtgagaagcaccgcccccgccgtggcctacgacagcaagcagtactaccagcagcccaccgccaccgccgccgccgtggccgccgccgcccagccccagcccagcgtggccgagacctactaccagaccgcccccaaggccggctacagccagggcgccacccagtacacccaggcccagcagaccagacaggtgaccgccatcaagcccgccacccccagccccgccaccaccaccttcagcatctaccccgtgagcagcaccgtgcagcccgtggccgccgccgccaccgtggtgcccagctacacccagagcgccacctacagcaccaccgccgtgacctacagcggcaccagctacagcggctacgaggccgccgtgtacagcgccgccagcagctactaccagcagcagcagcagcagcagaagcaggccgccgccgccgccgccgccgccgccgccaccgccgcctggaccggcaccaccttcaccaagaaggcccccttccagaacaagcagctgaagcccaagcagccccccaagcccccccagatccactactgcgacgtgtgcaagatcagctgcgccggcccccagacctacaaggagcacctggagggccagaagcacaagaagaaggaggccgccctgaaggccagccagaacaccagcagcagcaacagcagcaccagaggcacccagaaccagctgagatgcgagctgtgcgacgtgagctgcaccggcgccgacgcctacgccgcccacatcagaggcgccaagcaccagaaggtggtgaagctgcacaccaagctgggcaagcccatccccagcaccgagcccaacgtggtgagccaggccaccagcagcaccgccgtgagcgccagcaagcccaccgccagccccagcagcatcgccgccaacaactgcaccgtgaacaccagcagcgtggccaccagcagcatgaagggcctgaccaccaccggcaacagcagcctgaacagcaccagcaacaccaaggtgagcgccgtgcccaccaacatggccgccaagaagaccagcacccccaagatcaacttcgtgggcggcaacaagctgcagagcaccggcaacaaggccgaggacatcaagggcaccgagtgcgtgaagagcacccccgtgaccagcgccgtgcagatccccgaggtgaagcaggacaccgtgagcgagcccgtgacccccgccagcctggccgccctgcagagcgacgtgcagcccgtgggccacgactacgtggaggaggtgagaaacgacgagggcaaggtgatcagattccactgcaagctgtgcgagtgcagcttcaacgaccccaacgccaaggagatgcacctgaagggcagaagacacagactgcagtacaagaagaaggtgaaccccgacctgcaggtggaggtgaagcccagcatcagagccagaaagatccaggaggagaagatgagaaagcagatgcagaaggaggagtactggagaagaagagaggaggaggagagatggagaatggagatgagaagatacgaggaggacatgtactggagaagaatggaggaggagcagcaccactgggacgacagaagaagaatgcccgacggcggctacccccacggcccccccggccccctgggcctgctgggcgtgagacccggcatgcccccccagccccagggccccgcccccctgagaagacccgacagcagcgacgacagatacgtgatgaccaagcacgccaccatctaccccaccgaggaggagctgcaggccgtgcagaagatcgtgagcatcaccgagagagccctgaagctggtgagcgacagcctgagcgagcacgagaagaacaagaacaaggagggcgacgacaagaaggagggcggcaaggacagagccctgaagggcgtgctgagagtgggcgtgctggccaagggcctgctgctgagaggcgacagaaacgtgaacctggtgctgctgtgcagcgagaagcccagcaagaccctgctgagcagaatcgccgagaacctgcccaagcagctggccgtgatcagccccgagaagtacgacatcaagtgcgccgtgagcgaggccgccatcatcctgaacagctgcgtggagcccaagatgcaggtgaccatcaccctgaccagccccatcatcagagaggagaacatgagagagggcgacgtgaccagcggcatggtgaaggacccccccgacgtgctggacagacagaagtgcctggacgccctggccgccctgagacacgccaagtggttccagcaggccagagccaacggcctgcagagctgcgtgatcatcatcagaatcctgagagacctgtgccagagagtgcccacctggagcgacttccccagctgggccatggagctgctggtggagaaggccatcagcagcgccagcagcccccagagccccggcgacgccctgagaagagtgttcgagtgcatcagcagcggcatcatcctgaagggcagccccggcctgctggacccctgcgagaaggaccccttcgacaccctggccaccatgaccgaccagcagagagaggacatcaccagcagcgcccagttcgccctgagactgctggccttcagacagatccacaaggtgctgggcatggaccccctgccccagatgagccagagattcaacatccacaacaacagaaagagaagaagagacagcgacggcatggacctgaagctgagaggcaagaagaccaagaagatcatgatcaccttcaagaagtgcctgtag

SEQ ID NO: 11191 - DNA, 390 bp, Artificial Sequence
  Description of Artificial Sequence: Synthetic coding sequence
atgggctgctgcggctgcagcggcggctgcggcagcggctgcggcggctgcggcagcggctgcggcggctgcggcagcagctgctgcgtgcccatctgctgctgcaagcccgtgtgctgctgcgtgcccgcctgcagctgcaccagctgcggcagctgcggcggcagcaagggctgctgcggcagctgcggcggcagcaagggcggctgcggcagctgcggcggcagcaagggcggctgcggcagctgcggctgcagccagtgcagctgctgcaagccctgctactgcagcagcggctgcggcagcagctgctgccagagcagctgctgcaagccctgctgcagccaggccagctgctgcgtgcccatctgctgccagtgcaagatctag

SEQ ID NO: 11192 - DNA, 1344 bp, Artificial Sequence
  Description of Artificial Sequence: Synthetic coding sequence
atgcccatgcccaccgagggcacccccccccccctgagcggcacccccatccccgtgcccgcctacttcagacacgccgagcccggcttcagcctgaagagacccagaggcctgagcagaagcctgcccccccccccccccgccaagggcagcatccccatcagcagactgttcccccccagaacccccggctggcaccagctgcagcccagaagagtgagcttcagaggcgaggccagcgagaccctgcagagccccggctacgaccccagcagacccgagagcttcttccagcagagcttccagagactgagcagactgggccacggcagctacggcgaggtgttcaaggtgagaagcaaggaggacggcagactgtacgccgtgaagagaagcatgagccccttcagaggccccaaggacagagccagaaagctggccgaggtgggcagccacgagaaggtgggccagcacccctgctgcgtgagactggagcaggcctgggaggagggcggcatcctgtacctgcagaccgagctgtgcggccccagcctgcagcagcactgcgaggcctggggcgccagcctgcccgaggcccaggtgtggggctacctgagagacaccctgctggccctggcccacctgcacagccagggcctggtgcacctggacgtgaagcccgccaacatcttcctgggccccagaggcagatgcaagctgggcgacttcggcctgctggtggagctgggcaccgccggcgccggcgaggtgcaggagggcgaccccagatacatggcccccgagctgctgcagggcagctacggcaccgccgccgacgtgttcagcctgggcctgaccatcctggaggtggcctgcaacatggagctgccccacggcggcgagggctggcagcagctgagacagggctacctgccccccgagttcaccgccggcctgagcagcgagctgagaagcgtgctggtgatgatgctggagcccgaccccaagctgagagccaccgccgaggccctgctggccctgcccgtgctgagacagcccagagcctggggcgtgctgtggtgcatggccgccgaggccctgagcagaggctgggccctgtggcaggccctgctggccctgctgtgctggctgtggcacggcctggcccaccccgccagctggctgcagcccctgggcccccccgccaccccccccggcagccccccctgcagcctgctgctggacagcagcctgagcagcaactgggacgacgacagcctgggcccctgcgtgctgaagagaaccgagggcgccctggagtgcagccagatggagggcctgtag

SEQ ID NO: 11193 - DNA, 1005 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccagtag

SEQ ID NO: 11194 - DNA, 1173 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 11195 - DNA, 1173 bp, Artificial Sequence; identical to SEQ ID NO: 11194
  Description of Artificial Sequence: Synthetic coding sequence

SEQ ID NO: 11196 - DNA, 1101 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 11197 - DNA, 1149 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccagtag

SEQ ID NO: 11198 - DNA, 1842 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcagagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcagagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtgcgagatctgcaagatcctggtgctgaagaacgccgccgccttcctgtgccacagcaaggtgaacagaagcatctag

SEQ ID NO: 11199 - DNA, 384 bp, Artificial Sequence; identical to SEQ ID NO: 9944
  Description of Artificial Sequence: Synthetic coding sequence

SEQ ID NO: 11200 - DNA, 537 bp, Artificial Sequence
  Description of Artificial Sequence: Synthetic coding sequence
atgatgagagccatgaagccccccggcggcgagagcagcaacctgttcggcagccccgaggaggccacccccagcagcagacccaacagaatggccagcaacatcttcggccccaccgaggagccccagaacatccccaagagaaccaacccccccggcggcaagggcagcggcatcttcgacgagagcacccccgtgcagaccagacagcacctgaacccccccggcggcaagaccagcgacatcttcggcagccccgtgaccgccaccagcagactggcccaccccaacaagcccaaggaccacgtgttcctgtgcgagggcgaggagcccaagagcgacctgaaggccgccagaagcatccccgccggcgccgagcccggcgagaagggcagcgccagaaaggccggccccgccaaggagcaggagcccatgcccaccgtggacagccacgagcccagactgggccccagacccagaagccacaacaaggtgctgaacccccccggcggcaagagcagcatcagcttctactag

SEQ ID NO: 11201 - DNA, 657 bp, Artificial Sequence
  Description of Artificial Sequence: Synthetic coding sequence
atgttccaggtgcccgacagcgagggcggcagagccggcagcagaaagtggcagctgctgaccggcagcctggccagcaccagccccagcctgctgagcggccagggcccctgggcccccctgcagagagccatgaagccccccggcggcgagagcagcaacctgttcggcagccccgaggaggccacccccagcagcagacccaacagaatggccagcaacatcttcggccccaccgaggagccccagaacatccccaagagaaccaacccccccggcggcaagggcagcggcatcttcgacgagagcacccccgtgcagaccagacagcacctgaacccccccggcggcaagaccagcgacatcttcggcagccccgtgaccgccaccagcagactggcccaccccaacaagcccaaggaccacgtgttcctgtgcgagggcgaggagcccaagagcgacctgaaggccgccagaagcatccccgccggcgccgagcccggcgagaagggcagcgccagaaaggccggccccgccaaggagcaggagcccatgcccaccgtggacagccacgagcccagactgggccccagacccagaagccacaacaaggtgctgaacccccccggcggcaagagcagcatcagcttctactag

SEQ ID NO: 11202 - DNA, 4866 bp, Artificial Sequence
  Description of Artificial Sequence: Synthetic coding sequence
atggccggcggcagaggcgcccccggcagaggcagagacgagccccccgagagctacccccagagacaggaccacgagctgcaggccctggaggccatctacggcgccgacttccaggacctgagacccgacgcctgcggccccgtgaaggagccccccgagatcaacctggtgctgtacccccagggcctgaccggcgaggaggtgtacgtgaaggtggacctgagagtgaagtgcccccccacctaccccgacgtggtgcccgagatcgagctgaagaacgccaagggcctgagcaacgagagcgtgaacctgctgaagagcagactggaggagctggccaagaagcactgcggcgaggtgatgatcttcgagctggcctaccacgtgcagagcttcctgagcgagcacaacaagcccccccccaagagcttccacgaggagatgctggagagaagagcccaggaggagcagcagagactgctggaggccaagagaaaggaggagcaggagcagagagagatcctgcacgagatccagagaagaaaggaggagatcaaggaggagaagaagagaaaggagatggccaagcaggagagactggagatcgccagcctgagcaaccaggaccacaccagcaagaaggaccccggcggccacagaaccgccgccatcctgcacggcggcagccccgacttcgtgggcaacggcaagcacagagccaacagcagcggcagaagcagaagagagagacagtacagcgtgtgcaacagcgaggacagccccggcagctgcgagatcctgtacttcaacatgggcagccccgaccagctgatggtgcacaagggcaagtgcatcggcagcgacgagcagctgggcaagctggtgtacaacgccctggagaccgccaccggcggcttcgtgctgctgtacgagtgggtgctgcagtggcagaagaagatgggccccttcctgaccagccaggagaaggagaagatcgacaagtgcaagaagcagatccagggcaccgagaccgagttcaacagcctggtgaagctgagccaccccaacgtggtgagatacctggccatgaacctgaaggagcaggacgacagcatcgtggtggacatcctggtggagcacatcagcggcgtgagcctggccgcccacctgagccacagcggccccatccccgtgcaccagctgagaagatacaccgcccagctgctgagcggcctggactacctgcacagcaacagcgtggtgcacaaggtgctgagcgccagcaacgtgctggtggacgccgagggcaccgtgaagatcaccgactacagcatcagcaagagactggccgacatctgcaaggaggacgtgttcgagcagaccagagtgagattcagcgacaacgccctgccctacaagaccggcaagaagggcgacgtgtggagactgggcctgctgctgctgagcctgagccagggccaggagtgcggcgagtaccccgtgaccatccccagcgacctgcccgccgacttccaggacttcctgaagaagtgcgtgtgcctggacgacaaggagagatggagcccccagcagctgctgaagcacagcttcatcaacccccagcccaagatgcccctggtggagcagagccccgaggacagcgagggccaggactacgtggagaccgtgatccccagcaacagactgcccagcgccgccttcttcagcgagacccagagacagttcagcagatacttcatcgagttcgaggagctgcagctgctgggcaagggcgccttcggcgccgtgatcaaggtgcagaacaagctggacggctgctgctacgccgtgaagagaatccccatcaaccccgccagcagacagttcagaagaatcaagggcgaggtgaccctgctgagcagactgcaccacgagaacatcgtgagatactacaacgcctggatcgagagacacgagagacccgccggccccggcacccccccccccgacagcggccccctggccaaggacgacagagccgccagaggccagcccgccagcgacaccgacggcctggacagcgtggaggccgccgcccccccccccatcctgagcagcagcgtggagtggagcaccagcggcgagagaagcgccagcgccagattccccgccaccggccccggcagcagcgacgacgaggacgacgacgaggacgagcacggcggcgtgttcagccagagcttcctgcccgccagcgacagcgagagcgacatcatcttcgacaacgaggacgagaacagcaagagccagaaccagatggagtactgcgagaagagcaccctgagagacaccatcgaccagggcctgtacagagacaccgtgagactgtggagactgttcagagagatcctggacggcctggcctacatccacgagaagggcatgatccacagagacctgaagcccgtgaacatcttcctggacagcgacgaccacgtgaagatcggcgacttcggcctggccaccgaccacctggccttcagcgccgacagcaagcaggacgaccagaccggcgacctgatcaagagcgaccccagcggccacctgaccggcatggtgggcaccgccctgtacgtgagccccgaggtgcagggcagcaccaagagcgcctacaaccagaaggtggacctgttcagcctgggcatcatcttcttcgagatgagctaccaccccatggtgaccgccagcgagagaatcttcgtgctgaaccagctgagagaccccaccagccccaagttccccgaggacttcgacgacggcgagcacgccaagcagaagagcgtgatcagctggctgctgaaccacgaccccgccaagagacccaccgccaccgagctgctgaagagcgagctgctgccccccccccagatggaggagagcgagctgcacgaggtgctgcaccacaccctgaccaacgtggacggcaaggcctacagaaccatgatggcccagatcttcagccagagaatcagccccgccatcgactacacctacgacagcgacatcctgaagggcaacttcagcatcagaaccgccaagatgcagcagcacgtgtgcgagaccatcatcagaatcttcaagagacacggcgccgtgcagctgtgcacccccctgctgctgcccagaaacagacagatctacgagcacaacgaggccgccctgttcatggaccacagcggcatgctggtgatgctgcccttcgacctgagaatccccttcgccagatacgtggccagaaacaacatcctgaacctgaagagatactgcatcgagagagtgttcagacccagaaagctggacagattccaccccaaggagctgctggagtgcgccttcgacatcgtgaccagcaccaccaacagcttcctgcccaccgccgagatcatctacaccatctacgagatcatccaggagttccccgccctgcaggagagaaactacagcatctacctgaaccacaccatgctgctgaaggccatcctgctgcactgcggcatccccgaggacaagctgagccaggtgtacatcatcctgtacgacgccgtgaccgagaagctgaccagaagagaggtggaggccaagttctgcaacctgagcctgagcagcaacagcctgtgcagactgtacaagttcatcgagcagaagggcgacctgcaggacctgatgcccaccatcaacagcctgatcaagcagaagaccggcatcgcccagctggtgaagtacggcctgaaggacctggaggaggtggtgggcctgctgaagaagctgggcatcaagctgcaggtgctgatcaacctgggcctggtgtacaaggtgcagcagcacaacggcatcatcttccagttcgtggccttcatcaagagaagacagagagccgtgcccgagatcctggccgccggcggcagatacgacctgctgatcccccagttcagaggcccccaggccctgggccccgtgcccaccgccatcggcgtgagcatcgccatcgacaagatcagcgccgccgtgctgaacatggaggagagcgtgaccatcagcagctgcgacctgctggtggtgagcgtgggccagatgagcatgagcagagccatcaacctgacccagaagctgtggaccgccggcatcaccgccgagatcatgtacgactggagccagagccaggaggagctgcaggagtactgcagacaccacgagatcacctacgtggccctggtgagcgacaaggagggcagccacgtgaaggtgaagagcttcgagaaggagagacagaccgagaagagagtgctggagaccgagctggtggaccacgtgctgcagaagctgagaaccaaggtgaccgacgagagaaacggcagagaggccagcgacaacctggccgtgcagaacctgaagggcagcttcagcaacgccagcggcctgttcgagatccacggcgccaccgtggtgcccatcgtgagcgtgctggcccccgagaagctgagcgccagcaccagaagaagatacgagacccaggtgcagaccagactgcagaccagcctggccaacctgcaccagaagagcagcgagatcgagatcctggccgtggacctgcccaaggagaccatcctgcagttcctgagcctggagtgggacgccgacgagcaggccttcaacaccaccgtgaagcagctgctgagcagactgcccaagcagagatacctgaagctggtgtgcgacgagatctacaacatcaaggtggagaagaaggtgagcgtgctgttcctgtacagctacagagacgactactacagaatcctgttctag

SEQ ID NO: 11203 - DNA, 2388 bp, Artificial Sequence
  Description of Artificial Sequence: Synthetic coding sequence
atgaagttcaccaacaccaaggtgcagatgatgcagaacgtgcacctggcccccgagaccgacgaggacgacctgtacagcggctacaacgactacaaccccatctacgacatcgaggagctggagaacgacgccgccttccagcaggccgtgagaaccagccacggcagaagaccccccatcaccgccaagatcagcagcaccgccgtgaccagacccatcgccaccggctacggcagcaagaccagcctggccagcagcatcggcagacccatgaccggcgccatccaggacggcgtgaccagacccatgaccgccgtgagagccgccggcttcaccaaggccgccctgagaggcagcgccttcgaccccctgagccagagcagaggccccgccagccccctggaggccaagaagaaggacagccccgaggagaagatcaagcagctggagaaggaggtgaacgagctggtggaggagagctgcatcgccaacagctgcggcgacctgaagctggccctggagaaggccaaggacgccggcagaaaggagagagtgctggtgagacagagagagcaggtgaccacccccgagaacatcaacctggacctgacctacagcgtgctgttcaacctggccagccagtacagcgtgaacgagatgtacgccgaggccctgaacacctaccaggtgatcgtgaagaacaagatgttcagcaacgccggcatcctgaagatgaacatgggcaacatctacctgaagcagagaaactacagcaaggccatcaagttctacagaatggccctggaccaggtgcccagcgtgaacaagcagatgagaatcaagatcatgcagaacatcggcgtgaccttcatccaggccggccagtacagcgacgccatcaacagctacgagcacatcatgagcatggcccccaacctgaaggccggctacaacctgaccatctgctacttcgccatcggcgacagagagaagatgaagaaggccttccagaagctgatcaccgtgcccctggagatcgacgaggacaagtacatcagccccagcgacgacccccacaccaacctggtgaccgaggccatcaagaacgaccacctgagacagatggagagagagagaaaggccatggccgagaagtacatcatgaccagcgccaagctgatcgcccccgtgatcgagaccagcttcgccgccggctacgactggtgcgtggaggtggtgaaggccagccagtacgtggagctggccaacgacctggagatcaacaaggccgtgacctacctgagacagaaggactacaaccaggccgtggagatcctgaaggtgctggagaagaaggacagcagagtgaagagcgccgccgccaccaacctgagcgccctgtactacatgggcaaggacttcgcccaggccagcagctacgccgacatcgccgtgaacagcgacagatacaaccccgccgccctgaccaacaagggcaacaccgtgttcgccaacggcgactacgagaaggccgccgagttctacaaggaggccctgagaaacgacagcagctgcaccgaggccctgtacaacatcggcctgacctacgagaagctgaacagactggacgaggccctggactgcttcctgaagctgcacgccatcctgagaaacagcgccgaggtgctgtaccagatcgccaacatctacgagctgatggagaaccccagccaggccatcgagtggctgatgcaggtggtgagcgtgatccccaccgacccccaggtgctgagcaagctgggcgagctgtacgacagagagggcgacaagagccaggccttccagtactactacgagagctacagatacttcccctgcaacatcgaggtgatcgagtggctgggcgcctactacatcgacacccagttctgggagaaggccatccagtacttcgagagagccagcctgatccagcccacccaggtgaagtggcagctgatggtggccagctgcttcagaagaagcggcaactaccagaaggccctggacacctacaaggacacccacagaaagttccccgagaacgtggagtgcagcggcagcgtgagaaccggccacatggagagagaccccctgaacctgctgcccagaaagagcgtgctgcccggccccgagatcgccaagtgcaactacttcagcggcgagaagtactacctgagcgccttcctgagcagcagcctgcacagaagctggatcaagagatgcagcagaatctgccagaagaccgaggaggtgggcaagaacgagagaaacaagggcaccgcccacaaggtgagacagagatggcagtggggcctgccctggcagaagagaagaaagtgctag

SEQ ID NO: 11204 - DNA, 192 bp, Artificial Sequence
  Description of Artificial Sequence: Synthetic coding sequence
atgagctactacagaagctactacggcggcctgggctacggctacggcggcttcggcggctggggctacggctacggctgcggctacggcagcttcagaagactgggctacggctgcggctacggcggctacggcttcagctgctgcagacccctgtactacggcggctacggcttcagcgccttctactag

SEQ ID NO: 11205 - DNA, 135 bp, Artificial Sequence
  Description of Artificial Sequence: Synthetic coding sequence
atgagctactacggcaactactacggcggcctgggctacggctacgactgcaagtacagctacaccagcggcttcggcgccttcagaatcctggactgcggctacagatgcggctgcggcggcgtgtggatctag

SEQ ID NO: 11206 - DNA, 135 bp, Artificial Sequence
  Description of Artificial Sequence: Synthetic coding sequence
atgagctactacagccacctgagcggcggcctgggctgcggcctggccgtggccgtgaccatgggcagaaccgtggccgtggccgagtacggcagatgcagacacggctgccacagcagctacagcgccagatag

SEQ ID NO: 11207 - DNA, 138 bp, Artificial Sequence
  Description of Artificial Sequence: Synthetic coding sequence
atgtgctactaccacaactactacggcagcctggactacggctgcagctacggcagcgagtacggcaacagcggctacgcctgcaacttcccctgcagctacggcagattcctgctggcccccagaaagaagttctag

SEQ ID NO: 11208 - DNA, 624 bp, Artificial Sequence
  Description of Artificial Sequence: Synthetic coding sequence
atgccccacagccactgccacagcctgagaagcttccacaacgccccccccctgagcgccatcacccacggcaccaaccccatcaccttcgaggacagactgtgcctgcccagcagcttccacagcagaacctgcttcctggacaacttccaggagacctgcaacgagaccaccagctgccagatgaccaactgcgagcaggacctgttcaccgacgacagctgcgtgcagagcaactgcttccccggcgtggtgcagaccacctacagcaacagcagaccctgcgagagaaccgcctgccagagcgagagcagcagcgccggcctggcctgcgtgagccagccctgccagagcgagagcacccagcagatgggcttcgtggcccagagctgccagcccgccagcctgaagggcaacagctgcccccccaagaccagcaagagcaagaacttcgagaccctggagagagccagcagccagtgccagtgccagagccagaaccccgagagcagcagctgcagacccctggtgaacgtggcccccgagccccagctgctggagagcagccccggcgtggagcccacctgctgcgtgaccggcggcagccagctgcccagcaagtag

SEQ ID NO: 11209 - DNA, 645 bp, Artificial Sequence
  Description of Artificial Sequence: Synthetic coding sequence
atggcccacgtgagcagcgagacccaggacgtgagccccaaggacgagctgaccgccagcgaggccagcaccagaagccccctgtgcgagcacaccttccccggcgacagcgacctgagaagcatgatcgaggagcacgccttccaggtgctgagccagggcagcctgctggagagccccagctacaccgtgtgcgtgagcgagcccgacaaggacgacgacttcctgagcctgaacttccccagaaagctgtggaagatcgtggagagcgaccagttcaagagcatcagctgggacgagaacggcacctgcatcgtgatcaacgaggagctgttcaagaaggagatcctggagaccaaggccccctacagaatcttccagaccgacgccatcaagagcttcgtgagacagctgaacctgtacggcttcagcaagatccagcagaacttccagagaagcgccttcctggccaccttcctgagcgaggagaaggagagcagcgtgctgagcaagctgcacgtgttcgtgttccaccacagcctgttcggcgccaccttcggcgagcaccacttccagccctgccccctgcccagcggcaacaaggcccccatcagcacctggagcggcgacagctggctgctgtag

SEQ ID NO: 11210 - DNA, 645 bp, Artificial Sequence; identical to SEQ ID NO: 11209
  Description of Artificial Sequence: Synthetic coding sequence

SEQ ID NO: 11211 - DNA, 1437 bp, Artificial Sequence
  Description of Artificial Sequence: Synthetic coding sequence
atggccgccgccctgaagtgcctgctgaccctgggcagatggtgccccggcctgggcgtggccccccaggccagagccctggccgccctggtgcccggcgtgacccaggtggacaacaagagcggcttcctgcagaagagaccccacagacagcaccccggcatcctgaagctgccccacgtgagactgccccaggccctggccaacggcgcccagctgctgctgctgggcagcgccggccccaccatggagaaccaggtgcagaccctgaccagctacctgtggagcagacacctgcccgtggagcccgaggagctgcagagaagagccagacacctggagaagaagttcctggagaaccccgacctgagccagaccgaggagaagctgagaggcgccgtgctgcacgccctgagaaagaccacctaccactggcaggagctgagctacaccgagggcctgagcctggtgtacatggccgccagactggacggcggcttcgccgccgtgagcagagccttccacgagatcagagccagaaaccccgccttccagccccagaccctgatggacttcggcagcggcaccggcagcgtgacctgggccgcccacagcatctggggccagagcctgagagagtacatgtgcgtggacagaagcgccgccatgctggtgctggccgagaagctgctgaagggcggcagcgagagcggcgagccctacatccccggcgtgttcttcagacagttcctgcccgtgagccccaaggtgcagttcgacgtggtggtgagcgccttcagcctgagcgagctgcccagcaaggccgacagaaccgaggtggtgcagaccctgtggagaaagaccggccacttcctggtgctggtggagaacggcaccaaggccggccacagcctgctgatggacgccagagacctggtgctgaagggcaaggagaagagccccctggaccccagacccggcttcgtgttcgccccctgcccccacgagctgccctgcccccagctgaccaacctggcctgcagcttcagccaggcctaccaccccatccccttcagctggaacaagaagcccaaggaggagaagttcagcatggtgatcctggccagaggcagccccgaggaggcccacagatggcccagaatcacccagcccgtgctgaagagacccagacacgtgcactgccacctgtgctgccccgacggccacatgcagcacgccgtgctgaccgccagaagacacggcagatacggcggctgcgaccagaaccagtgggacgtggccggcagctgcagccccagacagcacctgttcccccagggcttcgtgagcctgtgcccctgccagctgctgggcagaagcttcacctgcgcctacagcgtgtgcgtgagcagcatctacggcagcggcagcctgtag

SEQ ID NO: 11212 - DNA, 774 bp, Artificial Sequence
  Description of Artificial Sequence: Synthetic coding sequence
atggaggaggaggccagcagccccggcctgggctgcagcaagccccacctggagaagctgaccctgggcatcaccagaatcctggagagcagccccggcgtgaccgaggtgaccatcatcgagaagccccccgccgagagacacatgatcagcagctgggagcagaagaacaactgcgtgatgcccgaggacgtgaagaacttctacctgatgaccaacggcttccacatgacctggagcgtgaagctggacgccagcgacgaccagcccgagaagccccacttcgacagcagaagcgtgatcttcgagctggacagctgcaacggcagcggcaaggtgtgcctggtgtacaagagcggcaagcccgccctggccgaggacaccgagatctggttcctggacagagccctgtactggcacttcctgaccgacaccttcaccgcctactacagactgctgatcacccacctgggcctgccccagtggcagtacgccttcaccagctacggcatcagcccccaggccaagcagtggttcagcatgtacaagcccatcacctacaacaccaacctgctgaccgaggagaccgacagcttcgtgaacaagctggaccccagcaaggtgttcaagagcaagaacaagatcgtgatccccaagaagaagggccccgtgcagcccgccggcggccagaagggccccagcggccccagcggccccagcaccagcagcaccagcaagagcagcagcggcagcggcaaccccaccagaaagtag

SEQ ID NO: 11213 - DNA, 792 bp, Artificial Sequence; identical to SEQ ID NO: 9911
  Description of Artificial Sequence: Synthetic coding sequence

SEQ ID NO: 11214 - DNA, 390 bp, Artificial Sequence; identical to SEQ ID NO: 10956
  Description of Artificial Sequence: Synthetic coding sequence

SEQ ID NO: 11215 - DNA, 1626 bp, Artificial Sequence
  Description of Artificial Sequence: Synthetic coding sequence
atggaggccctgctggagggcatccagaacagaggccacggcggcggcttcctgaccagctgcgaggccgagctgcaggagctgatgaagcagatcgacatcatggtggcccacaagaagagcgagtgggagggcagaacccacgccctggagacctgcctgaagatcagagagcaggagctgaagagcctgagaagccagctggacgtgacccacaaggaggtgggcatgctgcaccagcaggtggaggagcacgagaagatcaagcaggagatgaccatggagtacaagcaggagctgaagaagctgcacgaggagctgtgcatcctgaagagaagctacgagaagctgcagaagaagcagatgagagagttcagaggcaacaccaagaaccacagagaggacagaagcgagatcgagagactgaccgccaagatcgaggagttcagacagaagagcctggactgggagaagcagagactgatctaccagcagcaggtgagcagcctggaggcccagagaaaggccctggccgagcagagcgagatcatccaggcccagctggtgaacagaaagcagaagctggagagcgtggagctgagcagccagagcgagatccagcacctgagcagcaagctggagagagccaacgacaccatctgcgccaacgagctggagatcgagagactgaccatgagagtgaacgacctggtgggcaccagcatgaccgtgctgcaggagcagcagcagaaggaggagaagctgagagagagcgagaagctgctggaggccctgcaggaggagaagagagagctgaaggccgccctgcagagccaggagaacctgatccacgaggccagaatccagaaggagaagctgcaggagaaggtgaaggccaccaacacccagcacgccgtggaggccatcagacccagagaggagagcctggccgagaagaagtacaccagccagggccagggcgacctggacagcgtgctgagccagctgaacttcacccacaccagcgaggacctgctgcaggccgaggtgacctgcctggagggcagcctggagagcgtgagcgccacctgcaagcagctgagccaggagctgatggagaagtacgaggagctgaagagaatggaggcccacaacaacgagtacaaggccgagatcaagaagctgaaggagcagatcctgcagggcgagcagagctacagcagcgccctggagggcatgaagatggagatcagccacctgacccaggagctgcaccagagagacatcaccatcgccagcaccaagggcagcagcagcgacatggagaagagactgagagccgagatgcagaaggccgaggacaaggccgtggagcacaaggagatcctggaccagctggagagcctgaagctggagaacagacacctgagcgagatggtgatgaagctggagctgggcctgcacgagtgcagcctgcccgtgagccccctgggcagcatcgccaccagattcctggaggaggaggagctgagaagccaccacatcctggagagactggacgcccacatcgaggagctgaagagagagagcgagaagaccgtgagacagttcaccgccctgaagtag

SEQ ID NO: 11216 - DNA, 483 bp, Artificial Sequence; identical to SEQ ID NO: 10977
  Description of Artificial Sequence: Synthetic coding sequence

SEQ ID NO: 11217 - DNA, 483 bp, Artificial Sequence; identical to SEQ ID NO: 10977
  Description of Artificial Sequence: Synthetic coding sequence

SEQ ID NO: 11218 - DNA, 3192 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagagaggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcagctgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcaccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 11219 - DNA, 1620 bp, Artificial Sequence; identical to SEQ ID NO: 10018
  Description of Artificial Sequence: Synthetic coding sequence

SEQ ID NO: 11220 - DNA, 678 bp, Artificial Sequence
  Description of Artificial Sequence: Synthetic coding sequence
atggccgccggcagcgaggccaccacccccgtgatcgtggccgccggcgccggcggcgaggagggcgagcacgtgaagcccttcaagcccgagaaggccaaggagatcatcatgagcctgcagcagcccgccatcttctgcaacatggtgttcgactggcccgccagacactggaacgccaagtacctgagccaggtgctgcacggcaagcagatcagattcagaatgggcatgaagagcatgagcaccgtgccccagttcgagaccacctgcaactacgtggaggccaccctggaggagttcctgacctggaactgcgaccagagcagcatcagcggccccttcagagactacgaccacagcaagttctgggcctacgccgactacaagtacttcgtgagcctgttcgaggacaagaccgacctgttccaggacgtgaagtggagcgacttcggcttccccggcagaaacggccaggagagcaccctgtggatcggcagcctgggcgcccacaccccctgccacctggacagctacggctgcaacctggtgttccaggtgcagggcagactggagtgcaacggcatgatcatcgcccccggcccccaggccatcctgctgccccagcccctgaagtacctgggcctgcaggagaccatggccagcctgagcagctag

SEQ ID NO: 11221 - DNA, 2571 bp, Artificial Sequence; identical to SEQ ID NO: 9592
  Description of Artificial Sequence: Synthetic coding sequence

SEQ ID NO: 11222 - DNA, 2607 bp, Artificial Sequence
  Description of Artificial Sequence: Synthetic coding sequence
atggccagcttccccgagaccgacttccagatctgcctgctgtgcaaggagatgtgcggcagccccgcccccctgagcagcaacagcagcgccagcagcagcagcagccagaccagcaccagcagcggcggcggcggcggcggccccggcgccgccgccagaagactgcacgtgctgccctgcctgcacgccttctgcagaccctgcctggaggcccacagactgcccgccgccggcggcggcgccgccggcgagcccctgaagctgagatgccccgtgtgcgaccagaaggtggtgctggccgaggccgccggcatggacgccctgcccagcagcgccttcctgctgagcaacctgctggacgccgtggtggccaccgccgacgagcccccccccaagaacggcagagccggcgcccccgccggcgccggcggccacagcaaccacagacaccacgcccaccacgcccaccccagagccagcgccagcgccccccccctgccccaggccccccagccccccgcccccagcagaagcgcccccggcggccccgccgccagccccagcgccctgctgctgagaagaccccacggctgcagcagctgcgacgagggcaacgccgccagcagcagatgcctggactgccaggagcacctgtgcgacaactgcgtgagagcccaccagagagtgagactgaccaaggaccactacatcgagagaggcccccccggccccggcgccgccgccgccgcccagcagctgggcctgggcccccccttccccggcccccccttcagcatcctgagcgtgttccccgagagactgggcttctgccagcaccacgacgacgaggtgctgcacctgtactgcgacacctgcagcgtgcccatctgcagagagtgcaccatgggcagacacggcggccacagcttcatctacctgcaggaggccctgcaggacagcagagccctgaccatccagctgctggccgacgcccagcagggcagacaggccatccagctgagcatcgagcaggcccagaccgtggccgagcaggtggagatgaaggccaaggtggtgcagagcgaggtgaaggccgtgaccgccagacacaagaaggccctggaggagagagagtgcgagctgctgtggaaggtggagaagatcagacaggtgaaggccaagagcctgtacctgcaggtggagaagctgagacagaacctgaacaagctggagagcaccatcagcgccgtgcagcaggtgctggaggagggcagagccctggacatcctgctggccagagacagaatgctggcccaggtgcaggagctgaagaccgtgagaagcctgctgcagccccaggaggacgacagagtgatgttcaccccccccgaccaggccctgtacctggccatcaagagcttcggcttcgtgagcagcggcgccttcgcccccctgaccaaggccaccggcgacggcctgaagagagccctgcagggcaaggtggccagcttcaccgtgatcggctacgaccacgacggcgagcccagactgagcggcggcgacctgatgagcgccgtggtgctgggccccgacggcaacctgttcggcgccgaggtgagcgaccagcagaacggcacctacgtggtgagctacagaccccagctggagggcgagcacctggtgagcgtgaccctgtgcaaccagcacatcgagaacagccccttcaaggtggtggtgaagagcggcagaagctacgtgggcatcggcctgcccggcctgagcttcggcagcgagggcgacagcgacggcaagctgtgcagaccctggggcgtgagcgtggacaaggagggctacatcatcgtggccgacagaagcaacaacagaatccaggtgttcaagccctgcggcgccttccaccacaagttcggcaccctgggcagcagacccggccagttcgacagacccgccggcgtggcctgcgacgccagcagaagaatcgtggtggccgacaaggacaaccacagaatccagatcttcaccttcgagggccagttcctgctgaagttcggcgagaagggcaccaagaacggccagttcaactacccctgggacgtggccgtgaacagcgagggcaagatcctggtgagcgacaccagaaaccacagaatccagctgttcggccccgacggcgtgttcctgaacaagtacggcttcgagggcgccctgtggaagcacttcgacagccccagaggcgtggccttcaaccacgagggccacctggtggtgaccgacttcaacaaccacagactgctggtgatccaccccgactgccagagcgccagattcctgggcagcgagggcaccggcaacggccagttcctgagaccccagggcgtggccgtggaccaggagggcagaatcatcgtggccgacagcagaaaccacagagtgcagatgttcgagagcaacggcagcttcctgtgcaagttcggcgcccagggcagcggcttcggccagatggacagacccagcggcatcgccatcacccccgacggcatgatcgtggtggtggacttcggcaacaacagaatcctggtgttctag

SEQ ID NO: 11223 - DNA, 1107 bp, Artificial Sequence
  Description of Artificial Sequence: Synthetic coding sequence
atgagagagcccgtgctgacctggtgcgtgcccctggagctgctgtgcagccaccccctgcccctgagcgccttcctgaagagccaggtgaagctgtacacctacagagcctgcgccggcaaggacgagatgggcaagatggtgagcgtgatcaacaccgtggacaccagccacgaggacatgatccacgacgcccagatggactactacggcaccagactggccacctgcagcagcgacagaagcgtgaagatcttcgacgtgagaaacggcggccagatcctgatcgccgacctgagaggccacgagggccccgtgtggcaggtggcctgggcccaccccatgtacggcaacatcctggccagctgcagctacgacagaaaggtgatcatctggagagaggagaacggcacctgggagaagagccacgagcacgccggccacgacagcagcgtgaacagcgtgtgctgggccccccacgactacggcctgatcctggcctgcggcagcagcgacggcgccatcagcctgctgacctacaccggcgagggccagtgggaggtgaagaagatcaacaacgcccacaccatcggctgcaacgccgtgagctgggcccccgccgtggtgcccggcagcctgatcgaccaccccagcggccagaagcccaactacatcaagagattcgccagcggcggctgcgacaacctgatcaagctgtggaaggaggaggaggacggccagtggaaggaggagcagaagctggaggcccacagcgactgggtgagagacgtggcctgggcccccagcatcggcctgcccaccagcaccatcgccagctgcagccaggacggcagagtgttcatctggacctgcgacgacgccagcagcaacacctggagccccaagctgctgcacaagttcaacgacgtggtgtggcacgtgagctggagcatcaccgccaacatcctggccgtgagcggcggcgacaacaaggtgaccctgtggaaggagagcgtggacggccagtgggtgtgcatcagcgacgtgaacaagggccagggcagcgtgagcgccagcgtgaccgagggccagcagaacgagcagtag

SEQ ID NO: 11224 - DNA, 1059 bp, Artificial Sequence
  Description of Artificial Sequence: Synthetic coding sequence
atggacatcgacaaggacctggaggcccccctgtacctgacccccgagggctggagcctgttcctgcagagatactaccaggtggtgcacgagggcgccgagctgagacacctggacacccaggtgcagagatgcgaggacatcctgcagcagctgcaggccgtggtgccccagatcgacatggagggcgacagaaacatctggatcgtgaagcccggcgccaagagcagaggcagaggcatcatgtgcatggaccacctggaggagatgctgaagctggtgaacggcaaccccgtggtgatgaaggacggcaagtgggtggtgcagaagtacatcgagagacccctgctgatcttcggcaccaagttcgacctgagacagtggttcctggtgaccgactggaaccccctgaccgtgtggttctacagagacagctacatcagattcagcacccagcccttcagcctgaagaacctggacaacagcgtgcacctgtgcaacaacagcatccagaagcacctggagaacagctgccacagacaccccctgctgccccccgacaacatgtggagcagccagagattccaggcccacctgcaggagatgggcgcccccaacgcctggagcaccatcatcgtgcccggcatgaaggacgccgtgatccacgccctgcagaccagccaggacaccgtgcagtgcagaaaggccagcttcgagctgtacggcgccgacttcgtgttcggcgaggacttccagccctggctgatcgagatcaacgccagccccaccatggcccccagcaccgccgtgaccgccagactgtgcgccggcgtgcaggccgacaccctgagagtggtgatcgacagaatgctggacagaaactgcgacaccggcgccttcgagctgatctacaagcagcccgtgaccaccagccccgccagcacccccagacccagctgcctgctgcccatgtacagcgacaccagagccagaagcagcgacgacagcaccgccagctggtgggccctgagaccctgcagaccccaggccagaccctag

SEQ ID NO: 11225 - DNA, 579 bp, Artificial Sequence
  Description of Artificial Sequence: Synthetic coding sequence
atgggcaagggctgcaaggtggtggtgtgcggcctgctgagcgtgggcaagaccgccatcctggagcagctgctgtacggcaaccacaccatcggcatggaggactgcgagaccatggaggacgtgtacatggccagcgtggagaccgacagaggcgtgaaggagcagctgcacctgtacgacaccagaggcctgcaggagggcgtggagctgcccaagcactacttcagcttcgccgacggcttcgtgctggtgtacagcgtgaacaacctggagagcttccagagagtggagctgctgaagaaggagatcgacaagttcaaggacaagaaggaggtggccatcgtggtgctgggcaacaagatcgacctgagcgagcagagacaggtggacgccgaggtggcccagcagtgggccaagagcgagaaggtgagactgtgggaggtgaccgtgaccgacagaaagaccctgatcgagcccttcaccctgctggccagcaagctgagccagccccagagcaagagcagcttccccctgcccggcagaaagaacaagggcaacagcaacagcgagaactag

SEQ ID NO: 11226 - DNA, 1419 bp, Artificial Sequence
  Description of Artificial Sequence: Synthetic coding sequence
atgagcagaagagtggtgagacagagcaagttcagacacgtgttcggccaggccgccaaggccgaccaggcctacgaggacatcagagtgagcaaggtgacctgggacagcagcttctgcgccgtgaaccccaagttcctggccatcatcgtggaggccggcggcggcggcgccttcatcgtgctgcccctggccaagaccggcagagtggacaagaactaccccctggtgaccggccacaccgcccccgtgctggacatcgactggtgcccccacaacgacaacgtgatcgccagcgccagcgacgacaccaccatcatggtgtggcagatccccgactacacccccatgagaaacatcaccgagcccatcatcaccctggagggccacagcaagagagtgggcatcctgagctggcaccccaccgccagaaacgtgctgctgagcgccggcggcgacaacgtgatcatcatctggaacgtgggcaccggcgaggtgctgctgagcctggacgacatgcaccccgacgtgatccacagcgtgtgctggaacagcaacggcagcctgctggccaccacctgcaaggacaagaccctgagaatcatcgaccccagaaagggccaggtggtggccgagagattcgccgcccacgagggcatgagacccatgagagccgtgttcaccagacagggccacatcttcaccaccggcttcaccagaatgagccagagagagctgggcctgtgggaccccaacaacttcgaggagcccgtggccctgcaggagatggacaccagcaacggcgtgctgctgcccttctacgaccccgacagcagcatcgtgtacctgtgcggcaagggcgacagcagcatcagatacttcgagatcaccgacgagccccccttcgtgcactacctgaacaccttcagcagcaaggagccccagagaggcatgggcttcatgcccaagagaggcctggacgtgagcaagtgcgagatcgccagattctacaagctgcacgagagaaagtgcgagcccatcatcatgaccgtgcccagaaagagcgacctgttccaggacgacctgtaccccgacacccccggccccgagcccgccctggaggccgacgagtggctgagcggccaggacgccgagcccgtgctgatcagcctgagagacggctacgtgccccccaagcacagagagctgagagtgaccaagagaaacatcctggacgtgagaccccccagcggccccagaagaagccagagcgccagcgacgcccccctgagccagcagcacaccctggagaccctgctggaggagatcaaggccctgagagagagagtgcaggcccaggagcagagaatcaccgccctggagaacatgctgtgcgagctggtggacggcaccgactag

SEQ ID NO: 11227 - DNA, 2628 bp, Artificial Sequence
  Description of Artificial Sequence: Synthetic coding sequence
atgggcgacagcgacgacgagtacgacagaagaagaagagacaagttcagaagagagagaagcgactacgacagaagcagagagagagacgagagaagaagaggcgacgactggaacgacagagagtgggacagaggcagagagagaagaagcagaggcgagtacagagactacgacagaaacagaagagagagattcagcccccccagacacgagctgagccccccccagaagagaatgagaagagactgggacgagcacagcagcgacccctaccacagcggctacgagatgccctacgccggcggcggcggcggccccacctacggccccccccagccctggggccaccccgacgtgcacatcatgcagcaccacgtgctgcccatccaggccagactgggcagcatcgccgagatcgacctgggcgtgcccccccccgtgatgaagaccttcaaggagttcctgctgagcctggacgacagcgtggacgagaccgaggccgtgaagagatacaacgactacaagctggacttcagaagacagcagatgcaggacttcttcctggcccacaaggacgaggagtggttcagaagcaagtaccaccccgacgaggtgggcaagagaagacaggaggccagaggcgccctgcagaacagactgagagtgttcctgagcctgatggagaccggctggttcgacaacctgctgctggacatcgacaaggccgacgccatcgtgaagatgctggacgccgccgtgatcaagatggagggcggcaccgagaacgacctgagaatcctggagcaggaggaggaggaggagcaggccggcaagcccggcgagcccagcaagaaggaggagggcagagccggcgccggcctgggcgacggcgagagaaagaccaacgacaaggacgagaagaaggaggacggcaagcaggccgagaacgacagcagcaacgacgacaagaccaagaagagcgagggcgacggcgacaaggaggagaagaaggaggacagcgagaaggaggccaagaagagcagcaagaagagaaacagaaagcacagcggcgacgacagcttcgacgagggcagcgtgagcgagagcgagagcgagagcgagagcggccaggccgaggaggagaaggaggaggccgaggccctgaaggagaaggagaagcccaaggaggaggagtgggagaagcccaaggacgccgccggcctggagtgcaagcccagacccctgcacaagacctgcagcctgttcatgagaaacatcgcccccaacatcagcagagccgagatcatcagcctgtgcaagagataccccggcttcatgagagtggccctgagcgagccccagcccgagagaagattcttcagaagaggctgggtgaccttcgacagaagcgtgaacatcaaggagatctgctggaacctgcagaacatcagactgagagagtgcgagctgagccccggcgtgaacagagacctgaccagaagagtgagaaacatcaacggcatcacccagcacaagcagatcgtgagaaacgacatcaagctggccgccaagctgatccacaccctggacgacagaacccagctgtgggccagcgagcccggcaccccccccctgcccaccagcctgcccagccagaaccccatcctgaagaacatcaccgactacctgatcgaggaggtgagcgccgaggaggaggagctgctgggcagcagcggcggcgccccccccgaggagccccccaaggagggcaaccccgccgagatcaacgtggagagagacgagaagctgatcaaggtgctggacaagctgctgctgtacctgagaatcgtgcacagcctggactactacaacacctgcgagtaccccaacgaggacgagatgcccaacagatgcggcatcatccacgtgagaggccccatgccccccaacagaatcagccacggcgaggtgctggagtggcagaagaccttcgaggagaagctgacccccctgctgagcgtgagagagagcctgagcgaggaggaggcccagaagatgggcagaaaggaccccgagcaggaggtggagaagttcgtgaccagcaacacccaggagctgggcaaggacaagtggctgtgccccctgagcggcaagaagttcaagggccccgagttcgtgagaaagcacatcttcaacaagcacgccgagaagatcgaggaggtgaagaaggaggtggccttcttcaacaacttcctgaccgacgccaagagacccgccctgcccgagatcaagcccgcccagccccccggccccgcccagatcctgccccccggcctgacccccggcctgccctacccccaccagaccccccagggcctgatgccctacggccagcccagaccccccatcctgggctacggcgccggcgccgtgagacccgccgtgcccaccggcggccccccctacccccacgccccctacggcgccggcagaggcaactacgacgccttcagaggccagggcggctaccccggcaagcccagaaacagaatggtgagaggcgaccccagagccatcgtggagtacagagacctggacgcccccgacgacgtggacttcttctag

SEQ ID NO: 11228 - DNA, 816 bp, Artificial Sequence
  Description of Artificial Sequence: Synthetic coding sequence
atggccgccgtggagaagagaagacaggccgtgcccccccccgccggcttcaccgacagcggcagacagagcgtgagcagagccgccggcgccgccgagagcgaggaggacttcctgagacaggtgggcgtgaccgagatgctgagagccgccctgctgaaggtgctggaggccagacccgaggagcccatcgccttcctggcccactacttcgagaacatgggcctgagaagccccgtgaacggcggcgccggcgagccccccggccagctgctgctgcagcagcagagactgggcagagccctgtggcacctgagactggcccaccacagccagagagccgccttcaacaacaacgtgagcgtggcctacgagtgcctgagcgccggcggcagaagaaagagacccggcctggacggcagaacctacagcgagctgctgagaagaatctgcagagacggccaggcccccgaggaggtggtggcccccctgctgagaaaggtgcagtgcagagaccacgaggccgtgcccctgagcgtgttcagagccggcaccctgacctgcttcgtgctgctggagttcgtggccagagccggcgccctgttccagctgctggaggacagcgccgccgccgtggccgacagaagagtgggccaggccgtgctggacaccctggagggcgccctgcaggccagcgacgccgccgcccccgccagattcctggaggccggcagcagactggcccccatgaccagagaggagttcctggagagagccgccgccctgttcatcgccaaggtgaagcccgtgggctag

SEQ ID NO: 11229 - DNA, 1977 bp, Artificial Sequence
  Description of Artificial Sequence: Synthetic coding sequence
atgggcggccacctgagcccctggcccacctacaccagcggccagaccatcctgcagaacagaaagccctgcagcgacgactacagaaagagagtgggcagctgccagcagcaccccttcagaaccgccaagccccagtacctggaggagctggagaactacctgagaaaggagctgctgctgctggacctgggcaccgacagcacccaggagctgagactgcagccctacagagagatcttcgagttcttcatcgaggacttcaagacctacaagcccctgctgagcagcatcaagaacgcctacgagggcatgctggcccaccagagagagaagatcagagccctggagcccctgaaggccaagctggtgaccgtgaacgaggactgcaacgagagaatcctggccatgagagccgaggagaagtacgagatcagcctgctgaagaaggagaagatgaacctgctgaagctgatcgacaagaagaacgaggagaagatcagcctgcagagcgaggtgaccaagctgagaaagaacctggccgaggagtacctgcactacctgagcgagagagacgcctgcaagatcctgatcgccgacctgaacgagctgagataccagagagaggacatgagcctggcccagagccccggcatctggggcgaggaccccgtgaagctgaccctggccctgaagatgaccagacaggacctgaccagaacccagatggagctgaacaacatgaaggccaacttcggcgacgtggtgcccagaagagacttcgagatgcaggagaagaccaacaaggacctgcaggagcagctggacaccctgagagccagctacgaggaggtgagaaaggagcacgagatcctgatgcagctgcacatgagcaccctgaaggagagagaccagttcttcagcgagctgcaggagatccagagaaccagcacccccagacccgactggaccaagtgcaaggacgtggtggccggcggccccgagagatggcagatgctggccgagggcaagaacagcgaccagctggtggacgtgctgctggaggagatcggcagcggcctgctgagagagaaggacttcttccccggcctgggctacggcgaggccatccccgccttcctgagattcgacggcctggtggagaacaagaagcccagcaagaaggacgtggtgaacctgctgaaggacgcctggaaggagagactggccgaggagcagaaggagaccttccccgacttcttcttcaacttcctggagcacagattcggccccagcgacgccatggcctgggcctacaccatcttcgagaacatcaagatcttccacagcaacgaggtgatgagccagttctacgccgtgctgatgggcaagagaagcgagaacgtgtacgtgacccagaaggagaccgtggcccagctgctgaaggagatgaccaacgccgacagccagaacgagggcctgctgaccatggagcagttcaacaccgtgctgaagagcaccttccccctgaagaccgaggagcagatccaggagctgatggaggccggcggctggcaccccagcagcagcaacgccgacctgctgaactacagaagcctgttcatggaggacgaggagggccagagcgagcccttcgtgcagaagctgtgggagcagtacatggacgagaaggacgagtacctgcagcagctgaagcaggagctgggcatcgagctgcacgaggaggtgaccctgcccaagctgagaggcggcctgatgaccatcgaccccagcctggacaagcagaccgtgaacacctacatgagccaggccttccagctgcccgagagcgagatgcccgaggagggcgacgagaaggaggaggccgtggtggagatcctgcagaccgccctggagagactgcaggtgatcgacatcagaagagtgggccccagagagcccgagcccgccagctag

SEQ ID NO: 11230 - DNA, 1287 bp, Artificial Sequence
  Description of Artificial Sequence: Synthetic coding sequence
atggagcccctgaaggtggagaagttcgccaccgccaagagaggcaacggcctgagagccgtgacccccctgagacccggcgagctgctgttcagaagcgaccccctggcctacaccgtgtgcaagggcagcagaggcgtggtgtgcgacagatgcctgctgggcaaggagaagctgatgagatgcagccagtgcagagtggccaagtactgcagcgccaagtgccagaagaaggcctggcccgaccacaagagagagtgcaagtgcctgaagagctgcaagcccagatacccccccgacagcgtgagactgctgggcagagtggtgttcaagctgatggacggcgcccccagcgagagcgagaagctgtacagcttctacgacctggagagcaacatcaacaagctgaccgaggacaagaaggagggcctgagacagctggtgatgaccttccagcacttcatgagagaggagatccaggacgccagccagctgccccccgccttcgacctgttcgaggccttcgccaaggtgatctgcaacagcttcaccatctgcaacgccgagatgcaggaggtgggcgtgggcctgtaccccagcatcagcctgctgaaccacagctgcgaccccaactgcagcatcgtgttcaacggcccccacctgctgctgagagccgtgagagacatcgaggtgggcgaggagctgaccatctgctacctggacatgctgatgaccagcgaggagagaagaaagcagctgagagaccagtactgcttcgagtgcgactgcttcagatgccagacccaggacaaggacgccgacatgctgaccggcgacgagcaggtgtggaaggaggtgcaggagagcctgaagaagatcgaggagctgaaggcccactggaagtgggagcaggtgctggccatgtgccaggccatcatcagcagcaacagcgagagactgcccgacatcaacatctaccagctgaaggtgctggactgcgccatggacgcctgcatcaacctgggcctgctggaggaggccctgttctacggcaccagaaccatggagccctacagaatcttcttccccggcagccaccccgtgagaggcgtgcaggtgatgaaggtgggcaagctgcagctgcaccagggcatgttcccccaggccatgaagaacctgagactggccttcgacatcatgagagtgacccacggcagagagcacagcctgatcgaggacctgatcctgctgctggaggagtgcgacgccaacatcagagccagctag

SEQ ID NO: 11231 - DNA, 1122 bp, Artificial Sequence
  Description of Artificial Sequence: Synthetic coding sequence
atgagcagcggcaactaccagcagagcgaggccctgagcaagcccaccttcagcgaggagcaggccagcgccctggtggagagcgtgttcggcctgaaggtgagcaaggtgagacccctgcccagctacgacgaccagaacttccacgtgtacgtgagcaagaccaaggacggccccaccgagtacgtgctgaagatcagcaacaccaaggccagcaagaaccccgacctgatcgaggtgcagaaccacatcatcatgttcctgaaggccgccggcttccccaccgccagcgtgtgccacaccaagggcgacaacaccgccagcctggtgagcgtggacagcggcagcgagatcaagagctacctggtgagactgctgacctacctgcccggcagacccatcgccgagctgcccgtgagcccccagctgctgtacgagatcggcaagctggccgccaagctggacaagaccctgcagagattccaccaccccaagctgagcagcctgcacagagagaacttcatctggaacctgaagaacgtgcccctgctggagaagtacctgtacgccctgggccagaacagaaacagagagatcgtggagcacgtgatccacctgttcaaggaggaggtgatgaccaagctgagccacttcagagagtgcatcaaccacggcgacctgaacgaccacaacatcctgatcgagagcagcaagagcgccagcggcaacgccgagtaccaggtgagcggcatcctggacttcggcgacatgagctacggctactacgtgttcgaggtggccatcaccatcatgtacatgatgatcgagagcaagagccccatccaggtgggcggccacgtgctggccggcttcgagagcatcacccccctgaccgccgtggagaagggcgccctgttcctgctggtgtgcagcagattctgccagagcctggtgatggccgcctacagctgccagctgtaccccgagaacaaggactacctgatggtgaccgccaagaccggctggaagcacctgcagcagatgttcgacatgggccagaaggccgtggaggagatctggttcgagaccgccaagagctacgagagcggcatcagcatgtag

SEQ ID NO: 11232 - DNA, 2766 bp, Artificial Sequence
  Description of Artificial Sequence: Synthetic coding sequence
atggccctgctgtgcggcctgggccaggtgaccctgagaatctgggtgagcctgcccagccagagcgagaacggcatcggcagcggcggcatggaggccctgaccacccagctgggccccggcagagagggcagcagcagccccaacagcaagcaggagctgcagccctacagcggcagcagcgccctgaagcccaaccaggtgggcgagaccagcctgtacggcgtgcccatcgtgagcctggtgatcgacggccaggagagactgtgcctggcccagatcagcaacaccctgctgaagaactacagctacaacgagatccacaacagaagagtggccctgggcatcacctgcgtgcagtgcacccccgtgcagctggagatcctgagaagagccggcgccatgcccatcagcagcagaagatgcggcatgatcaccaagagagaggccgagagactgtgcaagagcttcctgggcgagcacaagccccccaagctgcccgagaacttcgccttcgacgtggtgcacgagtgcgcctggggcagcagaggcagcttcatccccgccagatacaacagcagcagagccaagtgcatcaagtgcggctactgcagcatgtacttcagccccaacaagttcatcttccacagccacagaacccccgacgccaagtacacccagcccgacgccgccaacttcaacagctggagaagacacctgaagctgagcgacaagagcgccaccgacgagctgagccacgcctgggaggacgtgaaggccatgttcaacggcggcaccagatgcggcgccgagatggcccccggcccccccccccacaagagcctgagatgcggcgaggacgaggccgccggcccccccggccccccccccccccacccccagagaggcctgggcctggccaccggcgccagcggccccgccggccccggcggccccggcggcggcgccggcgtgagaagctaccccgtgatccccgtgcccagcaagggcttcggcctgctgcagaagctgcccccccccctgttcccccacccctacggcttccccaccgccttcggcctgtgccccaagaaggacgaccccgtgctgggcgccggcgagcccaagggcggccccggcaccggcagcggcggcggcggcgccggcaccggcggcggcgccggcggccccggcgccagccacctgccccccggcgccggcgccggccccggcggcggcgccatgttctggggccaccagcccagcggcgccgccaaggacgccgccgccgtggccgccgccgccgccgccgccaccgtgtaccccaccttccccatgttctggcccgccgccggcagcctgcccgtgcccagctaccccgccgcccagagccaggccaaggccgtggccgccgccgtggccgccgccgccgccgccgccgccgccgccgccggcagcggcgcccccgagcccctggacggcgccgagcccgccaaggagagcggcctgggcgccgaggagagatgccccagcgccctgagcagaggccccctggacgaggacggcaccgacgaggccctgcccccccccctggcccccctgcccccccccccccccccccccgccagaaagggcagctacgtgagcgccttcagacccgtggtgaaggacaccgagagcatcgccaagctgtacggcagcgccagagaggcctacggcgccggccccgccagaggccccggccccggcgccggcagcggcggctacgtgagccccgacttcctgagcgagggcagcagcagctacaacagcgccagccccgacgtggacaccgccgacgagcccgaggtggacgtggagagcaacagattccccgacgacgaggacgcccaggaggagaccgagcccagcgcccccagcgccggcggcggccccgacggcgagcagcccaccggcccccccagcgccaccagcagcggcgccgacggccccgccaacagccccgacggcggcagccccagacccagaagaagactgggccccccccccgccggcagacccgccttcggcgacctggccgccgaggacctggtgagaagacccgagagaagcccccccagcggcggcggcggctacgagctgagagagccctgcggccccctgggcggccccgcccccgccaaggtgttcgcccccgagagagacgagcacgtgaagagcgccgccgtggccctgggccccgccgccagctacgtgtgcacccccgaggcccacgagcccgacaaggaggacaaccacagccccgccgacgacctggagaccagaaagagctaccccgaccagagaagcatcagccagcccagccccgccaacaccgacagaggcgaggacggcctgaccctggacgtgaccggcacccacctggtggagaaggacatcgagaacctggccagagaggagctgcagaagctgctgctggagcagatggagctgagaaagaagctggagagagagttccagagcctgaaggacaacttccaggaccagatgaagagagagctggcctacagagaggagatggtgcagcagctgcagatcgtgagagacaccctgtgcaacgagctggaccaggagagaaaggccagatacgccatccagcagaagctgaaggaggcccacgacgccctgcaccacttcagctgcaagatgctgacccccagacactgcaccggcaactgcagcttcaagccccccctgctgccctag

SEQ ID NO: 11233 - DNA, 1395 bp, Artificial Sequence
  Description of Artificial Sequence: Synthetic coding sequence
atggccatgaccgccggcaccaccaccaccttccccatgagcaaccacaccagagagagagtgaccgtggccaagctgaccctggagaacttctacagcaacctgatcctgcagcacgaggagagagagaccagacagaagaagctggaggtggccatggaggaggagggcctggccgacgaggagaagaagctgagaagaagccagcacgccagaaaggagaccgagttcctgagactgaagagaaccagactgggcctggacgacttcgagagcctgaaggtgatcggcagaggcgccttcggcgaggtgagactggtgcagaagaaggacaccggccacatctacgccatgaagatcctgagaaagagcgacatgctggagaaggagcaggtggcccacatcagagccgagagagacatcctggtggaggccgacggcgcctgggtggtgaagatgttctacagcttccaggacaagagaaacctgtacctgatcatggagttcctgcccggcggcgacatgatgaccctgctgatgaagaaggacaccctgaccgaggaggagacccagttctacatcagcgagaccgtgctggccatcgacgccatccaccagctgggcttcatccacagagacatcaagcccgacaacctgctgctggacgccaagggccacgtgaagctgagcgacttcggcctgtgcaccggcctgaagaaggcccacagaaccgagttctacagaaacctgacccacaacccccccagcgacttcagcttccagaacatgaacagcaagagaaaggccgagacctggaagaagaacagaagacagctggcctacagcaccgtgggcacccccgactacatcgcccccgaggtgttcatgcagaccggctacaacaagctgtgcgactggtggagcctgggcgtgatcatgtacgagatgctgatcggctacccccccttctgcagcgagaccccccaggagacctacagaaaggtgatgaactggaaggagaccctggtgttcccccccgaggtgcccatcagcgagaaggccaaggacctgatcctgagattctgcatcgacagcgagaacagaatcggcaacagcggcgtggaggagatcaagggccaccccttcttcgagggcgtggactgggagcacatcagagagagacccgccgccatccccatcgagatcaagagcatcgacgacaccagcaacttcgacgacttccccgagagcgacatcctgcagcccgtgcccaacaccaccgagcccgactacaagagcaaggactgggtgttcctgaactacacctacaagagattcgagggcctgacccagagaggcagcatccccacctacatgaaggccggcaagctgtag

SEQ ID NO: 11234 - DNA, 3951 bp, Artificial Sequence
  Description of Artificial Sequence: Synthetic coding sequence
atggccagcaagggcgccggcatgagcttcagcagaaagagctacagactgaccagcgacgccgagaagagcagagtgaccggcatcgtgcaggagaagctgctgaacgactacctgaacagaatcttcagcagcagcgagcacgccccccccgccgccaccagcagaaagcccctgaacttccagaacctgcccgagcacctggaccagctgctgcaggtggacaacgaggaggaggagagccagggccaggtggagggcagactgggccccagcaccgtggtgctggaccacaccggcggcttcgagggcctgctgctggtggacgacgacctgctgggcgtgatcggccacagcaacttcggcaccatcagaagcaccacctgcgtgtacaagggcaagtggctgtacgaggtgctgatcagcagccagggcctgatgcagatcggctggtgcaccatcagctgcagattcaaccaggaggagggcgtgggcgacacccacaacagctacgcctacgacggcaacagagtgagaaagtggaacgtgaccaccaccaactacggcaaggcctgggccgccggcgacatcgtgagctgcctgatcgacctggacgacggcaccctgagcttctgcctgaacggcgtgagcctgggcaccgccttcgagaacctgagcagaggcctgggcatggcctacttccccgccatcagcctgagcttcaaggagagcgtggccttcaacttcggcagcagacccctgagataccccgtggccggctacagacccctgcaggacccccccagcgccgacctggtgagagcccagagactgctgggctgcttcagagccgtgctgagcgtggagctggaccccgtggagggcagactgctggacaaggagagcagcaagtggagactgagaggccagcccaccgtgctgctgaccctggcccacatcttccaccacttcgcccccctgctgagaaaggtgtacctggtggaggccgtgctgatgagcttcctgctgggcatcgtggagaagggcacccccacccaggcccagagcgtggtgcaccaggtgctggacctgctgtggctgttcatggaggactacgaggtgcaggactgcctgaagcagctgatgatgagcctgctgagactgtacagattcagccccatcgtgcccgacctgggcctgcagatccactacctgagactgaccatcgccatcctgagacacgagaagagcagaaagttcctgctgagcaacgtgctgttcgacgtgctgagaagcgtggtgttcttctacatcaagagccccctgagagtggaggaggccggcctgcaggagctgatccccaccacctggtggccccactgcagcagcagagagggcaaggagagcaccgagatgaaggaggagaccgccgaggagagactgagaagaagagcctacgagagaggctgccagagactgagaaagagaatcgaggtggtggaggagctgcaggtgcagatcctgaagctgctgctggacaacaaggacgacaacggcggcgaggccagcagatacatcttcctgaccaagttcagaaagttcctgcaggagaacgccagcggcagaggcaacatgcccatgctgtgcccccccgagtacatggtgtgcttcctgcacagactgatcagcgccctgagatactactgggacgagtacaaggccagcaacccccacgccagcttcagcgaggaggcctacatccccccccaggtgttctacaacggcaaggtggactacttcgacctgcagagactgggcggcctgctgagccacctgagaaagaccctgaaggacgacctggccagcaaggccaacatcgtgatcgaccccctggagctgcagagcaccgccatggacgacctggacgaggacgaggagcccgcccccgccatggcccagagacccatgcaggccctggccgtgggcggccccctgcccctgcccagacccggctggctgagcagccccaccctgggcagagccaacagattcctgagcaccgccgccgtgagcctgatgacccccagaagacccctgagcaccagcgagaaggtgaaggtgagaaccctgagcgtggagcagagaaccagagaggacatcgagggcagccactggaacgagggcctgctgctgggcagaccccccgaggagcccgagcagcccctgaccgagaacagcctgctggaggtgctggacggcgccgtgatgatgtacaacctgagcgtgcaccagcagctgggcaagatggtgggcgtgagcgacgacgtgaacgagtacgccatggccctgagagacaccgaggacaagctgagaagatgccccaagagaagaaaggacatcctggccgagctgaccaagagccagaaggtgttcagcgagaagctggaccacctgagcagaagactggcctgggtgcacgccaccgtgtacagccaggagaagatgctggacatctactggctgctgagagtgtgcctgagaaccatcgagcacggcgacagaaccggcagcctgttcgccttcatgcccgagttctacctgagcgtggccatcaacagctacagcgccctgaagaactacttcggccccgtgcacagcatggaggagctgcccggctacgaggagaccctgaccagactggccgccatcctggccaagcacttcgccgacgccagaatcgtgggcaccgacatcagagacagcctgatgcaggccctggccagctacgtgtgctacccccacagcctgagagccgtggagagaatccccgaggagcagagaatcgccatggtgagaaacctgctggccccctacgagcagagaccctgggcccagaccaactggatcctggtgagactgtggagaggctgcggcttcggctacagatacaccagactgccccacctgctgaagaccaagctggaggacgccaacctgcccagcctgcagaagccctgccccagcaccctgctgcagcagcacatggccgacctgctgcagcagggccccgacgtggcccccagcttcctgaacagcgtgctgaaccagctgaactgggccttcagcgagttcatcggcatgatccaggagatccagcaggccgccgagagactggagagaaacttcgtggacagcagacagctgaaggtgtgcgccacctgcttcgacctgagcgtgagcctgctgagagtgctggagatgaccatcaccctggtgcccgagatcttcctggactggaccagacccaccagcgagatgctgctgagaagactggcccagctgctgaaccaggtgctgaacagagtgaccgccgagagaaacctgttcgacagagtggtgaccctgagactgcccggcctggagagcgtggaccactaccccatcctggtggccgtgaccggcatcctggtgcagctgctggtgagaggccccgccagcgagagagagcaggccaccagcgtgctgctggccgacccctgcttccagctgagaagcatctgctacctgctgggccagcccgagccccccgcccccggcaccgccctgcccgcccccgacagaaagagattcagcctgcagagctacgccgactacatcagcgccgacgagctggcccaggtggagcagatgctggcccacctgaccagcgccagcgcccaggccgccgccgccagcctgcccaccagcgaggaggacctgtgccccatctgctacgcccaccccatcagcgccgtgttccagccctgcggccacaagagctgcaaggcctgcatcaaccagcacctgatgaacaacaaggactgcttcttctgcaagaccaccaccagcaacctgctggcctgcctgtacccccactggtgggagcccagccacggccccaactgcgcctag

SEQ ID NO: 11235 - DNA, 2043 bp, Artificial Sequence
  Description of Artificial Sequence: Synthetic coding sequence
atgcccagcgtgagcaaggccgccgccgccgccctgagcggcagccccccccagaccgagaagcccacccactacagatacctgaaggagttcagaaccgagcagtgccccctgttcagccagcacaagtgcgcccagcacagacccttcacctgcttccactggcacttcctgaaccagagaagaagaagacccctgagaagaagagacggcaccttcaactacagccccgacgtgtactgcagcaagtacaacgaggccaccggcgtgtgccccgacggcgacgagtgcccctacctgcacagaaccaccggcgacaccgagagaaagtaccacctgagatactacaagaccggcacctgcatccacgagaccgacgccagaggccactgcgtgaagaacggcctgcactgcgccttcgcccacggccccctggacctgagaccccccgtgtgcgacgtgagagagctgcaggcccaggaggccctgcagaacggccagctgggcggcggcgagggcgtgcccgacctgcagcccggcgtgctggccagccaggccatgatcgagaagatcctgagcgaggaccccagatggcaggacgccaacttcgtgctgggcagctacaagaccgagcagtgccccaagccccccagactgtgcagacagggctacgcctgcccccactaccacaacagcagagacagaagaagaaaccccagaagattccagtacagaagcaccccctgccccagcgtgaagcacggcgacgagtggggcgagcccagcagatgcgacggcggcgacggctgccagtactgccacagcagaaccgagcagcagttccaccccgagagcaccaagtgcaacgacatgagacagaccggctactgccccagaggccccttctgcgccttcgcccacgtggagaagagcctgggcatggtgaacgagtggggctgccacgacctgcacctgaccagccccagcagcaccggcagcggccagcccggcaacgccaagagaagagacagccccgccgagggcggccccagaggcagcgagcaggacagcaagcagaaccacctggccgtgttcgccgccgtgcacccccccgcccccagcgtgagcagcagcgtggccagcagcctggccagcagcgccggcagcggcagcagcagccccaccgccctgcccgccccccccgccagagccctgcccctgggccccgccagcagcaccgtggaggccgtgctgggcagcgccctggacctgcacctgagcaacgtgaacatcgccagcctggagaaggacctggaggagcaggacggccacgacctgggcgccgccggccccagaagcctggccggcagcgcccccgtggccatccccggcagcctgcccagagcccccagcctgcacagccccagcagcgccagcaccagccccctgggcagcctgagccagcccctgcccggccccgtgggcagcagcgccatgacccccccccagcagcccccccccctgagaagcgagcccggcaccctgggcagcgccgccagcagctacagccccctgggcctgaacggcgtgcccggcagcatctgggacttcgtgagcggcagcttcagccccagccccagccccatcctgagcgccggcccccccagcagcagcagcgccagccccaacggcgccgagctggccagagtgagaagacagctggacgaggccaagagaaagatcagacagtgggaggagagctggcagcaggtgaagcaggtgtgcgacgcctggcagagagaggcccaggaggccaaggagagagccagagtggccgacagcgacagacagctggccctgcagaagaaggaggaggtggaggcccaggtgatcttccagctgagagccaagcagtgcgtggcctgcagagagagagcccacggcgccgtgctgagaccctgccagcaccacatcctgtgcgagccctgcgccgccaccgcccccgagtgcccctactgcaagggccagcccctgcagtggtag

SEQ ID NO: 11236 - DNA, 462 bp, Artificial Sequence
  Description of Artificial Sequence: Synthetic coding sequence
atgagcagccccctggccagcctgagcaagaccagaaaggtgcccctgcccagcgagcccatgaaccccggcagaagaggcatcagaatctacggcgacgtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagccctag

SEQ ID NO: 11237 - DNA, 2382 bp, Artificial Sequence
  Description of Artificial Sequence: Synthetic coding sequence
atgggccagtgctacaacctggaggacgacgacctggagaccgacgtgaacaagctgagcagcaagcccggcctggacagacccgaggaggagctgatgcagtacgaggtgatgtgcctggagctgagctacagcttcgaggagctgcagagcaagctgggcgacgacctgaacagcgagaagacccagtacgccaaccaccaccacatccccgccgccgccagcagcaagcagcactgctacagcaaggaccagagcagctgcggccaggagagagagtacgccgtgcagaccagcctgctgtgcagagtgaagaccggcagaagcaccgtgcacctgggcagcaagaagaaccccggcgtgaacctgtaccagaacgtgcagagcaacagcctgagaagagacagcagcgagagcgagatccccgacatccaggccagccccaaggccgacgcctgggacgtggacgccatcttctgccccagaatgagcgccagcttcagcaacagcaccagaaccagagaggtggtgaaggtgatcgacaagctgctgcagacccacctgaagagagtgcccttccacgacccctacctgtacatggccaaggccagaagaaccagcagcgtggtggacttcaagatgatggccttccccgacgtgtggggccactgccccccccccaccacccagcccatgctggagagaaagtgcggcgtgcagagaatcagaatcttcgaggacatcagaagactgatccagcccagcgacgtgatcaacaaggtggtgttcagcctggacgagccctggcccctgcaggacaacgccagcaactgcctgagattcttcagcaagttcgagagcggcaacctgagaaaggccatccaggtgagagagttcgagtacgacctgctggtgaacgccgacgtgaacagcacccagcaccagcagtggttctacttcaaggtgagcggcatgcaggccgccatcccctaccacttcaacatcatcaactgcgagaagcccaacagccagttcaactacggcatgcagcccaccctgtacagcgtgaaggaggccctgctgggcaagcccacctggatcagaaccggccacgagatctgctactacaagaaccactacagacagagcaccgccgtggccggcggcgccagcggcaagtgctactacaccctgaccttcgccgtgaccttcccccacagcgaggacgtgtgctacctggcctaccactacccctacacctacaccgccctgatgacccacctggacatcctggagaagagcgtgaacctgaaggaggtgtacttcagacaggacgtgctgtgccagaccctgggcggcaacccctgccccctggtgaccatcaccgccatgcccgagagcaacagcgacgagcacctggagcagttcagacacagaccctaccaggtgatcaccgccagagtgcaccccggcgagagcaacgccagctgggtgatgaagggcaccctggagttcctggtgagcagcgaccccgtggccagactgctgagagagaacttcatcttcaagatcatccccatgctgaaccccgacggcgtgatcaacggcaaccacagatgcagcctgagcggcgaggacctgaacagacagtggctgagccccagcgcccacctgcagcccaccatctaccacgccaagggcctgctgtaccacctgagcagcatcggcagaagccccgtggtgttctgcgacttccacggccacagccagaagaagaacgtgttcctgtacggctgcagcatcaaggagaccctgtggcaggccgcctgcaccgtgggcaccagcaccatcctggaggaggtgaactacagaaccctgcccaagatcctggacaagctggcccccgccttcaccatgagcagctgcagcttcctggtggagaagagcagagccagcaccgccagagtggtggtgtggagagagatgggcgtgagcagaagctacaccatggagagcagctactgcggctgcaaccagggcccctaccagtgcacccagagactgctggagagaaccaagaacgagagagcccaccccgtggacggcctgcagggcctgcagttcggcaccagagagctggaggagatgggcgccatgttctgcctgggcctgctgatcctggagctgaagagcgccagctgcagccaccagctgctggcccaggccgccaccctgctgagcgccgaggaggacgccctggaccagcacctgcagagactgaagagcagcaacttcctgcccaagcacatctggttcgcctaccacttcttcgccatcaccaacttcttcaagatgaacctgctgctgcacgtgagcccctag

SEQ ID NO: 11238 - DNA, 153 bp, Artificial Sequence
  Description of Artificial Sequence: Synthetic coding sequence
atgatgcagaacgtgcacctggcccccgagaccgacgaggacgacctgtacagcggctacaacgactacaaccccatctacgacatcgaggagctggagaacgacgccgccttccagcaggccgtgagaaccagccacggcagaagaccctag

SEQ ID NO: 11239 - DNA, 1299 bp, Artificial Sequence
  Description of Artificial Sequence: Synthetic coding sequence
atgaccgccgtgagagccgccggcttcaccaaggccgccctgagaggcagcgccttcgaccccctgagccagagcagaggccccgccagccccctggaggccaagaagaaggacagccccgaggagaagatcaagcagctggagaaggaggtgaacgagctggtggaggagagctgcatcgccaacagctgcggcgacctgaagctggccctggagaaggccaaggacgccggcagaaaggagagagtgctggtgagacagagagagcaggtgaccacccccgagaacatcaacctggacctgacctacagcgtgctgttcaacctggccagccagtacagcgtgaacgagatgtacgccgaggccctgaacacctaccaggtgatcgtgaagaacaagatgttcagcaacgccggcatcctgaagatgaacatgggcaacatctacctgaagcagagaaactacagcaaggccatcaagttctacagaatggccctggaccaggtgcccagcgtgaacaagcagatgagaatcaagatcatgcagaacatcggcgtgaccttcatccaggccgacagagagaagatgaagaaggccttccagaagctgatcaccgtgcccctggagatcgacgaggacaagtacatcagccccagcgacgacccccacaccaacctggtgaccgaggccatcaagaacgaccacctgagacagatggagagagagagaaaggccatggccgagaagtacatcatgaccagcgccaagctgatcgcccccgtgatcgagaccagcttcgccgccggctacgactggtgcgtggaggtggtgaaggccagccagtacgtggagctggccaacgacctggagatcaacaaggccgtgacctacctgagacagaaggactacaaccaggccgtggagatcctgaaggtgctggagaagaaggacagcagagtgaagagcgccgccgccaccaacctgagcgccctgtactacatgggcaaggacttcgcccaggccagcagctacgccgacatcgccgtgaacagcgacagatacaaccccgccgccctgaccaacaagggcaacaccgtgttcgccaacggcgactacgagaaggccgccgagttctacaaggaggccctgagaaacgacagcagctgcaccgaggccctgtacaacatcggcctgacctacgagaagctgaacagactggacgaggccctggactgcttcctgaagctgcacgccatcctgagaaacagcgccgaggtgctgtaccagatcgccaactag

SEQ ID NO: 11240 - DNA, 387 bp, Artificial Sequence
  Description of Artificial Sequence: Synthetic coding sequence
atggccgccgccgccgccgagcagcagcagttctacctgctgctgggcaacctgctgagccccgacaacgtggtgagaaagcaggccgaggccagacagatggccgccgtgctgctgagaagactgctgagcagcgccttcgacgaggtgtaccccgccctgcccagcgacgtgcagaccgccatcaagagcgagctgctgatgatcatccagatggagacccagagcagcatgagaaagaaggtgtgcgacatcgccgccgagctggccagaaacctgatcgacgaggacggcaacaaccagtggcccgagggcctgaagttcctgttcgacagcgtgagcagccagaacgtgggcctgagagaggccgccctgcacatcttctag

SEQ ID NO: 11241 - DNA, 2766 bp, Artificial Sequence
  Description of Artificial Sequence: Synthetic coding sequence
atgagacccgagggcgccggcatggagctgggcggcggcgaggagagactgcccgaggagagcagaagagagcactggcagctgctgggcaacctgaagaccaccgtggagggcctggtgagcaccaacagccccaacgtgtggagcaagtacggcggcctggagagactgtgcagagacatgcagagcatcctgtaccacggcctgatcagagaccaggcctgcagaagacagaccgactactggcagttcgtgaaggacatcagatggctgagcccccacagcgccctgcacgtggagaagttcatcagcgtgcacgagaacgaccagagcagcgccgacggcgccagcgagagagccgtggccgagctgtggctgcagcacagcctgcagtaccactgcctgagcgcccagctgagacccctgctgggcgacagacagtacatcagaaagttctacaccgacgccgccttcctgctgagcgacgcccacgtgaccgccatgctgcagtgcctggaggccgtggagcagaacaaccccagactgctggcccagatcgacgccagcatgttcgccagaaagcacgagagccccctgctggtgaccaagagccagagcctgaccgccctgcccagcagcacctacaccccccccaacagctacgcccagcacagctacttcggcagcttcagcagcctgcaccagagcgtgcccaacaacggcagcgagagaagaagcaccagcttccccctgagcggcccccccagaaagccccaggagagcagaggccacgtgagccccgccgaggaccagaccatccaggccccccccgtgagcgtgagcgccctggccagagacagccccctgacccccaacgagatgagcagcagcaccctgaccagccccatcgaggccagctgggtgagcagccagaacgacagccccggcgacgccagcgagggccccgagtacctggccatcggcaacctggaccccagaggcagaaccgccagctgccagagccacagcagcaacgccgagagcagcagcagcaacctgttcagcagcagcagcagccagaagcccgacagcgccgccagcagcctgggcgaccaggagggcggcggcgagagccagctgagcagcgtgctgagaagaagcagcttcagcgagggccagaccctgaccgtgaccagcggcgccaagaagagccacatcagaagccacagcgacaccagcatcgccagcagaggcgcccccgagagctgcaacgacaaggccaagctgagaggccccctgccctacagcggccagagcagcgaggtgagcacccccagcagcctgtacatggagtacgagggcggcagatacctgtgcagcggcgagggcatgttcagaagacccagcgagggccagagcctgatcagctacctgagcgagcaggacttcggcagctgcgccgacctggagaaggagaacgcccacttcagcatcagcgagagcctgatcgccgccatcgagctgatgaagtgcaacatgatgagccagtgcctggaggaggaggaggtggaggaggaggacagcgacagagagatccaggagctgaagcagaagatcagactgagaagacagcagatcagaaccaagaacctgctgcccatgtaccaggaggccgagcacggcagcttcagagtgaccagcagcagcagccagttcagcagcagagacagcgcccagctgagcgacagcggcagcgccgacgaggtggacgagttcgagatccaggacggcagcgagggcagcaacctgacccacatcagcaagaacggcctgagcgtgagcctggccagcatgttcagcgacgccgacatcagaagaaacaccgccagcagcagcaagagcttcgtgagcagccagagcttcagccactgcttcctgcacagcaccagcgccgaggccgtggccatgggcctgctgaagcagttcgagggcatgcagctgcccgccgccagcgagctggagtggctggtgcccgagcacgacgccccccagaagctgctgcccatccccgacagcctgcccatcagccccgacgacggccagcacgccgacatctacaagctgagaatcagagtgagaggcaacctggagtgggccccccccagaccccagatcatcttcaacgtgcaccccgcccccaccagaaagatcgccgtggccaagcagaactacagatgcgccggctgcggcatcagaaccgaccccgactacatcaagagactgagatactgcgagtacctgggcaagtacttctgccagtgctgccacgagaacgcccagatggccatccccagcagagtgctgagaaagtgggacttcagcaagtactacgtgagcaacttcagcaaggacctgctgatcaagatctggaacgaccccctgttcaacgtgcaggacatcaacagcgccctgtacagaaaggtgaagctgctgaaccaggtgagactgctgagagtgcagctgtgccacatgaagaacatgttcaagacctgcagactggccaaggagctgctggacagcttcgacaccgtgcccggccacctgaccgaggacctgcacctgtacagcctgaacgacctgaccgccaccagaaagggcgagctgggccccagactggccgagctgaccagagccggcgccacccacgtggagagatgcatggtgagaaagagccactgcagcatgcagctgagcccctgcttctag

SEQ ID NO: 11242 - DNA, 1644 bp, Artificial Sequence
  Description of Artificial Sequence: Synthetic coding sequence
atgagagccctgaccgtgcagagagtgaagttcgccatggacctgcccctgctgaagagagccggccaggacctggccgagaagaccaagaacttcgtgagcagaagcctggtgatcggcgaggtgctgagcatggccgacatggccaccggcgtgaagtgcggcatcatctactggctgttcggcggcgccatcagaaacctgggcagccccgagcacgtgaccaagtggttccagcccctgcaggagcagaagtacaccggcatgttcgccatgaccgagagaggccacggcagcaacgccagaggcatccagaccgaggccaccttcgacctgagcgcccaggagttcgtgatcgacaccccctgcgagaacgccgagaagatgtacatcggcaacgccatgtacggcaactacgccgccgtgttcgcccagctgatcatcgacggcagaagccagggcccccactgcttcatcgtgcccgtgagagacgagaacggcagcctgtaccccggcgtgaccgccatcgacatgatgtacaaggagggcctgcacggcgtggacaacggcatcctgatcttcgacaaggtgagaatccccagagagaacctgctggacaagttcggcagcgtggcccccgacggccagtaccacagccccatcagaaacaagagcgccagattcaacgccatgctggccgccctgacccccagcagactggccgtggccttccaggccatgggcgccatgaagctgggcctgaccatcgccatcagatacagccacagcagaagacagttcggccccaagaccaaggaggaggtgaagatcatcgagcaccagacccagaccctgagactgatgccccacctggccaccgccctggccctgaccttcgtgagcagatacgccggcgccctgctggacgaggacgtgttccagggcaaggagctggtgaacagcagaagcctgcaggccctggtggccggcctgaaggcctacagcacctgggagaacatcagatgcctgcaggactgcagagagtgcaccggcggcatgggctacatgatggagaacagaatcagcggcctgaagtgcgacaccgacgtgttcgccaccttcgagggcgacgacgtggtgatgctgcaggtggtgggcagagagctgctggcccagtacaccaagcagtacgaggagaagcccctgttcggcctgctgcagaactgggccgagagcgtgggcgacaagctgagaaccagcttcctggccttcaacatggacaccgtggacgacctggccttcctgctgaaggccgtgaagttcagagagagagtgctgcagagaggcctggtggccagaatctactacaaggtgaagaccaagaaggaggacttcttccacgcctggaacagctgcctgcaccacgtggccagcctgagcctggcccacacccacagagtgaccctggagcagttcagcctggccgtgaagagctgccccgaccaggaggaccagaccctgctgatgaagttctgcctgctgtacggcaccaagctggtgttccaggagagagcctggtacctggagcacaagtacctgacccccatggccagcaccagaatcagaaaccaggagagatgctag

SEQ ID NO: 11243 - DNA, 6087 bp, Artificial Sequence
  Description of Artificial Sequence: Synthetic coding sequence
atggacgtgaccgtgagcgagctgctggagctgttcctgcagagccccctggtgacctgggtgaagaccttcggccccttcggcagcggcagccaggacaacctgaccatgtacatggacctggtggacggcatcttcctgaaccagatcatgctgcagatcgaccccagacccaccaaccagagaatcaacaagcacgtgaacaacgacgtgaacctgagaatccagaacctgaccatcctggtgagaaacatcaagacctactaccaggaggtgctgcagcagctgatcgtgatgaacctgcccaacgtgctgatgatcggcagagaccccctgagcggcaagagcatggaggagatcaagaaggtgctgctgctggtgctgggctgcgccgtgcagtgcgagagaaaggaggagttcatcgagagaatcaagcagctggacatcgagacccaggccggcatcgtggcccacatccaggaggtgacccacaaccaggagaacgtgttcgacctgcagtggctggagctgcccgacgtggcccccgaggagctggaggccctgagcagaagcatggtgctgcacctgagaagactgatcgaccagagagacgagtgcaccgagctgatcgtggacctgacccaggagagagactacctgcaggcccagcacccccccagccccatcaagagcagcagcgccgacagcacccccagccccaccagcagcctgagcagcgaggacaagcagcacctggccgtggagctggccgacaccaaggccagactgagaagagtgagacaggagctggaggacaagaccgagcagctggtggacaccagacacgaggtggaccagctggtgctggagctgcagaaggtgaagcaggagaacatccagctggccgccgacgccagaagcgccagagcctacagagacgagctggacagcctgagagagaaggccaacagagtggagagactggagctggagctgaccagatgcaaggagaagctgcacgacgtggacttctacaaggccagaatggaggagctgagagaggacaacatcatcctgatcgagaccaaggccatgctggaggagcagctgaccgccgccagagccagaggcgacaaggtgcacgagctggagaaggagaacctgcagctgaagagcaagctgcacgacctggagctggacagagacaccgacaagaagagaatcgaggagctgctggaggagaacatggtgctggagatcgcccagaagcagagcatgaacgagagcgcccacctgggctgggagctggagcagctgagcaagaacgccgacctgagcgacgccagcagaaagagcttcgtgttcgagctgaacgagtgcgccagcagcagaatcctgaagctggagaaggagaaccagagcctgcagagcaccatccagggcctgagagacgccagcctggtgctggaggagagcggcctgaagtgcggcgagctggagaaggagaaccaccagctgagcaagaagatcgagaagctgcagacccagctggagagagagaagcagagcaaccaggacctggagaccctgagcgaggagctgatcagagagaaggagcagctgcagagcgacatggagaccctgaaggccgacaaggccagacagatcaaggacctggagcaggagaaggaccacctgaacagagccatgtggagcctgagagagagaagccaggtgagcagcgaggccagaatgaaggacgtggagaaggagaacaaggccctgcaccagaccgtgaccgaggccaacggcaagctgagccagctggagttcgagaagagacagctgcacagagacctggagcaggccaaggagaagggcgagagagccgagaagctggagagagagctgcagagactgcaggaggagaacggcagactggccagaaaggtgaccagcctggagaccgccaccgagaaggtggaggccctggagcacgagagccagggcctgcagctggagaacagaaccctgagaaagagcctggacaccctgcagaacgtgagcctgcagctggagggcctggagagagacaacaagcagctggacgccgagaacctggagctgagaagactggtggagaccatgagattcaccagcaccaagctggcccagatggagagagagaaccagcagctggagagagagaaggaggagctgagaaagaacgtggacctgctgaaggccctgggcaagaagagcgagagactggagctgagctaccagagcgtgagcgccgagaacctgagactgcagcagagcctggagagcagcagccacaagacccagaccctggagagcgagctgggcgagctggaggccgagagacaggccctgagaagagacctggaggccctgagactggccaacgcccagctggagggcgccgagaaggacagaaaggccctggagcaggaggtggcccagctggagaaggacaagaagctgctggagaaggaggccaagagactgtggcagcaggtggagctgaaggacgccgtgctggacgacagcaccgccaagctgagcgccgtggagaaggagagcagagccctggacaaggagctggccagatgcagagacgccgccggcaagctgaaggagctggagaaggacaacagagacctgaccaagcaggtgaccgtgcacgccagaaccctgaccaccctgagagaggacctggtgctggagaagctgaagagccagcagctgagcagcgagctggacaagctgagccaggagctggagaaggtgggcctgaacagagagctgctgctgcaggaggacgacagcggcagcgacaccaagtacaagatcctggagggcagaaacgagagcgccctgaagaccaccctggccatgaaggaggagaagatcgtgctgctggaggcccagatggaggagaaggccagcctgaacagacagctggagagcgagctgcagatgctgaagaaggagtgcgagaccctgagacagaaccagggcgagggccagcacctgcagaacagcttcaagcaccccgccggcaagaccgccgccagccaccagggcaaggaggcctggggccccggccacaaggaggccaccatggagctgctgagagtgaaggacagagccatcgagctggagagaaacaacgccgccctgcaggccgagaagcagctgctgaaggagcagctgcagcacctggagacccagaacgtgaccttcagcagccagatcctgaccctgcagaagcagagcgccttcctgcaggagcacaacaccaccctgcagacccagaccgccaagctgcaggtggagaacagcaccctgagcagccagagcgccgccctgaccgcccagtacaccctgctgcagaaccaccacaccgccaaggagaccgagaacgagagcctgcagagacagcaggagcagctgaccgccgcctacgaggccctgctgcaggaccacgagcacctgggcaccctgcacgagagacagagcgccgagtacgaggccctgatcagacagcacagctgcctgaagaccctgcacagaaacctggagctggagcacaaggagctgggcgagagacacggcgacatgctgaagagaaaggccgagctggaggagagagagaaggtgctgaccaccgagagagaggccctgcagcaggagcagagaaccaacgccctggccatgggcgagaaccagagactgagaggcgagctggacagagtgaacttcctgcaccaccagctgaagggcgagtacgaggagctgcacgcccacaccaaggagctgaagaccagcctgaacaacgcccagctggagctgaacagatggcaggccagattcgacgagctgaaggagcagcaccagaccatggacatcagcctgaccaagctggacaaccactgcgagctgctgagcagactgaagggcaacctggaggaggagaaccaccacctgctgagccagatccagctgctgagccagcagaaccagatgctgctggagcagaacatggagaacaaggagcagtaccacgaggagcagaagcagtacatcgacaagctgaacgccctgagaagacacaaggagaagctggaggagaagatcatggaccagtacaagttctacgaccccccccccaagaagaagaaccactggatcggcgccaaggccctggtgaagctgatcaagcccaagaaggagggcagcagagagagactgaagagcaccgtggacagccccccctggcagctggagagcagcgaccccgccagccccgccgccagccagcccctgagaagccaggccgagaaccccgacacccccgccctgggcagcaactgcgccgaggagagagacgcccacaacggcagcgtgggcaagggccccggcgacctgaagcccaagagaggcagcccccacagaggcagcctggacagaaccgacgccagcaccgacctggccatgagaagctggcccagcgagctgggcagcagaacctgcagcaccagcgccaccaccaccgcccccagcaacagcacccccatcgccagacaccccggcagaaccaagggctacaacagcgacgacaacctgtgcgagcccagcctggagttcgaggtgcccaaccacagacagtacgtgagcagacccagcagcctggagagcagcagaaacaccagcagcaacagcagccccctgaacctgaagggcagcagcgagcagctgcacggcagaagcgagagcttcagcagcgaggacctgatccccagcagagacctggccaccctgcccagagaggccagcacccccggcagaaacgccctgggcagacacgagtaccccctgcccagaaacggccccctgccccaggagggcgcccagaagagaggcaccgcccccccctacgtgggcgtgagaccctgcagcgccagccccagcagcgagatggtgaccctggaggagttcctggaggagagcaacagaagcagccccacccacgacacccccagctgcagagacgacctgctgagcgactacttcagaaaggccagcgacccccccgccatcggcggccagcccggcccccccgccaagaaggagggcgccaagatgcccaccaacttcgtggcccccaccgtgaagatggccgcccccaccagcgagggcagacccctgaagcccggccagtacgtgaagcccaacttcagactgaccgaggccgaggccccccccagcgtggcccccagacaggcccagcccccccagagcctgagcctgggcagacccagacaggcccccgtgccccccgccagccacgcccccgccagcagaagcgccagcctgagcagagccttcagcctggccagcgccgacctgctgagagccagcggccccgaggcctgcaagcaggagagcccccagaagctgggcgcccccgaggccctgggcggcagagagaccggcagccacaccctgcagagccccgccccccccagcagccacagcctggccagagagagaacccccctggtgggcaaggccggcagcagctgccagggccccggccccagaagcagacccctggacaccagaagattcagcctggccccccccaaggaggagagactggcccccctgcaccagagcgccaccgcccccgccatcgccaccgccggcgccggcgccgccgccgccggcagcggcagcaacagccagctgctgcacttcagccccgccgccgcccccgccgccagaaccaagcccaaggccccccccagaagcggcgaggtggccaccatcacccccgtgagagccggcctgagcctgagcgagggcgacggcgtgcccggccagggctgcagcgagggcctgcccgccaagagccccggcagaagccccgacctggccccccacctgggcagagccctggaggactgcagcagaggcagcgtgagcaagagcagccccgccagccccgagcccggcggcgacccccagaccgtgtggtacgagtacggctgcgtgtag

SEQ ID NO: 11244 - DNA, 3831 bp, Artificial Sequence
  Description of Artificial Sequence: Synthetic coding sequence
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaagctggccgagtacgagaacctgaccaacaagctgcagagaaacctggagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagaacagcgtggtgggcagcagcagagagggctgcagcagcctgcccgagatcgtgtgcgaggacgccgcccccgaggtgcactgcgacgcctag

SEQ ID NO: 11245 - DNA, 2997 bp, Artificial Sequence
  Description of Artificial Sequence: Synthetic coding sequence
atgaaggacagcggcgacagcaaggaccagcagctgatggtggccctgagagtgagacccatcagcgtggccgagctggaggagggcgccaccctgatcgcccacaaggtggacgagcagatggtggtgctgatggaccccatggaggaccccgacgacatcctgagagcccacagaagcagagagaagagctacctgttcgacgtggccttcgacttcaccgccacccaggagatggtgtaccaggccaccaccaagagcctgatcgagggcgtgatcagcggctacaacgccaccgtgttcgcctacggccccaccggctgcggcaagacctacaccatgctgggcaccgaccaggagcccggcatctacgtgcagaccctgaacgacctgttcagagccatcgaggagaccagcaacgacatggagtacgaggtgagcatgagctacctggagatctacaacgagatgatcagagacctgctgaaccccagcctgggctacctggagctgagagaggacagcaagggcgtgatccaggtggccggcatcaccgaggtgagcaccatcaacgccaaggagatcatgcagctgctgatgaagggcaacagacagagaacccaggagcccaccgccgccaaccagaccagcagcagaagccacgccgtgctgcaggtgaccgtgagacagagaagcagagtgaagaacatcctgcaggaggtgagacagggcagactgttcatgatcgacctggccggcagcgagagagccagccagacccagaacagaggccagagaatgaaggagggcgcccacatcaacagaagcctgctggccctgggcaactgcatcaacgccctgagcgacaagggcagcaacaagtacatcaactacagagacagcaagctgaccagactgctgaaggacagcctgggcggcaacagcagaaccgtgatgatcgcccacatcagccccgccagcagcgccttcgaggagagcagaaacaccctgacctacgccggcagagccaagaacatcaagaccagagtgaagcagaacctgctgaacgtgagctaccacatcgcccagtacaccagcatcatcgccgacctgagaggcgagatccagagactgaagagaaagatcgacgagcagaccggcagaggccaggccagaggcagacaggacagaggcgacatcagacacatccaggccgaggtgcagctgcacagcggccagggcgagaaggccggcatgggccagctgagagagcagctggccagcgccttccaggagcagatggacgtgagaagaagactgctggagctggagaacagagccatggaggtgcagatcgacaccagcagacacctgctgaccatcgccggctggaagcacgagaagagcagaagagccctgaagtggagagaggagcagagaaaggagtgctacgccaaggacgacagcgagaaggacagcgacaccggcgacgaccagcccgacatcctggagccccccgaggtggccgccgccagagagagcatcgccgccctggtggacgagcagaagcagctgagaaagcagaagctggccctggagcagagatgcagagagctgagagccagaggcagaagactggaggagaccctgcccagaagaatcggcagcgaggagcagagagaggtgctgagcctgctgtgcagagtgcacgagctggaggtggagaacaccgagatgcagagccacgccctgctgagagacggcgccctgagacacagacacgaggccgtgagaagactggagcagcacagaagcctgtgcgacgagatcatccagggccagagacagatcatcgacgactacaacctggccgtgccccagagactggaggagctgtacgaggtgtacctgagagagctggaggagggcagcctggagcaggccaccatcatggaccaggtggccagcagagccctgcaggacagcagcctgcccaagatcacccccgccggcaccagcctgacccccgacagcgacctggagagcgtgaagaccctgagcagcgacgcccagcacctgcagaacagcgccctgccccccctgagcaccgagagcgagggccaccacgtgttcaaggccggcaccggcgcctggcaggccaagagcagcagcgtgcccacccccccccccatccagctgggcagcctggtgacccaggaggcccccgcccaggacagcctgggcagctggatcaacagcagccccgacagcagcgagaacctgagcgagatccccctgagccacaaggagagaaaggagatcctgaccggcaccaagtgcatctgggtgaaggccgccagaagaagaagcagagccctgggcaccgagggcagacacctgctggcccccgccaccgagagaagcagcctgagcctgcacagcctgagcgagggcgacgacgccagaccccccggccccctggcctgcaagagaccccccagccccaccctgcagcacgccgccagcgaggacaacctgagcagcagcaccggcgaggcccccagcagagccgtgggccaccacggcgacggccccagaccctggctgagaggccagaagaagagcctgggcaagaagagagaggagagcctggaggccaagagaagaaagagaagaagcagaagcttcgaggtgaccggccagggcctgagccaccccaagacccacctgctgggcccccaccaggccgagagaatcagcgaccacagaatgcccgtgtgcagacaccccgcccccggcatcagacacctgggcaaggtgaccctgcccctggccaaggtgaagctgccccccagccagaacaccggccccggcgacagcagccccctggccgtgccccccaaccccggcggcggcagcagaagagccaccagaggccccagactgccccacggcaccagcacccacggcaaggacggctgcagcagacacaactag

SEQ ID NO: 11246 - DNA, 1194 bp, Artificial Sequence
  Description of Artificial Sequence: Synthetic coding sequence
atgaccgccgaggagggcgtgcagctgagccagcagaacgccaaggacttcttcagagtgctgaacctgaacaagaagtgcgacaccagcaagcacaaggtgctggtggtgagcgtgtgcccccagagcctgccctacttcgccgccaagttcaacctgagcgtgaccgacgccagcagaagactgtgcggcttcctgaagagcctgggcgtgcactacgtgttcgacaccaccatcgccgccgacttcagcatcctggagagccagaaggagttcgtgagaagatacagacagcacagcgaggaggagagaaccctgcccatgctgaccagcgcctgccccggctgggtgagatacgccgagagagtgctgggcagacccatcaccgcccacctgtgcaccgccaagagcccccagcaggtgatgggcagcctggtgaaggactacttcgccagacagcagaacctgagccccgagaagatcttccacgtgatcgtggccccctgctacgacaagaagctggaggccctgcaggagagcctgccccccgccctgcacggcagcagaggcgccgactgcgtgctgaccagcggcgagatcgcccagatcatggagcagggcgacctgagcgtgagagacgccgccgtggacaccctgttcggcgacctgaaggaggacaaggtgaccagacacgacggcgccagcagcgacggccacctggcccacatcttcagacacgccgccaaggagctgttcaacgaggacgtggaggaggtgacctacagagccctgagaaacaaggacttccaggaggtgaccctggagaagaacggcgaggtggtgctgagattcgccgccgcctacggcttcagaaacatccagaacatgatcctgaagctgaagaagggcaagttccccttccacttcgtggaggtgctggcctgcgccggcggctgcctgaacggcagaggccaggcccagacccccgacggccacgccgacaaggccctgctgagacagatggagggcatctacgccgacatccccgtgagaagacccgagagcagcgcccacgtgcaggagctgtaccaggagtggctggagggcatcaacagccccaaggccagagaggtgctgcacaccacctaccagagccaggagagaggcacccacagcctggacatcaagtggtag

SEQ ID NO: 11247 - DNA, 3603 bp, Artificial Sequence
  Description of Artificial Sequence: Synthetic coding sequence
atgaaggtggccggcggcctggagctgggcgccgccgccctgctgagcgccagccccagagccctggtgaccctgagcaccggccccacctgcagcatcctgcccaagaaccccctgttcccccagaacctgagcagccagccctgcatcaagatggagggcgacaagagcctgaccttcagcagctacggcctgcagtggtgcctgtacgagctggacaaggaggagttccagaccttcaaggagctgctgaagaagaagagcagcgagagcaccacctgcagcatcccccagttcgagatcgagaacgccaacgtggagtgcctggccctgctgctgcacgagtactacggcgccagcctggcctgggccaccagcatcagcatcttcgagaacatgaacctgagaaccctgagcgagaaggccagagacgacatgaagagacacagccccgaggaccccgaggccaccatgaccgaccagggccccagcaaggagaaggtgcccggcatcagccaggccgtgcagcaggacagcgccaccgccgccgagaccaaggagcaggagatcagccaggccatggagcaggagggcgccaccgccgccgagaccgaggagcaggagatcagccaggccatggagcaggagggcgccaccgccgccgagaccgaggagcagggccacggcggcgacacctgggactacaagagccacgtgatgaccaagttcgccgaggaggaggacgtgagaagaagcttcgagaacaccgccgccgactggcccgagatgcagaccctggccggcgccttcgacagcgacagatggggcttcagacccagaaccgtggtgctgcacggcaagagcggcatcggcaagagcgccctggccagaagaatcgtgctgtgctgggcccagggcggcctgtaccagggcatgttcagctacgtgttcttcctgcccgtgagagagatgcagagaaagaaggagagcagcgtgaccgagttcatcagcagagagtggcccgacagccaggcccccgtgaccgagatcatgagcagacccgagagactgctgttcatcatcgacggcttcgacgacctgggcagcgtgctgaacaacgacaccaagctgtgcaaggactgggccgagaagcagccccccttcaccctgatcagaagcctgctgagaaaggtgctgctgcccgagagcttcctgatcgtgaccgtgagagacgtgggcaccgagaagctgaagagcgaggtggtgagccccagatacctgctggtgagaggcatcagcggcgagcagagaatccacctgctgctggagagaggcatcggcgagcaccagaagacccagggcctgagagccatcatgaacaacagagagctgctggaccagtgccaggtgcccgccgtgggcagcctgatctgcgtggccctgcagctgcaggacgtggtgggcgagagcgtggcccccttcaaccagaccctgaccggcctgcacgccgccttcgtgttccaccagctgacccccagaggcgtggtgagaagatgcctgaacctggaggagagagtggtgctgaagagattctgcagaatggccgtggagggcgtgtggaacagaaagagcgtgttcgacggcgacgacctgatggtgcagggcctgggcgagagcgagctgagagccctgttccacatgaacatcctgctgcccgacagccactgcgaggagtactacaccttcttccacctgagcctgcaggacttctgcgccgccctgtactacgtgctggagggcctggagatcgagcccgccctgtgccccctgtacgtggagaagaccaagagaagcatggagctgaagcaggccggcttccacatccacagcctgtggatgaagagattcctgttcggcctggtgagcgaggacgtgagaagacccctggaggtgctgctgggctgccccgtgcccctgggcgtgaagcagaagctgctgcactgggtgagcctgctgggccagcagcccaacgccaccacccccggcgacaccctggacgccttccactgcctgttcgagacccaggacaaggagttcgtgagactggccctgaacagcttccaggaggtgtggctgcccatcaaccagaacctggacctgatcgccagcagcttctgcctgcagcactgcccctacctgagaaagatcagagtggacgtgaagggcatcttccccagagacgagagcgccgaggcctgccccgtggtgcccctgtggatgagagacaagaccctgatcgaggagcagtgggaggacttctgcagcatgctgggcacccacccccacctgagacagctggacctgggcagcagcatcctgaccgagagagccatgaagaccctgtgcgccaagctgagacaccccacctgcaagatccagaccctgatgttcagaaacgcccagatcacccccggcgtgcagcacctgtggagaatcgtgatggccaacagaaacctgagaagcctgaacctgggcggcacccacctgaaggaggaggacgtgagaatggcctgcgaggccctgaagcaccccaagtgcctgctggagagcctgagactggactgctgcggcctgacccacgcctgctacctgaagatcagccagatcctgaccaccagccccagcctgaagagcctgagcctggccggcaacaaggtgaccgaccagggcgtgatgcccctgagcgacgccctgagagtgagccagtgcgccctgcagaagctgatcctggaggactgcggcatcaccgccaccggctgccagagcctggccagcgccctggtgagcaacagaagcctgacccacctgtgcctgagcaacaacagcctgggcaacgagggcgtgaacctgctgtgcagaagcatgagactgccccactgcagcctgcagagactgatgctgaaccagtgccacctggacaccgccggctgcggcttcctggccctggccctgatgggcaacagctggctgacccacctgagcctgagcatgaaccccgtggaggacaacggcgtgaagctgctgtgcgaggtgatgagagagcccagctgccacctgcaggacctggagctggtgaagtgccacctgaccgccgcctgctgcgagagcctgagctgcgtgatcagcagaagcagacacctgaagagcctggacctgaccgacaacgccctgggcgacggcggcgtggccgccctgtgcgagggcctgaagcagaagaacagcgtgctggccagactgggcctgaaggcctgcggcctgaccagcgactgctgcgaggccctgagcctggccctgagctgcaacagacacctgaccagcctgaacctggtgcagaacaacttcagccccaagggcatgatgaagctgtgcagcgccttcgcctgccccaccagcaacctgcagatcatcggcctgtggaagtggcagtaccccgtgcagatcagaaagctgctggaggaggtgcagctgctgaagcccagagtggtgatcgacggcagctggcacagcttcgacgaggacgacagatactggtggaagaactag

SEQ ID NO: 11248 - DNA, 2787 bp, Artificial Sequence
  Description of Artificial Sequence: Synthetic coding sequence
atgaacgaggccatggccaccgacagccccagaagacccagcagatgcaccggcggcgtggtggtgagaccccaggccgtgaccgagcagagctacatggagagcgtggtgaccttcctgcaggacgtggtgccccaggcctacagcggcacccccctgaccgaggagaaggagaagatcgtgtgggtgagattcgagaacgccgacctgaacgacaccagcagaaacctggagttccacgagatccacagcaccggcaacgagccccccctgctgatcatgatcggctacagcgacggcatgcaggtgtggagcatccccatcagcggcgaggcccaggagctgttcagcgtgagacacggccccatcagagccgccagaatcctgcccgccccccagttcggcgcccagaagtgcgacaacttcgccgagaagagacccctgctgggcgtgtgcaagagcatcggcagcagcggcaccagccccccctactgctgcgtggacctgtacagcctgagaaccggcgagatggtgaagagcatccagttcaagacccccatctacgacctgcactgcaacaagagaatcctggtggtggtgctgcaggagaagatcgccgccttcgacagctgcaccttcaccaagaagttcttcgtgaccagctgctacccctgccccggccccaacatgaaccccatcgccctgggcagcagatggctggcctacgccgagaacaagctgatcagatgccaccagagcagaggcggcgcctgcggcgacaacatccagagctacaccgccaccgtgatcagcgccgccaagaccctgaagagcggcctgaccatggtgggcaaggtggtgacccagctgaccggcaccctgcccagcggcgtgaccgaggacgacgtggccatccacagcaacagcagaagaagccccctggtgcccggcatcatcaccgtgatcgacaccgagaccgtgggcgagggccaggtgctggtgagcgaggacagcgacagcgacggcatcgtggcccacttccccgcccacgagaagcccgtgtgctgcatggccttcaacaccagcggcatgctgctggtgaccaccgacaccctgggccacgacttccacgtgttccagatcctgacccacccctggagcagcagccagtgcgccgtgcaccacctgtacaccctgcacagaggcgagaccgaggccaaggtgcaggacatctgcttcagccacgactgcagatgggtggtggtgagcaccctgagaggcaccagccacgtgttccccatcaacccctacggcggccagccctgcgtgagaacccacatgagccccagagtggtgaacagaatgagcagattccagaagagcgccggcctggaggagatcgagcaggagctgaccagcaagcagggcggcagatgcagccccgtgcccggcctgagcagcagccccagcggcagccccctgcacggcaagctgaacagccaggacagctacaacaacttcaccaacaacaaccccggcaaccccagactgagccccctgcccagcctgatggtggtgatgcccctggcccagatcaagcagcccatgaccctgggcaccatcaccaagagaaccggcccctacctgttcggcgccggctgcttcagcatcaaggccccctgcaaggtgaagccccccccccagatcagccccagcaagagcatgggcggcgagttctgcgtggccgccatcttcggcaccagcagaagctggttcgccaacaacgccggcctgaagagagagaaggaccagagcaagcaggtggtggtggagagcctgtacatcatcagctgctacggcaccctggtggagcacatgatggagcccagacccctgagcaccgcccccaagatcagcgacgacacccccctggagatgatgaccagccccagagccagctggaccctggtgagaaccccccagtggaacgagctgcagccccccttcaacgccaaccaccccctgctgctggccgccgacgccgtgcagtactaccagttcctgctggccggcctggtgccccccggcagccccggccccatcaccagacacggcagctacgacagcctggccagcgaccacagcggccaggaggacgaggagtggctgagccaggtggagatcgtgacccacaccggcccccacagaagactgtggatgggcccccagttccagttcaagaccatccaccccagcggccagaccaccgtgatcagcagcagcagcagcgtgctgcagagccacggccccagcgacaccccccagcccctgctggacttcgacaccgacgacctggacctgaacagcctgagaatccagcccgtgagaagcgaccccgtgagcatgcccggcagcagcagacccgtgagcgacagaagaggcgtgagcaccgtgatcgacgccgccagcggcaccttcgacagaagcgtgaccctgctggaggtgtgcggcagctggcccgagggcttcggcctgagacacatgagcagcatggagcacaccgaggagggcctgagagagagactggccgacgccatggccgagagccccagcagagacgtggtgggcagcggcaccgagctgcagagagagggcagcatcgagaccctgagcaacagcagcggcagcaccagcggcagcatccccagaaacttcgacggctacagaagccccctgcccaccaacgagagccagcccctgagcctgttccccaccggcttcccctag

SEQ ID NO: 11249 - DNA, 501 bp, Artificial Sequence
  Description of Artificial Sequence: Synthetic coding sequence
atggtgaacagctgctgcggcagcgtgtgcagcgaccagggctgcggcctggagaactgctgcagacccagctactgccagaccacctgctgcagaaccacctgctgcagacccagctgctgcgtgagcagctgctgcagaccccagtgctgccagaccacctgctgcagaaccacctgctgccaccccagctgctgcgtgagcagctgctgcagaccccagtgctgccagagcgtgtgctgccagcccacctgctgcagaccccagtgctgccagaccacctgctgcagaaccacctgctgcagacccagctgctgcagaccccagtgctgccagagcgtgtgctgccagcccacctgctgctgccccagctactgcgtgagcagctgctgcagaccccagtgctgccagaccacctgctgcagaaccacctgctgcagacccagctgctgcgtgagcagatgctacagaccccactgcggccagagcctgtgctgctag

SEQ ID NO: 11250 - DNA, 1104 bp, Artificial Sequence
  Description of Artificial Sequence: Synthetic coding sequence
atggacgacgccgccgtgctgaagagaagaggctacctgctgggcatcaacctgggcgagggcagctacgccaaggtgaagagcgcctacagcgagagactgaagttcaacgtggccatcaagatcatcgacagaaagaaggcccccgccgacttcctggagaagttcctgcccagagagatcgagatcctggccatgctgaaccactgcagcatcatcaagacctacgagatcttcgagaccagccacggcaaggtgtacatcgtgatggagctggccgtgcagggcgacctgctggagctgatcaagaccagaggcgccctgcacgaggacgaggccagaaagaagttccaccagctgagcctggccatcaagtactgccacgacctggacgtggtgcacagagacctgaagtgcgacaacctgctgctggacaaggacttcaacatcaagctgagcgacttcagcttcagcaagagatgcctgagagacgacagcggcagaatggccctgagcaagaccttctgcggcagccccgcctacgccgcccccgaggtgctgcagggcatcccctaccagcccaaggtgtacgacatctggagcctgggcgtgatcctgtacatcatggtgtgcggcagcatgccctacgacgacagcaacatcaagaagatgctgagaatccagaaggagcacagagtgaacttccccagaagcaagcacctgaccggcgagtgcaaggacctgatctaccacatgctgcagcccgacgtgaacagaagactgcacatcgacgagatcctgagccactgctggatgcagcccaaggccagaggcagccccagcgtggccatcaacaaggagggcgagagcagcagaggcaccgagcccctgtggacccccgagcccggcagcgacaagaagagcgccaccaagctggagcccgagggcgaggcccagccccaggcccagcccgagaccaagcccgagggcaccgccatgcagatgagcagacagagcgagatcctgggcttccccagcaagcccagcaccatggagaccgaggagggccccccccagcagccccccgagaccagagcccagtag

SEQ ID NO: 11251 - DNA, 273 bp, Artificial Sequence
  Description of Artificial Sequence: Synthetic coding sequence
atgagccactacggcagctactacggcggcctgggctacagctgcggcggcttcggcggcctgggctacggctacggctgcggctgcggcagcttctgcagaagaggcagcggctgcggctacggcggctacggctacggcagcggcttcggcagctacggctacggcagcggcttcggcggctacggctacggcagcggcttcggcggctacggctacggctgctgcagacccagctacaacggcggctacggcttcagcggcttctactag

SEQ ID NO: 11252 - DNA, 519 bp, Artificial Sequence
  Description of Artificial Sequence: Synthetic coding sequence
atgagctacaactgctgcagcagaaacttcagcagctgcagccacggcggctacctgcactaccccggcagcagctgcggcagcagctaccccagcaacctggtgtacagcaccgacctgtgcagccccagcacctgccagctgggcagcagcctgtacagaggctgccaggagacctgctggagacccaacagctgccagaccctgtgcgtggagagcagcccctgccacaccagctgctactaccccagaacccacatgctgtgcaacagctgcctgaccatgcacgtgggcagcagaggcttcggcagcaacagctgctgcagcctgagctgcggcagcagaagctgcagcagcctgggctgcggcagcaacggcttcagatacctgaactacagaatccacaccagccccagccagagctacagaagcagattctgccaccccatctacttcccccccagaagatggttccacagcagctgctaccagcccttctgcagaagcggcttctactag

SEQ ID NO: 11253 - DNA, 1554 bp, Artificial Sequence
  Description of Artificial Sequence: Synthetic coding sequence
atgagcggcagctgcagcagcagaaagtgcttcagcgtgcccgccaccagcctgtgcagcaccgaggtgagctgcggcggccccatctgcctgcccagcagctgccagagccagacctggcagctggtgacctgccaggacagctgcggcagcagcagctgcggcccccagtgcagacagcccagctgccccgtgagcagctgcgcccagcccctgtgctgcgaccccgtgatctgcgagcccagctgcagcgtgagcagcggctgccagcccgtgtgctgcgaggccaccacctgcgagcccagctgcagcgtgagcaactgctaccagcccgtgtgcttcgaggccaccatctgcgagcccagctgcagcgtgagcaactgctgccagcccgtgtgcttcgaggccaccgtgtgcgagcccagctgcagcgtgagcagctgcgcccagcccgtgtgctgcgagcccgccatctgcgagcccagctgcagcgtgagcagctgctgccagcccgtgggcagcgaggccaccagctgccagcccgtgctgtgcgtgcccaccagctgccagcccgtgctgtgcaagagcagctgctgccagcccgtggtgtgcgagcccagctgctgcagcgccgtgtgcaccctgcccagcagctgccagcccgtggtgtgcgagcccagctgctgccagcccgtgtgccccacccccacctgcagcgtgaccagcagctgccaggccgtgtgctgcgaccccagcccctgcgagcccagctgcagcgagagcagcatctgccagcccgccacctgcgtggccctggtgtgcgagcccgtgtgcctgagacccgtgtgctgcgtgcagagcagctgcgagccccccagcgtgcccagcacctgccaggagcccagctgctgcgtgagcagcatctgccagcccatctgcagcgagcccagcccctgcagccccgccgtgtgcgtgagcagcccctgccagcccacctgctacgtggtgaagagatgccccagcgtgtgccccgagcccgtgagctgccccagcaccagctgcagacccctgagctgcagccccggcagcagcgccagcgccatctgcagacccacctgccccagaaccttctacatccccagcagcagcaagagaccctgcagcgccaccatcagctacagacccgtgagcagacccatctgcagacccatctgcagcggcctgctgacctacagacagccctacatgaccagcatcagctacagacccgcctgctacagaccctgctacagcatcctgagaagacccgcctgcgtgaccagctacagctgcagacccgtgtacttcagacccagctgcaccgagagcgacagctgcaagagagactgcaagaagagcaccagcagccagctggactgcgtggacaccaccccctgcaaggtggacgtgagcgaggaggccccctgccagcccaccgaggccaagcccatcagccccaccaccagagaggccgccgccgcccagcccgccgccagcaagcccgccaactgctag

SEQ ID NO: 11254 - DNA, 1026 bp, Artificial Sequence
  Description of Artificial Sequence: Synthetic coding sequence
atggccgacggctgctgccccggcaacaccaccgccatccccgccgtgcccaccatcaccacctaccccgtgaagggcggcttcagacacgccctgtgcctgcccagcagctgccacagcagaatgtggcagctggtgacctgccaggagagctgccagcccagcatcggcgcccccagcggctgcgaccccgccagctgccagcccaccagactgcccgccaccagctgcgtgggcttcgtgtgccagcccatgtgcagccacgccgcctgctaccagagcggcaccggccagagcccctgcctggtgagcagctgccagcccagctgcagcgagagcacctgctgccaggagaagtgctgcgacgccagcccctgccagcagagcagctgccaggagagcgtgtgcatgagcggcagctgccaggccgcctgcggccagagcgtgtgctgcgacgccggcagctgccagcccagctgcagcgaggtgaccagctgccccgagaccagctgcctgcccaccatctgcaccgccagcccctgccagcccacctggtgccagggcagcagctgccagcccgtgagcggcgagggccagccctgcaagagcacctactaccagcccatctgctacatcttcaagccctgccagagcgccctgtacatgcccgtgccctgccagcccagcacctgcgtgttcagcagctgcaacaccacctgctgcgtgcccagccactgccagcccccccactgccagctggtgcccagcacctgcttcatctaccagcccgtggccaactgccaggccccctgcagcaccaagaactgctgcaagcccgccagctgcgacaccgtgatcagcggccagcccacctgcgacggcccccccagctacaaccagagcggctgcaagagcgcctgctgcgtgaccggcctgggcaccagccccagcagcggcagcaactgcctgcccaccagctgccagcccagctgcgagagcagcttctgcaaggccaccctgtgctag

SEQ ID NO: 11255 - DNA, 588 bp, Artificial Sequence
  Description of Artificial Sequence: Synthetic coding sequence
atggtgagcagctgctgcggcagcgtgtgcagcgaccagagctgcggccagggcctgggccaggagagctgctgcagacccagctgctgccagaccacctgctgcagaaccacctgctgcagacccagctgctgcatcagcagctgctgcagacccagctgctgcatcagcagctgctgcaagcccagctgctgcagaaccacctgctgcagacccagctgctgcatcagcagctgctgcagacccagctgctgcatcagcagctgctgcaagcccagctgctgcagaaccacctgctgcagacccagctgctgcatcagcagctgctgcagacccagctgctgcatcagcagctgctgcaagcccagctgctgccagaccacctgctgcagacccagctgctgcatcagcagctgctacagaccccagtgctgccagcccagctgctgcagacccgcctgctgcatcagcagctgctgccaccccagctgctgcgtgagcagctgcagatgccccttcagctgccccaccacctgctgcagaaccacctgcttccaccccatctgctgcggcagcagctgctgctag

SEQ ID NO: 11256 - DNA, 588 bp, Artificial Sequence
  Description of Artificial Sequence: Synthetic coding sequence
atggtgaacagctgctgcggcagcgtgtgcagccaccagggctgcggcagagacctgtgccaggagacctgctgcagacccagctgctgcgagaccacctgctgcagaaccacctactgcagacccagctgctgcgtgagcagctgctgcagaccccagtgctgccagagcgtgtgctgccagcccacctgctgcagacccagatgctgcatcagcagctgctgcagacccagctgctgcgtgagcagctgctgcaagccccagtgctgccagagcatgtgctgccagcccacctgctgcagacccagatgctgcatcagcagctgctgcagacccagctgctgcgtgagcagctgctgcagaccccagtgctgccagagcgtgtgctgccagcccacctgctgccaccccagctgcagcatcagcagctgctgcagacccagctgctgcgagagcagctgctgcagaccctgctgctgcctgagacccgtgtgcggcagagtgagctgccacaccacctgctacagacccacctgcgtgatcagcagctgccccagacccctgtgctgcgccagcagctgctgctag

SEQ ID NO: 11257 - DNA, 633 bp, Artificial Sequence
  Description of Artificial Sequence: Synthetic coding sequence
atggtgagcagctgctgcggcagcgtgtgcagcgaccagggctgcggccaggacctgtgccaggagacctgctgcagacccagctgctgcgagaccacctgctgcagaaccacctgctgcagacccagctgctgcgtgagcagctgctgcagaccccagtgctgccagagcgtgtgctgccagcccacctgcagcagacccagctgctgccagaccacctgctgcagaaccacctgctacagacccagctgctgcgtgagcagctgctgcagaccccagtgctgccagcccgcctgctgccagcccacctgctgcagacccagctgctgcgagaccacctgctgccaccccagatgctgcatcagcagctgctgcagacccagctgctgcgtgagcagctgctgcaagccccagtgctgccagagcgtgtgctgccagcccaactgctgcagacccagctgcagcatcagcagctgctgcagacccagctgctgcgagagcagctgctgcagaccctgctgctgcgtgagacccgtgtgcggcagagtgagctgccacaccacctgctacagacccacctgcgtgatcagcagctgccccagacccctgtgctgcgccagcagctgctgctag

SEQ ID NO: 11258 - DNA, 387 bp, Artificial Sequence
  Description of Artificial Sequence: Synthetic coding sequence
atgaccggcagctgctgcggcagcaccctgagcagcctgagctacggcggcggctgctgccagccctgctgctgcagagacccctgctgctgcagacccgtgacctgccagaccaccgtgtgcagacccgtgacctgcgtgcccagatgcaccagacccatctgcgagccctgcagaagacccgtgtgctgcgacccctgcagcctgcaggagggctgctgcagacccatcacctgctgccccagcagctgcaccgccgtggtgtgcagaccctgctgctgggccaccacctgctgccagcccgtgagcgtgcagagcccctgctgcagacccccctgcggccagcccaccccctgcagcaccacctgcagaaccagcagctgctag

SEQ ID NO: 11259 - DNA, 387 bp, Artificial Sequence
  Description of Artificial Sequence: Synthetic coding sequence
atgaccggcagctgctgcggcagcaccttcagcagcctgagctacggcggcggctgctgccagccctgctgctgcagagacccctgctgctgcagacccgtgacctgccagaccaccgtgtgcagacccgtgacctgcgtgcccagatgcaccagacccatctgcgagccctgcagaagacccgtgtgctgcgacccctgcagcctgcaggagggctgctgcagacccatcacctgctgccccagcagctgcaccgccgtggtgtgcagaccctgctgctgggccaccacctgctgccagcccgtgagcgtgcagagcccctgctgcagacccccctgcggccagcccaccccctgcagcaccacctgcagaaccagcagctgctag

SEQ ID NO: 11260 - DNA, 297 bp, Artificial Sequence
  Description of Artificial Sequence: Synthetic coding sequence
atggactgctgcgccagcagaggctgcagcgtgcccaccggccccgccaccaccatctgcagcagcgacaagagctgcagatgcggcgtgtgcctgcccagcacctgcccccacaccgtgtggctgctggagcccacctgctgcgacaactgcccccccccctgccacatcccccagccctgcgtgcccacctgcttcctgctgaacagctgccagcccacccccggcctggagaccctgaacctgaccaccttcacccagccctgctgcgagccctgcctgcccagaggctgctag

SEQ ID NO: 11261 - DNA, 297 bp, Artificial Sequence
  Description of Artificial Sequence: Synthetic coding sequence
atggactgctgcgccagcagaagctgcagcgtgcccaccggccccgccaccaccatctgcagcagcgacaagagctgcagatgcggcgtgtgcctgcccagcacctgcccccacaccgtgtggctgctggagcccatctgctgcgacaactgcccccccccctgccacatcccccagccctgcgtgcccacctgcttcctgctgaacagctgccagcccacccccggcctggagaccctgaacctgaccaccttcacccagccctgctgcgagccctgcctgcccagaggctgctag

SEQ ID NO: 11262 - DNA, 297 bp, Artificial Sequence
  Description of Artificial Sequence: Synthetic coding sequence
atgtactgctgcgccctgagaagctgcagcgtgcccaccggccccgccaccaccttctgcagcttcgacaagagctgcagatgcggcgtgtgcctgcccagcacctgcccccacgagatcagcctgctgcagcccatctgctgcgacacctgcccccccccctgctgcaagcccgacacctacgtgcccacctgctggctgctgaacaactgccaccccacccccggcctgagcggcatcaacctgaccacctacgtgcagcccggctgcgagagcccctgcgagcccagatgctag

SEQ ID NO: 11263 - DNA, 291 bp, Artificial Sequence
  Description of Artificial Sequence: Synthetic coding sequence
atgtgccacaccagctgcagcagcggctgccagcccgcctgctgcgcccccagcccctgccaggccagctgctacatccccgtgggctgccagagcagcgtgtgcgtgcccgtgagcttcaagcccgccgtgtgcgtgcccgtgagatgccagagcagcgtgtgcgtgcccgtgagctgcagacccgtggtgtacgccgcccccagctgccagagcagcggctgctgccagcccagctgcaccagcgtgctgtgcagacccatcagctgcagcacccccagctgctgctag

SEQ ID NO: 11264 - DNA, 339 bp, Artificial Sequence
  Description of Artificial Sequence: Synthetic coding sequence
atgtgccacaccagccacagcagcggctgccccatggcctgccccggcagcccctgctgcgtgcccagcacctgctacccccccgagggctacggcaccagctgctgctgcagcgccccctgcgtggccctgctgtgcagacccctgtgcggcgtgagcacctgctgccagcccgcctgctgcgtgcccagcccctgccaggtggcctgctgcgtgcccgtgagctgcaagcccgtgctgtgcgtggccagcttctgccccaccagcggctgctgccagcccttctgccccaccctggtgtacagacccgtgacctggagcacccccaccggctgctag

SEQ ID NO: 11265 - DNA, 666 bp, Artificial Sequence
  Description of Artificial Sequence: Synthetic coding sequence
atggccaccagcaccatgagcgtgtgcagcagcgcctacagcgacagctggcaggtggacgcctgccccgagagctgctgcgagcccccctgctgcgccaccagctgctgcgcccccgccccctgcctgaccctggtgtgcacccccgtgagctgcgtgagcagcccctgctgccaggccgcctgcgagcccagcccctgccagagcggctgcaccagcagctgcacccccagctgctgccagcagagcagctgccagcccgcctgctgcaccagcagcccctgccagcaggcctgctgcgtgcccgtgtgctgcaagcccgtgtgctgcgtgcccgtgtgctgcaagcccgtgtgctgcaagcccatctgctgcgtgcccgtgtgcagcggcgccagcagcagctgctgccagcagagcagcagacagcccgcctgctgcaccaccagctgctgcagacccagcagcagcgtgagcctgctgtgcagacccgtgtgcagaagcacctgctgcgtgcccatccccagctgctgcgcccccgccagcacctgccagcccagctgctgcagacccgccagctgcgtgagcctgctgtgcagacccacctgcagcagactgagcagcgcctgctgcggcctgagcagcggccagaagagcagctgctag

SEQ ID NO: 11266 - DNA, 768 bp, Artificial Sequence
  Description of Artificial Sequence: Synthetic coding sequence
atggccgccagcaccatgagcatctgcagcagcgcctgcaccaacagctggcaggtggacgactgccccgagagctgctgcgagctgccctgcggcacccccagctgctgcgcccccgccccctgcctgaccctggtgtgcacccccgtgagctgcgtgagcagcccctgctgccaggccgcctgcgagcccagcgcctgccagagcggctgcaccagcagctgcacccccagctgctgccagcagagcagctgccagcccgcctgctgcaccagcagcccctgccagcaggcctgctgcgtgcccgtgtgctgcaagcccgtgtgctgcgtgcccgtgtgctgcggcgccagcagctgctgccagcagagcagctgccagcccgcctgctgcgccagcagcagctgccagcagagctgcagagtgcccgtgtgctgcaaggccgtgtgctgcgtgcccacctgcagcgagagcagcagcagctgctgccagcagagcagctgccagcccgcctgctgcaccagcagcccctgccagcagagctgctgcgtgagcgtgtgctgcaagcccgtgtgctgcaagagcatctgctgcgtgcccgtgtgcagcggcgccagcagcccctgctgccagcagagcagctgccagcccgcctgctgcaccagcagctgctgcagacccagcagcagcgtgagcctgctgtgcagacccgtgtgcagcagacccgccagctgcagcttcagcagcggccagaagagcagctgctag

SEQ ID NO: 11267 - DNA, 312 bp, Artificial Sequence
  Description of Artificial Sequence: Synthetic coding sequence
atgtgcggcagctactacagaaactacaacggcggccacggctacggctgctgcggctacggcggcctgggctgcggctacggcggctgcggctacggctgctgcggctacggcggcctgggcttcggctacggcggcctggactgcggctacggcggcctgggctgcggctacggcagcttctgcggctgcggctacagaggcctggactgcggctacggctgcggctacggctacgtgagccacagcttctgcggctgcggctacagatgcggcagcggctacggcagcagcttcggctactactactag

SEQ ID NO: 11268 - DNA, 3117 bp, Artificial Sequence
  Description of Artificial Sequence: Synthetic coding sequence
atggtgagcagcgcccagatgggcttcaacctgcaggccctgctggagcagctgagccaggacgagctgagcaagttcaagtacctgatcaccaccttcagcctggcccacgagctgcagaagatcccccacaaggaggtggacaaggccgacggcaagcagctggtggagatcctgaccacccactgcgacagctactgggtggagatggccagcctgcaggtgttcgagaagatgcacagaatggacctgagcgagagagccaaggacgaggtgagagaggccgccctgaagagcttcaacaagagaaagcccctgagcctggccttcaccgagaccaagggcaacgtgatctgcctgggcaaggaggtgttcaagggcaagaagcccgacaaggacaacagatgcagatacatcctgaagaccaagttcagagagatgtggaagagctggcccggcgacagcaaggaggtgcaggtgatggccgagagatacaagatgctgatccccttcagcaaccccagagtgctgcccggccccttcagctacaccgtggtgctgtacggccccgccggcctgggcaagaccaccctggcccagaagctgatgctggactgggccgaggacaacctgatccacaagttcaagtacgccttctacctgagctgcagagagctgagcagactgggcccctgcagcttcgccgagctggtgttcagagactggcccgagctgcaggacgacatcccccacatcctggcccaggccagaaagatcctgttcgtgatcgacggcttcgacgagctgggcgccgcccccggcgccctgatcgaggacatctgcggcgactgggagaagaagaagcccgtgcccgtgctgctgggcagcctgctgaacagagtgatgctgcccaaggccgccctgctggtgaccaccagacccagagccctgagagacctgagaatcctggccgaggagcccatctacatcagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagaccagcgtgctgcacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacaccctggagaaggaggaggaggaggacagagacggccacacctgggacatcggcgacgtgcagaagctgctgagcggcgtggagagactgagaaaccccgacctgatccaggccggctactacagcttcggcctggccaacgagaagagagccaaggagctggaggccaccttcggctgcagaatgagccccgacatcaagcaggagctgctgagatgcgacatcagctgcaagggcggccacagcaccgtgaccgacctgcaggagctgctgggctgcctgtacgagagccaggaggaggagctggtgaaggaggtgatggcccagttcaaggagatcagcctgcacctgaacgccgtggacgtggtgcccagcagcttctgcgtgaagcactgcagaaacctgcagaagatgagcctgcaggtgatcaaggagaacctgcccgagaacgtgaccgccagcgagagcgacgccgaggtggagagaagccaggacgaccagcacatgctgcccttctggaccgacctgtgcagcatcttcggcagcaacaaggacctgatgggcctggccatcaacgacagcttcctgagcgccagcctggtgagaatcctgtgcgagcagatcgccagcgacacctgccacctgcagagagtggtgttcaagaacatcagccccgccgacgcccacagaaacctgtgcctggccctgagaggccacaagaccgtgacctacctgaccctgcagggcaacgaccaggacgacatgttccccgccctgtgcgaggtgctgagacaccccgagtgcaacctgagatacctgggcctggtgagctgcagcgccaccacccagcagtgggccgacctgagcctggccctggaggtgaaccagagcctgacctgcgtgaacctgagcgacaacgagctgctggacgagggcgccaagctgctgtacaccaccctgagacaccccaagtgcttcctgcagagactgagcctggagaactgccacctgaccgaggccaactgcaaggacctggccgccgtgctggtggtgagcagagagctgacccacctgtgcctggccaagaaccccatcggcaacaccggcgtgaagttcctgtgcgagggcctgagataccccgagtgcaagctgcagaccctggtgctgtggaactgcgacatcaccagcgacggctgctgcgacctgaccaagctgctgcaggagaagagcagcctgctgtgcctggacctgggcctgaaccacatcggcgtgaagggcatgaagttcctgtgcgaggccctgagaaagcccctgtgcaacctgagatgcctgtggctgtggggctgcagcatcccccccttcagctgcgaggacctgtgcagcgccctgagctgcaaccagagcctggtgaccctggacctgggccagaaccccctgggcagcagcggcgtgaagatgctgttcgagaccctgacctgcagcagcggcaccctgagaaccctgagactgaagatcgacgacttcaacgacgagctgaacaagctgctggaggagatcgaggagaagaacccccagctgatcatcgacaccgagaagcaccacccctgggccgagagacccagcagccacgacttcatgatctag

SEQ ID NO: 11269 - DNA, 762 bp, Artificial Sequence
  Description of Artificial Sequence: Synthetic coding sequence
atggagctggagcagagagagggcaccatggccgccgtgggcttcgaggagttcagcgccccccccggcagcgagctggccctgccccccctgttcggcggccacatcctggagagcgagctggagaccgaggtggagttcgtgagcggcggcctgggcggcagcggcctgagagagagagacgaggaggaggaggccgccagaggcagaagaagaagacagagagagctgaacagaagaaagtaccaggccctgggcagaagatgcagagagatcgagcaggtgaacgagagagtgctgaacagactgcaccaggtgcagagaatcaccagaagactgcagcaggagagaagattcctgatgagagtgctggacagctacggcgacgactacagagccagccagttcaccatcgtgctggaggacgagggcagccagggcaccgacgcccccacccccggcaacgccgagaacgagccccccgagaaggagaccctgagcccccccagaagaacccccgccccccccgagcccggcagccccgcccccggcgagggccccagcggcagaaagagaagaagagtgcccagagacggcagaagagccggcaacgccctgacccccgagctggcccccgtgcagatcaaggtggaggaggacttcggcttcgaggccgacgaggccctggacagcagctgggtgagcagaggccccgacaagctgctgccctaccccaccctggccagccccgccagcgactag

SEQ ID NO: 11270 - DNA, 2679 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgagacccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggtggctgttcggcatggacctgaacaagatgacccacagcagactggccgccctgagagtgaccaagccctacctggacatcggctgctag

SEQ ID NO: 11271 - DNA, 3189 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgagacccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgaagatctgcagactgaccgccgccgcctgcgacgagctggccagcaccctgagcgtgaaccagagcctgagagagctggacctgagcctgaacgagctgggcgacctgggcgtgctgctgctgtgcgagggcctgagacaccccacctgcaagctgcagaccctgagactgggcatctgcagactgggcagcgccgcctgcgagggcctgagcgtggtgctgcaggccaaccacaacctgagagagctggacctgagcttcaacgacctgggcgactggggcctgtggctgctggccgagggcctgcagcaccccgcctgcagactgcagaagctgtggctggacagctgcggcctgaccgccaaggcctgcgagaacctgtacttcaccctgggcatcaaccagaccctgaccgacctgtacctgaccaacaacgccctgggcgacaccggcgtgagactgctgtgcaagagactgagccaccccggctgcaagctgagagtgctgtggctgttcggcatggacctgaacaagatgacccacagcagactggccgccctgagagtgaccaagccctacctggacatcggctgctag

SEQ ID NO: 11272 - DNA, 3015 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgcccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgaagatctgcagactgaccgccgccgcctgcgacgagctggccagcaccctgagcgtgaaccagagcctgagagagctggacctgagcctgaacgagctgggcgacctgggcgtgctgctgctgtgcgagggcctgagacaccccacctgcaagctgcagaccctgagactggacagctgcggcctgaccgccaaggcctgcgagaacctgtacttcaccctgggcatcaaccagaccctgaccgacctgtacctgaccaacaacgccctgggcgacaccggcgtgagactgctgtgcaagagactgagccaccccggctgcaagctgagagtgctgtggctgttcggcatggacctgaacaagatgacccacagcagactggccgccctgagagtgaccaagccctacctggacatcggctgctag

SEQ ID NO: 11273 - DNA, 327 bp, Artificial Sequence
  Description of Artificial Sequence: Synthetic coding sequence
atggccagcggcagacccgaggagctgtgggaggccgtggtgggcgccgccgagagattcagagccagaaccggcaccgagctggtgctgctgaccgccgcccccccccccccccccagacccggcccctgcgcctacgccgcccacggcagaggcgccctggccgaggccgccagaagatgcctgcacgacatcgccctggcccacagagccgccaccgccgccagaccccccgcccccccccccgccccccagccccccagccccacccccagcccccccagacccaccctggccagagaggacaacgaggaggacgaggactag

SEQ ID NO: 11274 - DNA, 771 bp, Artificial Sequence; identical to SEQ ID NO: 10283
  Description of Artificial Sequence: Synthetic coding sequence

SEQ ID NO: 11275 - DNA, 771 bp, Artificial Sequence; identical to SEQ ID NO: 10283
  Description of Artificial Sequence: Synthetic coding sequence

SEQ ID NO: 11276 - DNA, 771 bp, Artificial Sequence; identical to SEQ ID NO: 10283
  Description of Artificial Sequence: Synthetic coding sequence

SEQ ID NO: 11277 - DNA, 771 bp, Artificial Sequence; identical to SEQ ID NO: 10283
  Description of Artificial Sequence: Synthetic coding sequence

SEQ ID NO: 11278 - DNA, 831 bp, Artificial Sequence
  Description of Artificial Sequence: Synthetic coding sequence
atgagcttcgagggcggcgacggcgccggccccgccatgctggccaccggcaccgccagaatggccagcggcagacccgaggagctgtgggaggccgtggtgggcgccgccgagagattcagagccagaaccggcaccgagctggtgctgctgaccgccgcccccccccccccccccagacccggcccctgcgcctacgccgcccacggcagaggcgccctggccgaggccgccagaagatgcctgcacgacatcgccctggcccacagagccgccaccgccgccagaccccccgcccccccccccgccccccagccccccagccccacccccagcccccccagacccaccctggccagagaggacaacgaggaggacgaggacgagcccaccgagaccgagaccagcggcgagcagctgggcatcagcgacaacggcggcctgttcgtgatggacgaggacgccaccctgcaggacctgccccccttctgcgagagcgaccccgagagcaccgacgacggcagcctgagcgaggagacccccgccggcccccccacctgcagcgtgccccccgccagcgccctgcccacccagcagtacgccaagagcctgcccgtgagcgtgcccgtgtggggcttcaaggagaagagaaccgaggccagaagcagcgacgaggagaacggcccccccagcagccccgacctggacagaatcgccgccagcatgagagccctggtgctgagagaggccgaggacacccaggtgttcggcgacctgcccagacccagactgaacaccagcgacttccagaagctgaagagaaagtactag

SEQ ID NO: 11279 - DNA, 906 bp, Artificial Sequence; identical to SEQ ID NO: 10199
  Description of Artificial Sequence: Synthetic coding sequence

SEQ ID NO: 11280 - DNA, 612 bp, Artificial Sequence
  Description of Artificial Sequence: Synthetic coding sequence
atggccgaggtgcaggtgctggtgctggacggcagaggccacctgctgggcagactggccgccatcgtggccaagcaggtgctgctgggcagaaaggtggtggtggtgagatgcgagggcatcaacatcagcggcaacttctacagaaacaagctgaagtacctggccttcctgagaaagagaatgaacaccaaccccagcagaggcccctaccacttcagagcccccagcagaatcttctggagaaccgtgagaggcatgctgccccacaagaccaagagaggccaggccgccctggacagactgaaggtgttcgacggcatcccccccccctacgacaagaagaagagaatggtggtgcccgccgccctgaaggtggtgagactgaagcccaccagaaagttcgcctacctgggcagactggcccacgaggtgggctggaagtaccaggccgtgaccgccaccctggaggagaagagaaaggagaaggccaagatccactacagaaagaagaagcagctgatgagactgagaaagcaggccgagaagaacgtggagaagaagatcgacaagtacaccgaggtgctgaagacccacggcctgctggtgtag

SEQ ID NO: 11281 - DNA, 690 bp, Artificial Sequence; identical to SEQ ID NO: 9325
  Description of Artificial Sequence: Synthetic coding sequence

SEQ ID NO: 11282 - DNA, 2283 bp, Artificial Sequence
  Description of Artificial Sequence: Synthetic coding sequence
atgatggaggagagagccgccgccgccgtggccgccgccgccagcagctgcagacccctgggcagcggcgccggccccggccccaccggcgccgcccccgtgagcgcccccgcccccggccccggccccgccggcaagggcggcggcggcggcggcagccccggccccaccgccggccccgagcccctgagcctgcccggcatcctgcacttcatccagcacgagtgggccagattcgaggccgagaaggccagatgggaggccgagagagccgagctgcaggcccaggtggccttcctgcagggcgagagaaagggccaggagaacctgaagaccgacctggtgagaagaatcaagatgctggagtacgccctgaagcaggagagagccaagtaccacaagctgaagttcggcaccgacctgaaccagggcgagaagaaggccgacgtgagcgagcaggtgagcaacggccccgtggagagcgtgaccctggagaacagccccctggtgtggaaggagggcagacagctgctgagacagtacctggaggaggtgggctacaccgacaccatcctggacatgagaagcaagagagtgagaagcctgctgggcagaagcctggagctgaacggcgccgtggagcccagcgagggcgcccccagagccccccccggccccgccggcctgagcggcggcgagagcctgctggtgaagcagatcgaggagcagatcaagagaaacgccgccggcaaggacggcaaggagagactgggcggcagcgtgctgggccagatccccttcctgcagaactgcgaggacgaggacagcgacgaggacgacgagctggacagcgtgcagcacaagaagcagagagtgaagctgcccagcaaggccctggtgcccgagatggaggacgaggacgaggaggacgacagcgaggacgccatcaacgagttcgacttcctgggcagcggcgaggacggcgagggcgcccccgaccccagaagatgcaccgtggacggcagcccccacgagctggagagcagaagagtgaagctgcagggcatcctggccgacctgagagacgtggacggcctgccccccaaggtgaccggccccccccccggcaccccccagcccagaccccacgagggcagcttcggcttcagcagcgacgtgttcatcatggacaccatcggcggcggcgaggtgagcctgggcgacctggccgacctgaccgtgaccaacgacaacgacctgagctgcgacctgagcgacagcaaggacgccttcaagaagacctggaaccccaagttcaccctgagaagccactacgacggcatcagaagcctggccttccaccacagccagagcgccctgctgaccgccagcgaggacggcaccctgaagctgtggaacctgcagaaggccgtgaccgccaagaagaacgccgccctggacgtggagcccatccacgccttcagagcccacagaggccccgtgctggccgtggccatgggcagcaacagcgagtactgctacagcggcggcgccgacgcctgcatccacagctggaagatccccgacctgagcatggacccctacgacggctacgaccccagcgtgctgagccacgtgctggagggccacggcgacgccgtgtggggcctggccttcagccccaccagccagagactggccagctgcagcgccgacggcaccgtgagaatctgggaccccagcagcagcagccccgcctgcctgtgcaccttccccaccgccagcgagcacggcgtgcccaccagcgtggccttcaccagcaccgagcccgcccacatcgtggccagcttcagaagcggcgacaccgtgctgtacgacatggaggtgggcagcgccctgctgaccctggagagcagaggcagcagcggccccacccagatcaaccaggtggtgagccaccccaaccagcccctgaccatcaccgcccacgacgacagaggcatcagattcctggacaacagaaccggcaagcccgtgcacagcatggtggcccacctggacgccgtgacctgcctggccgtggaccccaacggcgccttcctgatgagcggcagccacgactgcagcctgagactgtggagcctggacaacaagacctgcgtgcaggagatcaccgcccacagaaagaagcacgaggaggccatccacgccgtggcctgccaccccagcaaggccctgatcgccagcgccggcgccgacgccctggccaaggtgttcgtgtag

SEQ ID NO: 11283 - DNA, 327 bp, Artificial Sequence
  Description of Artificial Sequence: Synthetic coding sequence
atgacccccgaggagctgcagaagagagaggaggaggagttcaacaccggccccctgagcgtgctgacccagagcgtgaagaacaacacccaggtgctgatcaactgcagaaacaacaagaagctgctgggcagagtgaaggccttcgacagacactgcaacatggtgctggagaacgtgaaggagatgtggaccgaggtgcccaagagcggcaagggcaagaagaagagcaagcccgtgaacaaggacagatacatcagcaagatgttcctgagaggcgacagcgtgatcgtggtgctgagaaaccccctgatcgccggcaagtag

SEQ ID NO: 11284 - DNA, 1275 bp, Artificial Sequence
  Description of Artificial Sequence: Synthetic coding sequence
atggtgcagaccctgtactacagcgccgaccacaagctgctggacggcaacctgctggacggccaggccgaggtgttcggcagcgacgacgaccacatccagttcgtgcagaagaagccccccagagagaacggccacaagcagatcagcagcagcagcaccggctgcctgagcagccccaacgccaccgtgcagagccccaagcacgagtggaagatcgtggccagcgagaagaccagcaacaacacctacctgtgcctggccgtgctggacggcatcttctgcgtgatcttcctgcacggcagaaacagcccccagagcagccccaccagcacccccaagctgagcaagagcctgagcttcgagatgcagcaggacgagctgatcgagaagcccatgagccccatgcagtacgccagaagcggcctgggcaccgccgagatgaacggcaagctgatcgccgccggcggctacaacagagaggagtgcctgagaaccgtggagtgctacaacccccacaccgaccactggagcttcctggcccccatgagaacccccagagccagattccagatggccgtgctgatgggccagctgtacgtggtgggcggcagcaacggccacagcgacgacctgagctgcggcgagatgtacgacagcaacatcgacgactggatccccgtgcccgagctgagaaccaacagatgcaacgccggcgtgtgcgccctgaacggcaagctgtacatcgtgggcggcagcgacccctacggccagaagggcctgaagaactgcgacgtgttcgaccccgtgaccaagctgtggaccagctgcgcccccctgaacatcagaagacaccagagcgccgtgtgcgagctgggcggctacctgtacatcatcggcggcgccgagagctggaactgcctgaacaccgtggagagatacaaccccgagaacaacacctggaccctgatcgcccccatgaacgtggccagaagaggcgccggcgtggccgtgctgaacggcaagctgttcgtgtgcggcggcttcgacggcagccacgccatcagctgcgtggagatgtacgaccccaccagaaacgagtggaagatgatgggcaacatgaccagccccagaagcaacgccggcatcgccaccgtgggcaacaccatctacgccgtgggcggcttcgacggcaacgagttcctgaacaccgtggaggtgtacaacctggagagcaacgagtggagcccctacaccaagatcttccagttctag

SEQ ID NO: 11285 - DNA, 483 bp, Artificial Sequence
  Description of Artificial Sequence: Synthetic coding sequence
atgaacaacgccagatacctgtggaagagaatcccccccgccatcaagagcgccaacagcgagctgggcggcatctggagcgtgggccagagaatctggcagagagacttccccggcatctacaccaccatcaacgcccaccagtggagcgagaccgtgcagcccatcatggaggccctgagagacgccaccagaagaagagccttcgccctggtgagccaggcctacaccagcatcatcgccgacgacttcgccgccttcgtgggcctgcccgtggaggaggccgtgaagggcatcctggagcagggctggcaggccgacagcaccaccagaatggtgctgcccagaaagcccgtggccggcgccctggacgtgagcttcaacaagttcatccccctgagcgagcccgcccccgtgccccccatccccaacgagcagcagctggccagactgaccgactacgtggccttcctggagaactag

SEQ ID NO: 11286 - DNA, 927 bp, Artificial Sequence
  Description of Artificial Sequence: Synthetic coding sequence
atgatggaggagatcagcatcatggtggcctacgacgcccacgtgttcagccagctgcacgacgaggacttcctgaccagcctggtggccatcagcaagcccagaagcatggtgcccaccaagaagctgaagaagtacgagaaggagtaccagaccatgagagagagccagctgcagcaggaggaccccatggacagatacaagagagagaacagaagactgcaggaggccagcatgagactggagcaggagaacgacgacctggcccacgagctggtgaccagcaagatcgccctgagaaacgacctggaccaggccgaggacaaggccgacgtgctgaacaaggagctgctgctgaccaagcagagactggtggagaccgaggaggagaagagaaagcaggaggaggagaccgcccagctgaaggaggtgttcagaaagcagctggagaaggccgagtacgagatcaagaagaccaccgccatcatcgccgagtacaagcagatctgcagccagctgagcaccagactggagaagcagcaggccgccagcaaggaggagctggaggtggtgaagggcaagatgatggcctgcaagcactgcagcgacatcttcagcaaggagggcgccctgaagctggccgccaccggcagagaggaccagggcatcgagaccgacgacgagaaggacagcctgaagaagcagctgagagagatggagctggagctggcccagaccaagctgcagctggtggaggccaagtgcaagatccaggagctggagcaccagagaggcgccctgatgaacgagatccaggccgccaagaacagctggttcagcaagaccctgaacagcatcaagaccgccaccggcacccagcccctgcagcccgcccccgtgacccagccccccaaggagagcacctag

SEQ ID NO: 11287 - DNA, 3600 bp, Artificial Sequence; identical to SEQ ID NO: 9377
  Description of Artificial Sequence: Synthetic coding sequence

SEQ ID NO: 11288 - DNA, 2337 bp, Artificial Sequence
  Description of Artificial Sequence: Synthetic coding sequence
agaatccaggagcagctggagagcagcttcaccggcctgaccgacgagaaggtgaaggcctacctgagcctgcacccccaggtgctggacgagttcgtgagcgagagcgtgagcgccgagaccgtggagaagtggctgaagagaaagaacaacaagagcgaggacgagagcgcccccaaggaggtgagcagataccaggacaccaacatgcagggcgtggtgtacgagctgaacagctacatcgagcagagactggacaccggcggcgacaaccagctgctgctgtacgagctgagcagcatcatcaagatcgccaccaaggccgacggcttcgccctgtacttcctgggcgagtgcaacaacagcctgtgcatcttcaccccccccggcatcaaggagggcaagcccagactgatccccgccggccccatcacccagggcaccaccgtgagcgcctacgtggccaagagcagaaagaccctgctggtggaggacatcctgggcgacgagagattccccagaggcaccggcctggagagcggcaccagaatccagagcgtgctgtgcctgcccatcgtgaccgccatcggcgacctgatcggcatcctggagctgtacagacactggggcaaggaggccttctgcctgagccaccaggaggtggccaccgccaacctggcctgggccagcgtggccatccaccaggtgcaggtgtgcagaggcctggccaagcagaccgagctgaacgacttcctgctggacgtgagcaagacctacttcgacaacatcgtggccatcgacagcctgctggagcacatcatgatctacgccaagaacctggtgaacgccgacagatgcgccctgttccaggtggaccacaagaacaaggagctgtacagcgacctgttcgacatcggcgaggagaaggagggcaagcccgtgttcaagaagaccaaggagatcagattcagcatcgagaagggcatcgccggccaggtggccagaaccggcgaggtgctgaacatccccgacgcctacgccgaccccagattcaacagagaggtggacctgtacaccggctacaccaccagaaacatcctgtgcatgcccatcgtgagcagaggcagcgtgatcggcgtggtgcagatggtgaacaagatcagcggcagcgccttcagcaagaccgacgagaacaacttcaagatgttcgccgtgttctgcgccctggccctgcactgcgccaacatgtaccacagaatcagacacagcgagtgcatctacagagtgaccatggagaagctgagctaccacagcatctgcaccagcgaggagtggcagggcctgatgcagttcaccctgcccgtgagactgtgcaaggagatcgagctgttccacttcgacatcggccccttcgagaacatgtggcccggcatcttcgtgtacatggtgcacagaagctgcggcaccagctgcttcgagctggagaagctgtgcagattcatcatgagcgtgaagaagaactacagaagagtgccctaccacaactggaagcacgccgtgaccgtggcccactgcatgtacgccatcctgcagaacaaccacaccctgttcaccgacctggagagaaagggcctgctgatcgcctgcctgtgccacgacctggaccacagaggcttcagcaacagctacctgcagaagttcgaccaccccctggccgccctgtacagcaccagcaccatggagcagcaccacttcagccagaccgtgagcatcctgcagctggagggccacaacatcttcagcaccctgagcagcagcgagtacgagcaggtgctggagatcatcagaaaggccatcatcgccaccgacctggccctgtacttcggcaacagaaagcagctggaggagatgtaccagaccggcagcctgaacctgaacaaccagagccacagagacagagtgatcggcctgatgatgaccgcctgcgacctgtgcagcgtgaccaagctgtggcccgtgaccaagctgaccgccaacgacatctacgccgagttctgggccgagggcgacgagatgaagaagctgggcatccagcccatccccatgatggacagagacaagaaggacgaggtgccccagggccagctgggcttctacaacgccgtggccatcccctgctacaccaccctgacccagatcctgccccccaccgagcccctgctgaaggcctgcagagacaacctgagccagtgggagaaggtgatcagaggcgaggagaccgccacctggatcagcagccccagcgtggcccagaaggccgccgccagcgaggactag

SEQ ID NO: 11289 - DNA, 1281 bp, Artificial Sequence; identical to SEQ ID NO: 10654
  Description of Artificial Sequence: Synthetic coding sequence

SEQ ID NO: 11290 - DNA, 1779 bp, Artificial Sequence
  Description of Artificial Sequence: Synthetic coding sequence
atggacgtgatgctggagaactactgccacctgatcagcgtgggctgccacatgaccaagcccgacgtgatcctgaagctggagagaggcgaggagccctggaccagcttcgccggccacacctgcctggaggagaactggaaggccgaggacttcctggtgaagttcaaggagcaccaggagaagtacagcagaagcgtggtgagcatcaaccacaagaagctggtgaaggagaagagcaagatctacgagaagaccttcaccctgggcaagaaccccgtgaacagcaagaacctgccccccgagtacgacacccacggcagaatcctgaagaacgtgagcgagctgatcatcagcaacctgaaccccgccagaaagagactgagcgagtacaacggctacggcaagagcctgctgagcaccaagcaggagaccacccaccccgaggtgaagagccacaaccagagcgccagagccttcagccacaacgaggtgctgatgcagtaccagaagaccgagacccccgcccagagcttcggctacaacgactgcgagaagagcttcctgcagagaggcggcctgatcacccacagcagaccctacaagggcgagaaccccagcgtgtacaacaagaagagaagagccaccaacatcgagaagaagcacacctgcaacgagtgcggcaagagcttctgcagaaagagcgtgctgatcctgcaccagggcatccacagcgaggagaagccctaccagtgccaccagtgcggcaacgccttcagaagaaagagctacctgatcgaccaccagagaacccacaccggcgagaagcccttcgtgtgcaacgagtgcggcaagagcttcagactgaagaccgccctgaccgaccaccagagaacccacaccggcgagaagagctacgagtgcctgcagtgcagaaacgccttcagactgaagagccacctgatcagacaccagagaacccacaccggcgagaagccctacgagtgcaacgactgcggcaagagcttcagacagaagaccaccctgagcctgcaccagagaatccacaccggcgagaagccctacatctgcaaggagtgcggcaagagcttccaccagaaggccaacctgaccgtgcaccagagaacccacaccggcgagaagccctacatctgcaacgagtgcggcaagagcttcagccagaagaccaccctggccctgcacgagaagacccacaacgaggagaagccctacatctgcagcgagtgcggcaagagcttcagacagaagaccaccctggtggcccaccagagaacccacaccggcgagaagagctacgagtgcccccactgcggcaaggccttcagaatgaagagctacctgatcgaccaccacagaacccacaccggcgagaagccctacgagtgcaacgagtgcggcaagagcttcagccagaagaccaacctgaacctgcaccagagaatccacaccggcgagaagccctacgtgtgcaacgagtgcggcaagagcttcagacagaaggccaccctgaccgtgcaccagaagatccacaccggccagaagagctacgagtgcccccagtgcggcaaggccttcagcagaaagagctacctgatccaccaccagagaacccacaccggcgagaagccctacaagtgcagcgagtgcggcaagtgcttcagacagaagaccaacctgatcgtgcaccagagaacccacaccggcggcgaggacggcctgaccggctgcctgagctag

SEQ ID NO: 11291 - DNA, 645 bp, Artificial Sequence
  Description of Artificial Sequence: Synthetic coding sequence
atggaggtgaccggcgtgagcgcccccaccgtgaccgtgttcatcagcagcagcctgaacaccttcagaagcgagaagagatacagcagaagcctgaccatcgccgagttcaagtgcaagctggagctgctggtgggcagccccgccagctgcatggagctggagctgtacggcgtggacgacaagttctacagcaagctggaccaggaggacgccctgctgggcagctaccccgtggacgacggctgcagaatccacgtgatcgaccacagcggcgccagactgggcgagtacgaggacgtgagcagagtggagaagtacaccatcagccaggaggcctacgaccagagacaggacaccgtgagaagcttcctgaagagaagcaagctgggcagatacaacgaggaggagagagcccagcaggaggccgaggccgcccagagactggccgaggagaaggcccaggccagcagcatccccgtgggcagcagatgcgaggtgagagccgccggccagagccccagaagaggcaccgtgatgtacgtgggcgcctggctggccggccccgtgcccggcagcagagcccccagacccggcggcaacgtgggcggcaccgtggagcccagaagacccagaagcgcctag

SEQ ID NO: 11292 - DNA, 189 bp, Artificial Sequence
  Description of Artificial Sequence: Synthetic coding sequence
atgagcatccagtggaagaccagacagctgcagagcaagctgcacgaggccgacatcgtggtgctgggcagccccaagcccgaggagatccccctgacctggatccagcccggcaccaccgtgctgaactgcagccacgacttcctgagcgagagcctgatcatcatcagaagaatggccatcttctag

SEQ ID NO: 11293 - DNA, 1269 bp, Artificial Sequence
  Description of Artificial Sequence: Synthetic coding sequence
atgtaccccaaccccctgatctactgcacctgctgggacccctggaacctgggccccagaaagctgatcaagaccccccagctgcccagaaagaacagcaccggcagcagcaagctgacccccctggtgcccgcccccaagaaccacaactacctgcagcccaccaagcccgtggtgagccccaagatgaagatccacagcgccagacaggaggagaccaacaagagcttctacgaggtgatcaacgtgagccccggctaccagctggtgagaaacagagagcagatcagcgtgaccctgggcgacgagatgttcgacagaaagaagagatgggagagcgagatccccgacaagggcagattcagcagaaccaacatcatcagcgacctggaggagcagatcagcgagctgaccgccatcatcgagcagatgaacagagaccaccagagcgcccagaagctgctgagcagcgagatggacctgagatgcgccgagatgaagcagaacttcgagaacaagaacagagagctgaaggaggcccacgaggccgagctgagcgagctggagaacaactacaaggccgccctgaaggccgagaagctggccgcccaggagaagctggaggagatgggcaaggagtacaagtacctgaagaacatgttcagaacctaccaggacagcatctacgacgagatggaggagaagtggagcaagcagaaggccaagtggaagaaggacgagaagttcgagagagagaacatcctgctgcagcagaagaagaagatgaccaagaagttcgagatggagagcggcgaggaggacaagaagatcaacgagagctgcagcgccgtgttcgagaacttcatccaggagaaggaggagctgctgaagcagcaccagagcgacaccctgcagctggaggagctgagaaagaccaaggaggtgatgcaggaggagctgcacgcccaggccctgatcctggagagcctgaacaccaacctgtactacacccagctggagctgcagaaggagaaggccatcgtgggcaacctggagaagatgctgcagaccaagttcgccgagaccgaggagaagtacaagcacaccatccagatcctgaccgaggagaacatccacctgaagcagaagatcatcagcaagaacgaggagatctgcgagggctgcagcggcagactggccagcatcaccgtgagcaaggacgacagcgacaccgtgcaggacggcagcaagaagggccaggagagctag

SEQ ID NO: 11294 - DNA, 1380 bp, Artificial Sequence
  Description of Artificial Sequence: Synthetic coding sequence
atggtgcccttcggccccttcgccttcatgcccggcaagctggtgcacaccaacgaggtgaccgtgctgctgggcgacaactggttcgccaagtgcagcgccaagcaggccgtgggcctggtggagcacagaaaggagcacgtgagaaagaccatcgacgacctgaagaaggtgatgaagaacttcgagagcagagtggagttcaccgaggacctgcagaagatgagcgacgccgccggcgacatcgtggacatcagagaggagatcaagtgcgacttcgagttcaaggccaagcacagaatcgcccacaagccccacagcaagcccaagaccagcgacatcttcgaggccgacatcgccaacgacgtgaagagcaaggacctgctggccgacaaggagctgtgggccagactggaggagctggagagacaggaggagctgctgggcgagctggacagcaagcccgacaccgtgatcgccaacggcgaggacaccaccagcagcgaggaggagaaggaggacagaaacaccaacgtgaacgccatgcaccaggtgaccgacagccacaccccctgccacaaggacgtggccagcagcgagcccttcagcggccaggtgaacagccagctgaactgcagcgtgaacggcagcagcagctaccacagcgacgacgacgacgacgacgacgacgacgacgacgacgacaacatcgacgacgacgacggcgacaacgaccacgaggccctgggcgtgggcgacaacagcatccccaccatctacttcagccacaccgtggagcccaagagagtgagaatcaacaccggcaagaacaccaccctgaagttcagcgagaagaaggaggaggccaagagaaagagaaagaacagcaccggcagcggccacagcgcccaggagctgcccaccatcagaacccccgccgacatctacagagccttcgtggacgtggtgaacggcgagtacgtgcccagaaagagcatcctgaagagcagaagcagagagaacagcgtgtgcagcgacaccagcgagagcagcgccgccgagttcgacgacagaagaggcgtgctgagaagcatcagctgcgaggaggccacctgcagcgacaccagcgagagcatcctggaggaggagccccaggagaaccagaagaagctgctgcccctgagcgtgacccccgaggccttcagcggcaccgtgatcgagaaggagttcgtgagccccagcctgacccccccccccgccatcgcccaccccgccctgcccaccatccccgagagaaaggaggtgctgctggaggccagcgaggagaccggcaagagagtgagcaagttcaaggccgccagactgcagcagaaggactag

SEQ ID NO: 11295 - DNA, 1068 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcagctaccacggcgacagcgacctgcagctgctgacccacagcctgggcggcggcaccggcagcggcatgggcaccctgctgatcagcaagatcagagaggagtaccccgacagaatcatgaacaccttcagcgtgatgcccagccccaaggtgagcgacaccgtggtggagccctacaacgccaccctgagcgtgcaccagctggtggagaacaccgacgagacctacagcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacagcaagaacatgatggccgcctgcgaccccagacacggcagatacctgaccgtggccgccatcttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatgagcgccaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgacgagcagggcgagttcgaggaggaggagggcgaggacgaggcctag

SEQ ID NO: 11296 - DNA, 255 bp, Artificial Sequence; identical to SEQ ID NO: 10297
  Description of Artificial Sequence: Synthetic coding sequence

SEQ ID NO: 11297 - DNA, 1416 bp, Artificial Sequence
  Description of Artificial Sequence: Synthetic coding sequence
atgaagatgcaggtgttctgcaagagcatcgaggacatgaccgtgaaggccgagcagagccagcaggaggccgccaagaagcacgaggaggagaagaaggagctggagagaaagctgagcgacctggagaagaagatggagaccagccacaaccagtgccaggagctgaaggccagatacgagagagccaccagcgagaccaagaccaagcacgaggagatcctgcagaacctgcagaagaccctgctggacaccgaggacaagctgaagggcgccagagaggagaacagcggcctgctgcaggagctggaggagctgagaaagcaggccgacaaggccaaggccgcccagaccgccgaggacgccatgcagatcatggagcagatgaccaaggagaagaccgagaccctggccagcctggaggacaccaagcagaccaacgccaagctgcagaacgagctggacaccctgaaggagaacaacctgaagaacgtggaggagctgaacaagagcaaggagctgctgaccgtggagaaccagaagatggaggagttcagaaaggagatcgagaccctgaagcaggccgccgcccagaagagccagcagctgagcgccctgcaggaggagaacgtgaagctggccgaggagctgggcagaagcagagacgaggtgaccagccaccagaagctggaggaggagagaagcgtgctgaacaaccagctgctggagatgaagaagagagagagcaagttcatcaaggacgccgacgaggagaaggccagcctgcagaagagcatcagcatcaccagcgccctgctgaccgagaaggacgccgagctggagaagctgagaaacgaggtgaccgtgctgagaggcgagaacgccagcgccaagagcctgcacagcgtggtgcagaccctggagagcgacaaggtgaagctggagctgaaggtgaagaacctggagctgcagctgaaggagaacaagagacagctgagcagcagcagcggcaacaccgacacccaggccgacgaggacgagagagcccaggagagccaggtgatgatcgacttcctgaacagcgtgatcgtggacctgcagagaaagaaccaggacctgaagatgaaggtggagatgatgagcgaggccgccctgaacggcaacggcgacgacctgaacaactacgacagcgacgaccaggagaagcagagcaagaagaagcccagactgttctgcgacatctgcgactgcttcgacctgcacgacaccgaggactgccccacccaggcccagatgagcgaggaccccccccacagcacccaccacggcagcagaggcgaggagagaccctactgcgagatctgcgagatgttcggccactgggccaccaactgcaacgacgacgagaccttctag

SEQ ID NO: 11298 - DNA, 1602 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagctgcacccctgggtgaccagacacggcgccgagcccctgcccagcgaggacgagaactgcaccctggtggaggtgaccgaggaggaggtggagaacagcgtgaagcacatccccagcctggccaccgtgatcctggtgaagaccatgatcagaaagagaagcttcggcaaccccttcgagggcagcagaagagaggagagaagcctgagcgcccccggcaacctgctgaccaagaagcccaccagagagtgcgagagcctgagcgagctgaagacctag

SEQ ID NO: 11299 - DNA, 1671 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagctgcacccctgggtgaccagacacggcgccgagcccctgcccagcgaggacgagaactgcaccctggtggaggtgaccgaggaggaggtggagaacagcgtgaagcacatccccagcctggccaccgtgatcctggtgaagaccatgatcagaaagagaagcttcggcaaccccttcgagggcagcagaagagaggagagaagcctgagcgcccccggcaacctgctgaccaagaagcccaccagagagtgcgagagcctgagcgagctgaagggcaccaagaagaagaagggcctggacagcatgaccagcaccgtggccgccggctggctggacagaagagtgtag

SEQ ID NO: 11300 - DNA, 309 bp, Artificial Sequence
  Description of Artificial Sequence: Synthetic coding sequence
atgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagaagaaagtag

SEQ ID NO: 11301 - DNA, 615 bp, Artificial Sequence
  Description of Artificial Sequence: Synthetic coding sequence
atggaggccgagcccaagggcctgctggagaccgagcccctgcagggcaccgacgaggacgccgtggccagcgccgacttcagcagcatgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagctacagcatcagacacagcatcagcatgcccgccatgagaaacagccccaccttcaagagcttcgaggagagagtggagaccaccgtgaccagcctgaagaccaaggtgggcggcaccaaccccaacggcggcagcttcgaggaggtgctgagcagcaccgcccacgccagcgcccagagcctggccggcggcagcagaagaaccaaggaggaggagctgcagtgctag

SEQ ID NO: 11302 - DNA, 369 bp, Artificial Sequence
  Description of Artificial Sequence: Synthetic coding sequence
tgatacctggtggccctgggctgcatcaagcccctgtgcgacctgctgaccgtgatggacagcaagatcgtgcaggtggccctgaacggcctggagaacatcctgagactgggcgagcaggagagcaagcagaacggcatcggcatcaacccctactgcgccctgatcgaggaggcctacggcctggacaagatcgagttcctgcagagccacgagaaccaggagatctaccagaaggccttcgacctgatcgagcactacttcggcgtggaggaggacgaccccagcatcgtgccccaggtggacgagaaccagcagcagttcatcttccagcagcaggaggcccccatggacggcttccagctgtag

SEQ ID NO: 11303 - DNA, 1137 bp, Artificial Sequence
  Description of Artificial Sequence: Synthetic coding sequence
atggaggtgaagcccccccccggcagaccccagcccgacagcggcagaagaagaagaagaagaggcgaggagggccacgaccccaaggagcccgagcagctgagaaagctgttcatcggcggcctgagcttcgagaccaccgacgacagcctgagagagcacttcgagaagtggggcaccctgaccgactgcgtggtgatgagagacccccagaccaagagaagcagaggcttcggcttcgtgacctacagctgcgtggaggaggtggacgccgccatgtgcgccagaccccacaaggtggacggcagagtggtggagcccaagagagccgtgagcagagaggacagcgtgaagcccggcgcccacctgaccgtgaagaagatcttcgtgggcggcatcaaggaggacaccgaggagtacaacctgagagactacttcgagaagtacggcaagatcgagaccatcgaggtgatggaggacagacagagcggcaagaagagaggcttcgccttcgtgaccttcgacgaccacgacaccgtggacaagatcgtggtgcagaagtaccacaccatcaacggccacaactgcgaggtgaagaaggccctgagcaagcaggagatgcagagcgccggcagccagagaggcagaggcggcggcagcggcaacttcatgggcagaggcggcaacttcggcggcggcggcggcaacttcggcagaggcggcaacttcggcggcagaggcggctacggcggcggcggcggcggcagcagaggcagctacggcggcggcgacggcggctacaacggcttcggcggcgacggcggcaactacggcggcggccccggctacagcagcagaggcggctacggcggcggcggccccggctacggcaaccagggcggcggctacggcggcggcggcggctacgacggctacaacgagggcggcaacttcggcggcggcaactacggcggcggcggcaactacaacgacttcggcaactacagcggccagcagcagagcaactacggccccatgaagggcggcagcttcggcggcagaagcagcggcagcccctacggcggcggctacggcagcggcggcggcagcggcggctacggcagcagaagattctag

SEQ ID NO: 11304 - DNA, 3063 bp, Artificial Sequence
  Description of Artificial Sequence: Synthetic coding sequence
atgagaagattcctgagacccggccacgaccccgtgagagagagactgaagagagacctgttccagttcaacaagaccgtggagcacggcttcccccaccagcccagcgccctgggctacagccccagcctgagaatcctggccatcggcaccagaagcggcgccatcaagctgtacggcgcccccggcgtggagttcatgggcctgcaccaggagaacaacgccgtgacccagatccacctgctgcccggccagtgccagctggtgaccctgctggacgacaacagcctgcacctgtggagcctgaaggtgaagggcggcgccagcgagctgcaggaggacgagagcttcaccctgagaggcccccccggcgccgcccccagcgccacccagatcaccgtggtgctgccccacagcagctgcgagctgctgtacctgggcaccgagagcggcaacgtgttcgtggtgcagctgcccgccttcagagccctggaggacagaaccatcagcagcgacgccgtgctgcagagactgcccgaggaggccagacacagaagagtgttcgagatggtggaggccctgcaggagcaccccagagaccccaaccagatcctgatcggctacagcagaggcctggtggtgatctgggacctgcagggcagcagagtgctgtaccacttcctgagcagccagcagctggagaacatctggtggcagagagacggcagactgctggtgagctgccacagcgacggcagctactgccagtggcccgtgagcagcgaggcccagcagcccgagcccctgagaagcctggtgccctacggccccttcccctgcaaggccatcaccagaatcctgtggctgaccaccagacagggcctgcccttcaccatcttccagggcggcatgcccagagccagctacggcgacagacactgcatcagcgtgatccacgacggccagcagaccgccttcgacttcaccagcagagtgatcggcttcaccgtgctgaccgaggccgaccccgccgccaccttcgacgacccctacgccctggtggtgctggccgaggaggagctggtggtgatcgacctgcagaccgccggctggccccccgtgcagctgccctacctggccagcctgcactgcagcgccatcacctgcagccaccacgtgagcaacatccccctgaagctgtgggagagaatcatcgccgccggcagcagacagaacgcccacttcagcaccatggagtggcccatcgacggcggcaccagcctgacccccgcccccccccagagagacctgctgctgaccggccacgaggacggcaccgtgagattctgggacgccagcggcgtgtgcctgagactgctgtacaagctgagcaccgtgagagtgttcctgaccgacaccgaccccaacgagaacttcagcgcccagggcgaggacgagtggccccccctgagaaaggtgggcagcttcgacccctacagcgacgaccccagactgggcatccagaagatcttcctgtgcaagtacagcggctacctggccgtggccggcaccgccggccaggtgctggtgctggagctgaacgacgaggccgccgagcaggccgtggagcaggtggaggccgacctgctgcaggaccaggagggctacagatggaagggccacgagagactggccgccagaagcggccccgtgagattcgagcccggcttccagcccttcgtgctggtgcagtgccagccccccgccgtggtgaccagcctggccctgcacagcgagtggagactggtggccttcggcaccagccacggcttcggcctgttcgaccaccagcagagaagacaggtgttcgtgaagtgcaccctgcaccccagcgaccagctggccctggagggccccctgagcagagtgaagagcctgaagaagagcctgagacagagcttcagaagaatgagaagaagcagagtgagcagcagaaagagacaccccgccggcccccccggcgaggcccaggagggcagcgccaaggccgagagacccggcctgcagaacatggagctggcccccgtgcagagaaagatcgaggccagaagcgccgaggacagcttcaccggcttcgtgagaaccctgtacttcgccgacacctacctgaaggacagcagcagacactgccccagcctgtgggccggcaccaacggcggcaccatctacgccttcagcctgagagtgccccccgccgagagaagaatggacgagcccgtgagagccgagcaggccaaggagatccagctgatgcacagagcccccgtggtgggcatcctggtgctggacggccacagcgtgcccctgcccgagcccctggaggtggcccacgacctgagcaagagccccgacatgcagggcagccaccagctgctggtggtgagcgaggagcagttcaaggtgttcaccctgcccaaggtgagcgccaagctgaagctgaagctgaccgccctggagggcagcagagtgagaagagtgagcgtggcccacttcggcagcagaagagccgaggactacggcgagcaccacctggccgtgctgaccaacctgggcgacatccaggtggtgagcctgcccctgctgaagccccaggtgagatacagctgcatcagaagagaggacgtgagcggcatcgccagctgcgtgttcaccaagtacggccagggcttctacctgatcagccccagcgagttcgagagattcagcctgagcaccaagtggctggtggagcccagatgcctggtggacagcgccgagaccaagaaccacagacccggcaacggcgccggccccaagaaggcccccagcagagccagaaacagcggcacccagagcgacggcgaggagaagcagcccggcctggtgatggagagagccctgctgagcgacgagagagtgctgaaggagatccagagcaccctggagggcgacagaggcagcggcaactggagaagccacagagccgccgtgggctgcagcctgagcaacggcggcgccgagtag

SEQ ID NO: 11305 - DNA, 1458 bp, Artificial Sequence
  Description of Artificial Sequence: Synthetic coding sequence
atggccgccgagctgtacgcccccgccagcgccgccgccgccgacctggccaacagcaacgccggcgccgccgtgggcagaaaggccggccccagaagcccccccagcgcccccgcccccgccccccccccccccgcccccgccccccccaccctgggcaacaaccaccaggagagccccggctggagatgctgcagacccaccctgagagagagaaacgccctgatgttcaacaacgagctgatggccgacgtgcacttcgtggtgggcccccccggcgccaccagaaccgtgcccgcccacaagtacgtgctggccgtgggcagcagcgtgttctacgccatgttctacggcgacctggccgaggtgaagagcgagatccacatccccgacgtggagcccgccgccttcctgatcctgctgaagtacatgtacagcgacgagatcgacctggaggccgacaccgtgctggccaccctgtacgccgccaagaagtacatcgtgcccgccctggccaaggcctgcgtgaacttcctggagaccagcctggaggccaagaacgcctgcgtgctgctgagccagagcagactgttcgaggagcccgagctgacccagagatgctgggaggtgatcgacgcccaggccgagatggccctgagaagcgagggcttctgcgagatcgacagacagaccctggagatcatcgtgaccagagaggccctgaacaccaaggaggccgtggtgttcgaggccgtgctgaactgggccgaggccgagtgcaagagacagggcctgcccatcacccccagaaacaagagacacgtgctgggcagagccctgtacctggtgagaatccccaccatgaccctggaggagttcgccaacggcgccgcccagagcgacatcctgaccctggaggagacccacagcatcttcctgtggtacaccgccaccaacaagcccagactggacttccccctgaccaagagaaagggcctggccccccagagatgccacagattccagagcagcgcctacagaagcaaccagtggagatacagaggcagatgcgacagcatccagttcgccgtggacagaagagtgttcatcgccggcctgggcctgtacggcagcagcagcggcaaggccgagtacagcgtgaagatcgagctgaagagactgggcgtggtgctggcccagaacctgaccaagttcatgagcgacggcagcagcaacaccttccccgtgtggttcgagcaccccgtgcaggtggagcaggacaccttctacaccgccagcgccgtgctggacggcagcgagctgagctacttcggccaggagggcatgaccgaggtgcagtgcggcaaggtggccttccagttccagtgcagcagcgacagcaccaacggcaccggcgtgcagggcggccagatccccgagctgatcttctacgcctag

SEQ ID NO: 11306 - DNA, 2883 bp, Artificial Sequence; identical to SEQ ID NO: 9420
  Description of Artificial Sequence: Synthetic coding sequence

SEQ ID NO: 11307 - DNA, 669 bp, Artificial Sequence
  Description of Artificial Sequence: Synthetic coding sequence
atggagagaatcgagggcgccagcgtgggcagatgcgccgccagcccctacctgagacccctgaccctgcactacagacagaacggcgcccagaagagctgggacttcatgaagacccacgacagcgtgaccgtgctgctgttcaacagcagcagaagaagcctggtgctggtgaagcagttcagacccgccgtgtacgccggcgaggtggagagaagattccccggcagcctggccgccgtggaccaggacggccccagagagctgcagcccgccctgcccggcagcgccggcgtgaccgtggagctgtgcgccggcctggtggaccagcccggcctgagcctggaggaggtggcctgcaaggaggcctgggaggagtgcggctaccacctggcccccagcgacctgagaagagtggccacctactggagcggcgtgggcctgaccggcagcagacagaccatgttctacaccgaggtgaccgacgcccagagaagcggccccggcggcggcctggtggaggagggcgagctgatcgaggtggtgcacctgcccctggagggcgcccaggccttcgccgacgaccccgacatccccaagaccctgggcgtgatcttcggcgtgagctggttcctgagccaggtggcccccaacctggacctgcagtag

SEQ ID NO: 11308 - DNA, 876 bp, Artificial Sequence
  Description of Artificial Sequence: Synthetic coding sequence
atgaacatgatctggagaaacagcatcagctgcctgagactgggcaaggtgccccacagataccagagcggctaccaccccgtggcccccctgggcagcagaatcctgaccgaccccgccaaggtgttcgagcacaacatgtgggaccacatgcagtggagcaaggaggaggaggccgccgccagaaagaaggtgaaggagaacagcgccgtgagagtgctgctggaggagcaggtgaagtacgagagagaggccagcaagtactgggacaccttctacaagatccacaagaacaagttcttcaaggacagaaactggctgctgagagagttccccgagatcctgcccgtggaccagaagcccgaggagaaggccagagagagcagctgggaccacgtgaagaccagcgccaccaacagattcagcagaatgcactgccccaccgtgcccgacgagaagaaccactacgagaagagcagcggcagcagcgagggccagagcaagaccgagagcgacttcagcaacctggacagcgagaagcacaagaagggccccatggagaccggcctgttccccggcagcaacgccaccttcagaatcctggaggtgggctgcggcgccggcaacagcgtgttccccatcctgaacaccctggagaacagccccgagagcttcctgtactgctgcgacttcgccagcggcgccgtggagctggtgaagagccacagcagctacagagccacccagtgcttcgccttcgtgcacgacgtgtgcgacgacggcctgccctaccccttccccgacggcatcctggacgtgatcctgctggtgttcgtgctgagcagcatccaccccgacagaaccctgttcatctag

SEQ ID NO: 11309 - DNA, 630 bp, Artificial Sequence; identical to SEQ ID NO: 9403
  Description of Artificial Sequence: Synthetic coding sequence

SEQ ID NO: 11310 - DNA, 504 bp, Artificial Sequence
  Description of Artificial Sequence: Synthetic coding sequence
atgcccgcctaccacagcagcctgatggaccccgacaccaagctgatcggcaacatggccctgctgcccatcagaagccagttcaagggccccgcccccagagagaccaaggacaccgacatcgtggacgaggccatctactacttcaaggccaacgtgttcttcaagaactacgagatcaagaacgaggccgacagaaccctgatctacatcaccctgtacatcagcgagtgcctgaagaagctgcagaagtgcaacagcaagagccagggcgagaaggagatgtacaccctgggcatcaccaacttccccatccccggcgagcccggcttccccctgaacgccatctacgccaagcccgccaacaagcaggaggacgaggtgatgagagcctacctgcagcagctgagacaggagaccggcctgagactgtgcgagaaggtgatcaagggcgacctgaagttcagcgccgccctgaagctggccctgaacaagaacaagtag

SEQ ID NO: 11311 - DNA, 4074 bp, Artificial Sequence; identical to SEQ ID NO: 10560
  Description of Artificial Sequence: Synthetic coding sequence

SEQ ID NO: 11312 - DNA, 288 bp, Artificial Sequence
  Description of Artificial Sequence: Synthetic coding sequence
atgctgaagaacaagggccacagcagcaagaaggacaacctggccgtgaacgccgtggccctgcaggaccacatcctgcacgacctgcagctgagaaacctgagcgtggccgaccacagcaagacccaggtgcagaagaaggagaacaagagcctgaagagagacaccaaggccatcatcgacaccggcctgaagaagaccacccagtgccccaagctggaggacagcgagaaggagtacgtgctggaccccaagcccccccccctgaccctgggctaccacagctag

SEQ ID NO: 11313 - DNA, 708 bp, Artificial Sequence
  Description of Artificial Sequence: Synthetic coding sequence
atgctgaagaacaagggccacagcagcaagaaggacaacctggccgtgaacgccgtggccctgcaggaccacatcctgcacgacctgcagctgagaaacctgagcgtggccgaccacagcaagacccaggtgcagaagaaggagaacaagagcctgaagagagacaccaaggccatcatcgacaccggcctgaagaagaccacccagtgccccaagctggaggacagcgagaaggagtacgtgctggaccccaagcccccccccctgaccctggcccagaagctgggcctgatcggccccccccccccccccctgagcagcgacgagtgggagaaggtgaagcagagaagcctgctgcagggcgacagcgtgcagccctgccccatctgcaaggaggagttcgagctgagaccccaggtgctgctgagctgcagccacgtgttccacaaggcctgcctgcaggccttcgagaagttcaccaacaagaagacctgccccctgtgcagaaagaaccagtaccagaccagagtgatccacgacggcgccagactgttcagaatcaagtgcgtgaccagaatccaggcctactggagaggctgcgtggtgagaaagtggtacagaaacctgagaaagaccgtgccccccaccgacgccaagctgagaaagaagttcttcgagaagaagacccaggactggaagcccgcctag

SEQ ID NO: 11314 - DNA, 1089 bp, Artificial Sequence; identical to SEQ ID NO: 9912
  Description of Artificial Sequence: Synthetic coding sequence

SEQ ID NO: 11315 - DNA, 1278 bp, Artificial Sequence; identical to SEQ ID NO: 9384
  Description of Artificial Sequence: Synthetic coding sequence

SEQ ID NO: 11316 - DNA, 639 bp, Artificial Sequence
  Description of Artificial Sequence: Synthetic coding sequence
atggccccctggggcaagagactggccggcgtgagaggcgtgctgctggacatcagcggcgtgctgtacgacagcggcgccggcggcggcaccgccatcgccggcagcgtggaggccgtggccagactgaagagaagcagactgaaggtgagattctgcaccaacgagagccagaagagcagagccgagctggtgggccagctgcagagactgggcttcgacatcagcgagcaggaggtgaccgcccccgcccccgccgcctgccagatcctgaaggagcagggcctgagaccctacctgctgatccacgacggcgtgagaagcgagttcgaccagatcgacaccagcaaccccaactgcgtggtgatcgccgacgccggcgagagcttcagctaccagaacatgaacaacgccttccaggtgctgatggagctggagaagcccgtgctgatcagcctgggcaagggcagatactacaaggagaccagcggcctgatgctggacgtgggcccctacatgaaggccctggagtacgcctgcggcatcaaggccgaggtggtgggcaagcccagccccgagttcttcaagagcgccctgcaggccatcggcgtggaggcccaccagctgctgagcgtgtag

SEQ ID NO: 11317 - DNA, 2868 bp, Artificial Sequence
  Description of Artificial Sequence: Synthetic coding sequence
atggaggtgggcagcgaggaggagaagtgggagaagctggacgccgagttcgaccacttcgtggtggacatgaagcccttcgtgctgaagctgccccacagaaccgagagacagagatgcgccctgtggatcagaaagctgtgcgagcccagcggcaccggcgccggcatcatgggcagaaagaacagaaacctgtacgccaagctgctgctgcacatgctgaagagaggcgccctggagggccccttcacccacagacccgagcccggcaccctgaagatcctgcccagctacatgagcatctacttcgacgagcccaaccccgccagagccaagggcagcagccccgagggcctgcccgcctgggtgctgggcgagctggagaccagcgagcacaagctgaacgagagctggaagctgagcagcggcgaggacaacaccctggtgcagagccccaccgacgtgtacagcagagagcagtacaccggcaagctgagagtgagaagccacagcctgagccccacccacagagaggacggccagaacatcacccccaagatctgcgaggtgtacagcaagaagagccccgtgagcctggacgacagcgacatcgaggccagactgaacagctggaacctgggcatcgagaaccccagatacctgagacagaagcccatccccgtgagcctgatgacccccaagttcagcctgagaaagagcagcagcttccacgacgaccacttcctgagcagaatcagagagaaggagctggacatgaagaccaagatgatggaggccaagttccacgaggagaagctgaagctgcagcagaagcacgacgccgacgtgcagaagatcctggagagaaagaacaacgagatcgaggagctgaagaccctgtacagaagcaagcagcacgagaccgaggagaccatcagaaagctggagaagaaggtgcagaccctgatcagagactgccaggtgatcagagagaccaaggaggaccagatcgccgagctgaagaagatctgcgagcagagcaccgagagcctgaacaacgactgggagaagaagctgcacaacgccgtggccgagatggagcaggagaagttcgacctgcagaagcagcacaccgagaacatccaggagctgctggaggacaccaacgtgagactgaacaagatggagagcgagtacatggcccagacccagagcaccaaccacatgatcaaggagctggaggccagagtgcagcagctgaccggcgaggccgagaacagcaacctgcagagacagaagctgatccaggagaaggccgagctggagagatgctaccagatcacctgcagcgagctgcaggaggtgaaggccagaagaaacaccctgcacaaggagaaggaccacctggtgaacgactacgagcagaacatgaagctgctgcagaccaagtacgacgccgacatcaacctgctgaagcaggagcacgccctgagcgccagcaaggccagcagcatgatcgaggagctggagcagaacgtgtgccagctgaagcagcagctgcaggagagcgagctgcagagaaagcagcagctgagagaccaggagaacaagttccagatggagaagagccacctgaagcacatctacgagaagaaggcccacgacctgcagagcgagctggacaagggcaaggaggacacccagaagaagatccacaagttcgaggaggccctgaaggagaaggaggagcagctgaccagagtgaccgaggtgcagagactgcaggcccagcaggccgacgccgccctggaggagttcaagagacaggtggagctgaacagcgagaaggtgtacgccgagatgaaggagcagatggagaaggtggaggccgacctgaccagaagcaagagcctgagagagaagcagagcaaggagttcctgtggcagctggaggacatcagacagagatacgagcagcagatcgtggagctgaagctggagcacgagcaggagaagacccacctgctgcagcagcacaacgccgagaaggacagcctggtgagagaccacgagagagagatcgagaacctggagaagcagctgagagccgccaacatggagcacgagaaccagatccaggagttcaagaagagagacgcccaggtgatcgccgacatggaggcccaggtgcacaagctgagagaggagctgatcaacgtgaacagccagagaaagcagcagctggtggagctgggcctgctgagagaggaggagaagcagagagccaccagagagcacgagatcgtggtgaacaagctgaaggccgagagcgagaagatgaagatcgagctgaagaagacccacgccgccgagaccgagatgaccctggagaaggccaacagcaagctgaagcagatcgagaaggagtacacccagaagctggccaagagcagccagatcatcgccgagctgcagaccaccatcagcagcctgaaggaggagaacagccagcagcagctggccgccgagagaagactgcaggacgtgagacagaagttcgaggacgagaagaagcagctgatcagagacaacgaccaggccatcaaggtgctgcaggacgagctggagaacagaagcaaccaggtgagatgcgccgagaagaagctgcagcacaaggagctggagagccaggagcagatcacctacatcagacaggagtacgagaccaagctgaagggcctgatgcccgccagcctgagacaggagctggaggacaccatcagcagcctgaagagccaggtgaacttcctgcagaagagagccagcatcctgcaggaggagctgaccacctaccagggcagaagatag

SEQ ID NO: 11318 - DNA, 1269 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaaggagggcgacgactacgaggtgatccccaacagcaacttctacgtgagcagaaccgcctgcagagacaacaccagcgtgtaccacatcagcggcaagaagaagaccttcaaggacgtgggcaacctgctgagaagccacggcatcgacctggaccacaacagattcctgatcctgcagggcgaggtggagcagatcgccatgatgaagcccaagggccagaccgagcacgacgagggcatgctggagtacctggaggacatcatcggctgcggcagactgaacgagcccatcaaggtgctgtgcagaagagtggagatcctgaacgagcacagaggcgagaagctgaacagagtgaagatggtggagaaggagaaggacgccctggagggcgagaagaacatcgccatcgagttcctgaccctggagaacgagatcttcagaaagaagaaccacgtgtgccagtactacatctacgagctgcagaagagaatcgccgagatggagacccagaaggagaagatccacgaggacaccaaggagatcaacgagaagagcaacatcctgagcaacgagatgaaggccaagaacaaggacgtgaaggacaccgagaagaagctgaacaagatcaccaagttcatcgaggagaacaaggagaagttcacccagctggacctggaggacgtgcaggtgagagagaagctgaagcacgccaccagcaaggccaagaccggcgagaccaccagcaagagaaagaagtag

SEQ ID NO: 11319 - DNA, 303 bp, Artificial Sequence
  Description of Artificial Sequence: Synthetic coding sequence
atgagaaagagactgagcgcccccgagctgagactgagcctgaccaagggccccggcaacgacggcgccagccccacccagagcgcccccagcagccccgacggcagcagcgacctggagatcgacgagctggagacccccagcgacagcgagcagctggacagcggccacgagttcgagtgggaggacgagctgcccagagccgagggcctgggcaccagcgagaccgccgagagactgggcagaggctgcatgtgggacgtgaccggcgaggacggccaccactggagagtgttcagatag

SEQ ID NO: 11320 - DNA, 1059 bp, Artificial Sequence
  Description of Artificial Sequence: Synthetic coding sequence
atgggcaaggtggagaacagcaagagcgcccagggcctggccggcctgagaaacctgggcaacacctgcttcatgaacagcatcctgcagtgcctgagcaacaccagagagctgagagactactgcctgcagagactgtacatgagagacctgcaccacggcagcaacgcccacaccgccctggtggaggagttcgccaagctgatccagaccatctggaccagcagccccaacgacgtggtgagccccagcgagttcaagacccagatccagagatacgcccccagattcgtgggctacaaccagcaggacgcccaggagttcctgagattcctgctggacggcctgcacaacgaggtgaacagagtgaccctgagacccaagagcaaccccgagaacctggaccacctgcccgacgacgagaagggcagacagatgtggagaaagtacctggagagagaggacagcagaatcggcgacctgttcgtgggccagctgaagagcagcctgacctgcaccgactgcggctactgcagcaccgtgttcgaccccttctgggacctgagcctgcccatcgccaagagaggctaccccgaggtgaccctgatggactgcatgagactgttcaccaaggaggacgtgctggacggcgacgagaagcccacctgctgcagatgcagaggcagaaagagatgcatcaagaagttcagcatccagagattccccaagatcctggtgctgcacctgaagagattcagcgagagcagaatcagaaccagcaagctgaccaccttcgtgaacttccccctgagagacctggacctgagagagttcgccagcgagaacaccaaccacgccgtgtacaacctgtacgccgtgagcaaccacagcggcaccaccatgggcggccactacaccgcctactgcagaagccccggcaccggcgagtggcacaccttcaacgacagcagcgtgacccccatgagcagcagccaggtgagaaccagcgacgcctacctgctgttctacgagctggccagcccccccagcagaatgtag

SEQ ID NO: 11321 - DNA, 1497 bp, Artificial Sequence
  Description of Artificial Sequence: Synthetic coding sequence
atggtgatcgaggaggtgaacttcatgcagaaccacctggagatcgagaagacctgcagagagagcgccgaggccctggccaccaagctgaacaaggagaacaagaccctgaagagaatcagcatgctgtacatggccaagctgggccccgacgtgatcaccgaggagatcaacatcgacgacgaggacagcaccaccgacaccgacggcgccgccgagacctgcgtgagcgtgcagtgccagaagcagatcaaggagctgagagaccagatcgtgagcgtgcaggaggagaagaagatcctggccatcgagctggagaacctgaagagcaagctggtggaggtgatcgaggaggtgaacaaggtgaagcaggagaagaccgtgctgaacagcgaggtgctggagcagagaaaggtgctggagaagtgcaacagagtgagcatgctggccgtggaggagtacgaggagatgcaggtgaacctggagctggagaaggacctgagaaagaaggccgagagcttcgcccaggagatgttcatcgagcagaacaagctgaagagacagagccacctgctgctgcagagcagcatccccgaccagcagctgctgaaggccctggacgagaacgccaagctgacccagcagctggaggaggagagaatccagcaccagcagaaggtgaaggagctggaggagcagctggagaacgagaccctgcacaaggagatccacaacctgaagcagcagctggagctgctggaggaggacaagaaggagctggagctgaagtaccagaacagcgaggagaaggccagaaacctgaagcacagcgtggacgagctgcagaagagagtgaaccagagcgagaacagcgtgcccccccccccccccccccccccccccctgcccccccccccccccaaccccatcagaagcctgatgagcatgatcagaaagagaagccaccccagcggcagcggcgccaagaaggagaaggccacccagcccgagaccaccgaggaggtgaccgacctgaagagacaggccgtggaggagatgatggacagaatcaagaagggcgtgcacctgagacccgtgaaccagaccgccagacccaagaccaagcccgagagcagcaagggctgcgagagcgccgtggacgagctgaagggcatcctgggcaccctgaacaagagcaccagcagcagaagcctgaagagcctggaccccgagaacagcgagaccgagctggagagaatcctgagaagaagaaaggtgaccgccgaggccgacagcagcagccccaccggcatcctggccaccagcgagagcaagagcatgcccgtgctgggcagcgtgagcagcgtgaccaagaccgccctgaacaagaagaccctggaggccgagttcaacagccccagcccccccacccccgagcccggcgagggccccagaaagctggagggctgcaccagcagcaaggtgaccttccagtag

SEQ ID NO: 11322 - DNA, 1950 bp, Artificial Sequence
  Description of Artificial Sequence: Synthetic coding sequence
atgaacagcagcgacgaggagaagcagctgcagctgatcaccagcctgaaggagcaggccatcggcgagtacgaggacctgagagccgagaaccagaagaccaaggagaagtgcgacaagatcagacaggagagagacgaggccgtgaagaagctggaggagttccagaagatcagccacatggtgatcgaggaggtgaacttcatgcagaaccacctggagatcgagaagacctgcagagagagcgccgaggccctggccaccaagctgaacaaggagaacaagaccctgaagagaatcagcatgctgtacatggccaagctgggccccgacgtgatcaccgaggagatcaacatcgacgacgaggacagcaccaccgacaccgacggcgccgccgagacctgcgtgagcgtgcagtgccagaagcagatcaaggagctgagagaccagatcgtgagcgtgcaggaggagaagaagatcctggccatcgagctggagaacctgaagagcaagctggtggaggtgatcgaggaggtgaacaaggtgaagcaggagaagaccgtgctgaacagcgaggtgctggagcagagaaaggtgctggagaagtgcaacagagtgagcatgctggccgtggaggagtacgaggagatgcaggtgaacctggagctggagaaggacctgagaaagaaggccgagagcttcgcccaggagatgttcatcgagcagaacaagctgaagagacagagccacctgctgctgcagagcagcatccccgaccagcagctgctgaaggccctggacgagaacgccaagctgacccagcagctggaggaggagagaatccagcaccagcagaaggtgaaggagctggaggagcagctggagaacgagaccctgcacaaggagatccacaacctgaagcagcagctggagctgctggaggaggacaagaaggagctggagctgaagtaccagaacagcgaggagaaggccagaaacctgaagcacagcgtggacgagctgcagaagagagtgaaccagagcgagaacagcgtgcccccccccccccccccccccccccccctgcccccccccccccccaaccccatcagaagcctgatgagcatgatcagaaagagaagccaccccagcggcagcggcgccaagaaggagaaggccacccagcccgagaccaccgaggaggtgaccgacctgaagagacaggccgtggaggagatgatggacagaatcaagaagggcgtgcacctgagacccgtgaaccagaccgccagacccaagaccaagcccgagagcagcaagggctgcgagagcgccgtggacgagctgaagggcatcctgggcaccctgaacaagagcaccagcagcagaagcctgaagagcctggaccccgagaacagcgagaccgagctggagagaatcctgagaagaagaaaggtgaccgccgaggccgacagcagcagccccaccggcatcctggccaccagcgagagcaagagcatgcccgtgctgggcagcgtgagcagcgtgaccaagaccgccctgaacaagaagaccctggaggccgagttcaacagccccagcccccccacccccgagcccggcgagggccccagaaagctggagggctgcaccagcagcaaggtgaccttccagccccccagcagcatcggctgcagaaagaagtacatcgacggcgagaagcaggccgagcccgtggtggtgctggaccccgtgagcacccacgagccccagaccaaggaccaggtggccgagaaggaccccacccagcacaaggaggacgagggcgagatccagcccgagaacaaggaggacagcatcgagaacttcttccccttccacttcggcttcgagggcgtgctgcccctggccggcgtgaccctgagcaccaaggccagagaccccaagtag

SEQ ID NO: 11323 - DNA, 837 bp, Artificial Sequence; identical to SEQ ID NO: 9588
  Description of Artificial Sequence: Synthetic coding sequence

SEQ ID NO: 11324 - DNA, 1368 bp, Artificial Sequence
  Description of Artificial Sequence: Synthetic coding sequence
atgttcaccgagggcgaggagatgtacctgcagggcagcaccgtgtggcaccccgactgcaagcagagcaccaagaccgaggagaagctgagactgcccaacatcagaagaagcagcagcgacttcttctacagcaagagcctgatcagaagaaccggcagaagccccagcctgcagcccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 11325 - DNA, 1959 bp, Artificial Sequence
  Description of Artificial Sequence: Synthetic coding sequence
tgaagccacgccttcatcagccagtgggtgtgcagacactggagagaccccgtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagactaccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 11326 - DNA, 837 bp, Artificial Sequence
  Description of Artificial Sequence: Synthetic coding sequence
atgacccagcagtggagagaggtgaacgaggacagagaggccgtggcccaggccagaagctggcagagcctgaacctgggcgacagagacatgggcgtgagcttcatcgagaccgccctggccctgagcgccgccagagccagaagacccctgctgaccagccacccccccagcagacccttccagccccccaagcacacccccagccccccccccgcccccagagtgaacagcagacaccccggcagaagcgtgagcctgagcctgcccagcgccagccaggccccccccgtgcccctggccagccccgagggcagaccccacaccgtgggcgccccccacgccagcacctggaagagaaccagaggcagacagagagccagaccccccaagatcgtgaaggaggccgaggtgccccaggccgccctgggcgtgcccgcccagggcaccggcgacaacggccacacccccgtggaggaggaggtgggcggcatccccgtgcccgcccccggcctgctgcaggtgaccgagagaagacagcccctgagcagcgtgagcagcctggaggtgcacttcgacctgctggacctgaccgagctgaccgacatgagcgaccaggagctggccgaggtgttcgccgacagcgacgacgagaacctgaacaccgagagccccgccggcctgcaccccctgcccagagccggctacctgagaagccccagctggaccagaaccagagccgagcagagccacgagaagcagcccctgggcgaccccgagagacaggccaccgtgctggacaccttcctgaccgtggagagaccccaggaggactag

SEQ ID NO: 11327 - DNA, 540 bp, Artificial Sequence
  Description of Artificial Sequence: Synthetic coding sequence
atgaccgacctggtggccgtgtgggacgtggccctgagcgacggcgtgcacaagatcgagttcgagcacggcaccaccagcggcaagagagtggtgtacgtggacggcaaggaggagatcagaaaggagtggatgttcaagctggtgggcaaggagaccttctacgtgggcgccgccaagaccaaggccaccatcaacatcgacgccatcagcggcttcgcctacgagtacaccctggagatcaacggcaagagcctgaagaagtacatggaggacagaagcaagaccaccaacacctgggtgctgcacatggacggcgagaacttcagaatcgtgctggagaaggacgccatggacgtgtggtgcaacggcaagaagctggagaccgccggcgagttcgtggacgacggcaccgagacccacttcagcatcggcaaccacgactgctacatcaaggccgtgagcagcggcaagagaaaggagggcatcatccacaccctgatcgtggacaacagagagatccccgagatcgccagctag

SEQ ID NO: 11328 - DNA, 540 bp, Artificial Sequence; identical to SEQ ID NO: 11327
  Description of Artificial Sequence: Synthetic coding sequence

SEQ ID NO: 11329 - DNA, 1053 bp, Artificial Sequence
  Description of Artificial Sequence: Synthetic coding sequence
atgggcccctgcaacctgagcagcgccgccggccccaccgccgagaagagcgtgccctaccagagaaccctgaaggagggccagggcaccagcgtggtggcccagggccccagcagacccctgcccagcaccgccaacgtggtggtgatcggcggcggcagcctgggctgccagaccctgtaccacctggccaagctgggcatgagcggcgccgtgctgctggagagagagagactgaccagcggcaccacctggcacaccgccggcctgctgtggcagctgagacccagcgacgtggaggtggagctgctggcccacaccagaagagtggtgagcagagagctggaggaggagaccggcctgcacaccggctggatccagaacggcggcctgttcatcgccagcaacagacagagactggacgagtacaagagactgatgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagaacatgcccaacgtgagagaccacgacgccagcgtgtacctgagactgcagggcgacgccctgagcgtgggcggctacgaggccaaccccatcttctgggaggaggccgtgaagtacagacccagagccgccggcggcctgtgcctgaagaccagcaccgagaaggtgtgcgccgtgtggagcgacgacctgagaagagcctag

SEQ ID NO: 11330 - DNA, 2001 bp, Artificial Sequence
  Description of Artificial Sequence: Synthetic coding sequence
atggccagagccggcagctgcggcggcgccgccgccggcgccggcagacccgagccctgggagctgagcctggaggaggtgctgaaggcctacgagcagcccctgaacgaggagcaggcctgggccgtgtgcttccagggctgcagaggcctgagaggcagccccggcagaagactgagagacaccggcgacctgctgctgagaggcgacggcagcgtgggcgccagagagcccgaggccgccgagcccgccaccatggtggtgcccctggccagcagcgaggcccagaccgtgcagagcctgggcttcgccatctacagagccctggactggggcctggacgagagcgaggagagagagctgagcccccagctggagagactgatcgacctgatggccaacaacgacagcgaggacagcggctgcggcgccgccgacgagggctacggcggccccgaggaggaggaggaggccgagggcgtgcccagaagcgtgagaaccttcgcccaggccatgagactgtgcgccgccagactgaccgaccccagaggcgcccaggcccactaccaggccgtgtgcagagccctgttcgtggagaccctggagctgagagccttcctggccagagtgagagaggccaaggagatgctgcagaagctgagagaggacgagccccacctggagacccccagagccgagctggacagcctgggccacaccgactgggccagactgtgggtgcagctgatgagagagctgagaagaggcgtgaagctgaagaaggtgcaggagcaggagttcaaccccctgcccaccgagttccagctgacccccttcgagatgctgatgcaggacatcagagccagaaactacaagctgagaaaggtgatggtggacggcgacatcccccccagagtgaagaaggacgcccacgagctgatcctggacttcatcagaagcagaccccccctgaagcaggtgagcgagagaagactgagacccctgccccccaagcagagaagcctgcacgagaagatcctggaggagatcaagcaggagagaagactgagacccgtgagaggcgagggctgggccgccagaggcttcggcagcctgccctgcatcctgaacgcctgcagcggcgacgccaagagcaccagctgcatcaacctgagcgtgaccgacgccggcggcagcgcccagagacccagacccagagtgctgctgaaggcccccaccctggccgagatggaggagatgaacaccagcgaggaggaggagagcccctgcggcgaggtgaccctgaagagagacagaagcttcagcgagcacgacctggcccagctgagaagcgaggtggccagcggcctgcagagcgccacccacccccccggcggcaccgagccccccagacccagagccggcagcgcccacgtgtggagacccggcagcagagaccagggcacctgccccgccagcgtgagcgaccccagccaccccctgctgagcaacagaggcagcagcggcgacagacccgaggccagcatgacccccgacgccaagcacctgtggctggagttcagccaccccgtggagagcctggccctgaccgtggaggaggtgatggacgtgagaagagtgctggtgaaggccgagatggagaagttcctgcagaacaaggagctgttcagcagcctgaagaagggcaagatctgctgctgctgcagagccaagttccccctgttcagctggccccccagctgcctgttctgcaagagaagcctgcagggcccccagtggcagagcgtggaggaggccttcccccacatctacagccacggctgcgtgctgaaggacgtgtgcagcgagtgcaccagcttcgtggccgacgtggtgagaagcagcagaaagagcgtggacgtgctgaacaccacccccagaagaagcagacagacccagagcctgtacatccccaacaccagaaccctggacttcaagtag

SEQ ID NO: 11331 - DNA, 474 bp, Artificial Sequence
  Description of Artificial Sequence: Synthetic coding sequence
atggagaccctgcagagcgagaccaagaccagagtgctgcccagctggctgaccgcccaggtggccaccaagaacgtggcccccatgaaggcccccaagagaatgagaatggccgccgtgcccgtggccgccgccagactgcccgccaccagaaccgtgtactgcatgaacgaggccgagatcgtggacgtggccctgggcatcctgatcgagagcagaaagcaggagaaggcctgcgagcagcccgccctggccggcgccgacaaccccgagcacagccccccctgcagcgtgagcccccacaccagcagcggcagcagcagcgaggaggaggacagcggcaagcaggccctggcccccggcctgagccccagccagagacccggcggcagcagcagcgcctgcagcagaagccccgaggaggaggaggaggaggacgtgctgaagtacgtgagagagatcttcttcagctag

SEQ ID NO: 11332 - DNA, 804 bp, Artificial Sequence
  Description of Artificial Sequence: Synthetic coding sequence
atggccaactgcgagagaaccttcatcgccatcaagcccgacggcgtgcagagaggcctggtgggcgagatcatcaagagattcgagcagaagggcttcagactggtgggcctgaagttcatgcaggccagcgaggacctgctgaaggagcactacgtggacctgaaggacagacccttcttcgccggcctggtgaagtacatgcacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaccatggccaacctggagagaaccttcatcgccatcaagcccgacggcgtgcagagaggcctggtgggcgagatcatcaagagattcgagcagaagggcttcagactggtggccatgaagttcctgagagccagcgaggagcacctgaagcagcactacatcgacctgaaggacagacccttcttccccggcctggtgaagtacatgaacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtgaagagcgccgagaaggagatcagcctgtggttcaagcccgaggagctggtggactacaagagctgcgcccacgactgggtgtacgagtag

SEQ ID NO: 11333 - DNA, 879 bp, Artificial Sequence
  Description of Artificial Sequence: Synthetic coding sequence
atggtgctgctgagcaccctgggcatcgtgttccagggcgagggcccccccatcagcagctgcgacaccggcaccatggccaactgcgagagaaccttcatcgccatcaagcccgacggcgtgcagagaggcctggtgggcgagatcatcaagagattcgagcagaagggcttcagactggtgggcctgaagttcatgcaggccagcgaggacctgctgaaggagcactacgtggacctgaaggacagacccttcttcgccggcctggtgaagtacatgcacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaccatggccaacctggagagaaccttcatcgccatcaagcccgacggcgtgcagagaggcctggtgggcgagatcatcaagagattcgagcagaagggcttcagactggtggccatgaagttcctgagagccagcgaggagcacctgaagcagcactacatcgacctgaaggacagacccttcttccccggcctggtgaagtacatgaacagcggccccgtggtggccatggtgtgggagggcctgaacgtggtgaagaccggcagagtgatgctgggcgagaccaaccccgccgacagcaagcccggcaccatcagaggcgacttctgcatccaggtgggcagaaacatcatccacggcagcgacagcgtgaagagcgccgagaaggagatcagcctgtggttcaagcccgaggagctggtggactacaagagctgcgcccacgactgggtgtacgagtag

SEQ ID NO: 11334 - DNA, 492 bp, Artificial Sequence
  Description of Artificial Sequence: Synthetic coding sequence
atgaagagcagccagaccttcgaggagcagaccgagtgcatcgtgaacaccctgctgatggacttcctgagccccaccctgcaggtggccagcagaaacctgtgctgcgtggacgaggtggacagcggcgagccctgcagcttcgacgtggccatcatcgccggcagactgagaatgctgggcgaccagttcaacggcgagctggaggccagcgccaagaacgtgatcgccgagaccatcaagggccagaccggcgccatcctgcaggacaccgtggagagcctgagcaagacctggtgcgcccaggacagcagcctggcctacgagagagccttcctggccgtgagcgtgaagctgctggagtacatggcccacatcgcccccgaggtggtgggccaggtggccatccccatgaccggcatgatcaacggcaaccaggccatcagagagttcatccagggccagggcggctgggagaacctggagagctag

SEQ ID NO: 11335 - DNA, 558 bp, Artificial Sequence
  Description of Artificial Sequence: Synthetic coding sequence
atgggcaagaagcagaacaagaagaaggtggaggaggtgctggaggaggaggaggaggagtacgtggtggagaaggtgctggacagaagagtggtgaagggcaaggtggagtacctgctgaagtggaagggcttcagcgacgaggacaacacctgggagcccgaggagaacctggactgccccgacctgatcgccgagttcctgcagagccagaagaccgcccacgagaccgacaagagcgagggcggcaagagaaaggccgacagcgacagcgaggacaagggcgaggagagcaagcccaagaagaagaaggaggagagcgagaagcccagaggcttcgccagaggcctggagcccgagagaatcatcggcgccaccgacagcagcggcgagctgatgttcctgatgaagtggaagaacagcgacgaggccgacctggtgcccgccaaggaggccaacgtgaagtgcccccaggtggtgatcagcttctacgaggagagactgacctggcacagctaccccagcgaggacgacgacaagaaggacgacaagaactag

SEQ ID NO: 11336 - DNA, 1350 bp, Artificial Sequence; identical to SEQ ID NO: 10423
  Description of Artificial Sequence: Synthetic coding sequence

SEQ ID NO: 11337 - DNA, 741 bp, Artificial Sequence
  Description of Artificial Sequence: Synthetic coding sequence
atgagcggcgccggcgaggccctggcccccggccccgtgggcccccagagagtggccgaggccggcggcggccagctgggcagcaccgcccagggcaagtgcgacaaggacaacaccgagaaggacatcacccaggccaccaacagccacttcacccacggcgagatgcaggaccagagcatctggggcaaccccagcgacggcgagctgatcagaacccagccccagagactgccccagctgcagaccagcgcccaggtgcccagcggcgaggagatcggcaagatcaagaacggccacaccggcctgagcaacggcaacggcatccaccacggcgccaagcacggcagcgccgacaacagaaagctgagcgcccccgtgagccagaagatgcacagaaagatccagagcagcctgagcgtgaacagcgacatcagcaagaagagcaaggtgaacgccgtgttcagccagaagaccggcagcagccccgaggactgctgcgtgcactgcatcctggcctgcctgttctgcgagttcctgaccctgtgcaacatcgtgctgggccaggccagctgcggcatctgcaccagcgaggcctgctgctgctgctgcggcgacgagatgggcgacgactgcaactgcccctgcgacatggactgcggcatcatggacgcctgctgcgagagcagcgactgcctggagatctgcatggagtgctgcggcatctgcttccccagctag

SEQ ID NO: 11338 - DNA, 30 bp, Artificial Sequence
  Description of Artificial Sequence: Synthetic coding sequence
atgagctactaccagagacccttcagctag

SEQ ID NO: 11339 - DNA, 2001 bp, Artificial Sequence
  Description of Artificial Sequence: Synthetic coding sequence
atgaacaccggcagagacagccagagccccgacagcgccaagggcttcagaagcgtgagacccaacctgcaggacaagagaagccccacccagagccagatcaccgtgaacggcaacagcggcggcgccgtgagccccatgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagaccatgttcaagcagatccacatggtgcacaagcccgacgacgacaccgacatgtacaacaccccctacacctacaacgccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccaccgacagaatcaaccccgacgacatcgacctggagaacgagccctggtacaagttcttcagcgagctggagttcggcagacccccccccaagaagcccctggactacgtgcaggaccacagcagcggcgtgttcaacgaggccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 11340 - DNA, 2472 bp, Artificial Sequence
  Description of Artificial Sequence: Synthetic coding sequence
atgaccctgctgagcagccagagcagcagcctggtggcccccagcggcagcgtgagcgccgagaaccccgagcagagaatgctggagaagagagccaaggtgatcgaggagctgctgcagaccgagagagactacatcagagacctggagatgtgcatcgagagaatcatggtgcccatgcagcaggcccaggtgcccaacatcgacttcgagggcctgttcggcaacatgcagatggtgatcaaggtgagcaagcagctgctggccgccctggagatcagcgacgccgtgggccccgtgttcctgggccacagagacgagctggagggcacctacaagatctactgccagaaccacgacgaggccatcgccctgctggagatctacgagaaggacgagaagatccagaagcacctgcaggacagcctggccgacctgaacagcctggtgctgaagaagggctgcaccaactacatcaacctgggcagcttcctgatcaagcccgtgcagagagtgatgagataccccctgctgctgatggagctgctgaacagcacccccgagagccaccccgacaaggtgcccctgaccaacgccgtgctggccgtgaaggagatcaacgtgaacatcaacgagtacaagagaagaaaggacctggtgctgaagtacagaaagggcgacgaggacagcctgatggagaagatcagcaagctgaacatccacagcatcatcaagaagagcaacagagtgagcagccacctgaagcacctgaccggcttcgccccccagatcaaggacgaggtgttcgaggagaccgagaagaacttcagaatgcaggagagactgatcaagagcttcatcagagacctgagcctgtacctgcagcacatcagagagagcgcctgcgtgaaggtggtggccgccgtgagcatgtgggacgtgtgcatggagagaggccacagagacctggagcagttcgagagagtgcacagatacatcagcgaccagctgttcaccaacttcaaggagagaaccgagagactggtgatcagccccctgaaccagctgctgagcatgttcaccggcccccacaagctggtgcagaagagattcgacaagctgctggacttctacaactgcaccgagagagccgagaagctgaaggacaagaagaccctggaggagctgcagagcgccagaaacaactacgaggccctgaacgcccagctgctggacgagctgcccaagttccaccagtacgcccagggcctgttcaccaactgcgtgcacggctacgccgaggcccactgcgacttcgtgcaccaggccctggagcagctgaagcccctgctgagcctgctgaaggtggccggcagagagggcaacctgatcgccatcttccacgaggagcacagcagagtgctgcagcagctgcaggtgttcaccttcttccccgagagcctgcccgccaccaagaagcccttcgagagaaagaccatcgacagacagagcgccagaaagcccctgctgggcctgcccagctacatgctgcagagcgaggagctgagagccagcctgctggccagatacccccccgagaagctgttccaggccgagagaaacttcaacgccgcccaggacctggacgtgagcctgctggagggcgacctggtgggcgtgatcaagaagaaggaccccatgggcagccagaacagatggctgatcgacaacggcgtgaccaagggcttcgtgtacagcagcttcctgaagccctacaaccccagaagaagccacagcgacgccagcgtgggcagccacagcagcaccgagagcgagcacggcagcagcagccccagattccccagacagaacagcggcagcaccctgaccttcaaccccagcagcatggccgtgagcttcaccagcggcagctgccagaagcagccccaggacgccagccccccccccaaggagtgcgaccagggcaccctgagcgccagcctgaaccccagcaacagcgagagcagccccagcagatgccccagcgaccccgacagcaccagccagcccagaagcggcgacagcgccgacgtggccagagacgtgaagcagcccaccgccacccccagaagctacagaaacttcagacaccccgagatcgtgggctacagcgtgcccggcagaaacggccagagccaggacctggtgaagggctgcgccagaaccgcccaggcccccgaggacagaagcaccgagcccgacggcagcgaggccgagggcaaccaggtgtacttcgccgtgtacaccttcaaggccagaaaccccaacgagctgagcgtgagcgccaaccagaagctgaagatcctggagttcaaggacgtgaccggcaacaccgagtggtggctggccgaggtgaacggcaagaagggctacgtgcccagcaactacatcagaaagaccgagtacacctag

SEQ ID NO: 11341 - DNA, 2964 bp, Artificial Sequence
  Description of Artificial Sequence: Synthetic coding sequence
atggccgagagcagcagcgagagcgaccacttcagatgcagagacagactgagcccctgggccgccagaagcacccacagaggcaccagaagcctgcccaccgtggaggtgaccgagaaggtgaacaccatcaccagcaccctgcaggacaccagcagaaacctgagacaggtggaccagatgctgggcagatacagagagtacagcaacggccaggccggcgccatcgagcacctgaaggagagcctggagcagagcatcgaccagctgagaagccagagactgctgagaaacagcggcggcagaagcatcagcgtgaccagcctgagcgccagcgacctggacggcggcaccggcagcgagctgcaccacttcccccccaccagccccctgaaggactacggcgacccccagggcatcaagagaatgagaagcagaaccggcgtgagattcgtgcaggagaccgacgacatgacccagctgcacggcttccaccagagcctgagagacctgagcagcgagcagatcagactgggcgacgacttcaacagagagctgagcagaagaagcagaagcgacgccgagaccaagagagccctggaggagctgaccgagaagctgaacgaggcccagaagcaggaggtggtgagcgacagagtggagagaagactgcaggagctggagagagagatgagaaccgagagagagctggtggagagaagacaggaccagctgggcctgatgagcctgcagctgcaggaggccctgaagaagcaggaggccaaggccgacgagcacgagggcgccatcaagaacaagctgagacagaccgagaccgagaagaaccagctggagcaggagctggagctgagcagaagactgctgaaccagagcgagggcagcagagagaccctgctgcaccaggtggaggagctgagaacccagctgaccaaggccgagggcgacagaaagggcctgcagcaccaggtgagccagatcagcaagcagcagagcaactaccaggacgagcagggcgaggactggagattcagaagaggcgtggagagagagaagcaggacctggagaagcagatgagcgacctgagagtgcagctgaacttcagcgccatggccagcgagctggaggaggtgaagagatgcatggagagaaaggacaaggagaaggcccacctggccagccaggtggagaacctgaccagagagctggagaacggcgagaagcagcagctgcagatgctggacagactgaaggagatccagaaccacttcgacacctgcgaggccgagagaaagcacgccgacctgcagatcagcgagctgaccagacacgccgaggacgccaccaagcaggccgagagatacctgagcgagctgcagcagagcgaggccctgaaggaggaggccgagaagagaagagaggacctgaagctgaaggcccaggagagcatcagacagtggaagctgaagcacaagaagctggagagagccctggagaagcagagcgagaccgtggacgagctgaccggcaagaacaaccagatcctgaaggagaaggacgagctgaagacccagctgtacgccgccctgcagcagatcgagaacctgagaaaggagctgaacgacgtgctgaccaagagagccctgcaggaggaggagctgcacagcaaggaggagaagctgagagacatcaagagccaccaggccgacctggagctggaggtgaagaacagcctggacaccatccacagactggagagcgagctgaagaagcagagcaagatccagagccagatgaaggtggagaaggcccacctggaggaggagatcgccgagctgaagaagagccaggcccaggacaaggccaagctgctggagatgcaggagagcatcaaggacctgagcgccatcagagccgacctggccaacaagctggccgaggaggagagagccaagaaggccgtgctgaaggacctgagcgacctgaccgcccaggccaagagcagagacgaggagaccgccaccatcatcacccagctgaagctggagagagacgtgcaccagagagagctgaaggacctgaccagcagcctgcagagcgtgaagaccaagcacgagcagaacatccaggagctgatgaagcacttcaagaaggagaagagcgaggccgagaaccacatcagaaccctgaaggccgagagcctggaggagaagaacatggccaagatccacagaggccagctggagaagctgaagagccagtgcgacagactgaccgaggagctgacccagaacgagaacgagaacaagaagctgaagctgaagtaccagtgcctgaaggaccagctggaggagagagagaagcacatcagcatcgaggaggagcacctgagaagaatggaggaggccagactgcagctgaaggaccagctgctgtgcctggagaccgagcaggagagcatcctgggcgtgatcggcaaggagatcgacgccgcctgcaagaccttcagcaaggacagcgtggagaagctgaaggtgttcagcagcggccccgacatccactacgacccccacagatggctggccgagagcaagaccaagctgcagtggctgtgcgaggagctgaaggagagagagaacagagagaagaacctgagacaccagctgatgctgtgcagacagcagctgagaaacctgaccgagaacaaggagagcgagctgcagtgcctgttccagcagatcgagagacaggagcagctgctggacgagatccacagagagaagagagacctgctggaggagacccagagaaaggacgaggagatgggcagcctgcaggacagagtgatcgccctggagaccagcacccaggtggccctggaccacctggagagcgtgcccgagaagctgagcctgctggaggacttcaaggacttcagaagatag

SEQ ID NO: 11342 - DNA, 5157 bp, Artificial Sequence
  Description of Artificial Sequence: Synthetic coding sequence
atgagcggcaccagcagccccgaggccgtgaagaagctgctggagaacatgcagagcgacctgagagccctgagcctggagtgcaagaagaagttcccccccgtgaaggaggccgccgagagcggcatcatcaaggtgaagaccatcgccgccagaaacaccgagatcctggccgccctgaaggagaacagcagcgaggtggtgcagcccttcctgatgggctgcggcaccaaggagcccaagatcacccagctgtgcctggccgccatccagagactgatgagccacgaggtggtgagcgagaccgccgccggcaacatcatcaacatgctgtggcagctgatggagaacagcctggaggagctgaagctgctgcagaccgtgctggtgctgctgaccaccaacaccgtggtgcacgacgaggccctgagcaaggccatcgtgctgtgcttcagactgcacttcaccaaggacaacatcaccaacaacaccgccgccgccaccgtgagacaggtggtgaccgtggtgttcgagagaatggtggccgaggacgagagacacagagacatcatcgagcagcccgtgctggtgcagggcaacagcaacagaagaagcgtgagcaccctgaagccctgcgccaaggacgcctacatgctgttccaggacctgtgccagctggtgaacgccgacgccccctactggctggtgggcatgaccgagatgaccagaaccttcggcctggagctgctggagagcgtgctgaacgacttcccccaggtgttcctgcagcaccaggagttcagcttcctgctgaaggagagagtgtgccccctggtgatcaagctgttcagccccaacatcaagttcagacagggcagcagcaccagcagcagccccgcccccgtggagaagccctacttccccatctgcatgagactgctgagagtggtgagcgtgctgatcaagcagttctacagcctgctggtgaccgagtgcgagatcttcctgagcctgctggtgaagttcctggacgccgacaagccccagtggctgagagccgtggccgtggagagcatccacagattctgcgtgcagccccagctgctgagaagcttctgccagagctacgacatgaagcagcacagcaccaaggtgttcagagacatcgtgaacgccctgggcagcttcatccagagcctgttcctggtgccccccaccggcaaccccgccaccagcaaccaggccggcaacaacaacctgggcggcagcgtgagcgcccccgccaacagcggcatggtgggcatcggcggcggcgtgaccctgctgcccgccttcgagtacagaggcacctggatccccatcctgaccatcaccgtgcagggcagcgccaaggccacctacctggagatgctggacaaggtggagccccccaccatccccgagggctacgccatgagcgtggccttccactgcctgctggacctggtgagaggcatcaccagcatgatcgagggcgagctgggcgagctggagaccgagtgccagaccaccaccgaggagggcagcagccccacccagagcaccgagcagcaggacctgcagagcaccagcgaccagatggacaaggagatcgtgagcagagccgtgtgggaggagatggtgaacgcctgctggtgcggcctgctggccgccctgagcctgctgctggacgccagcaccgacgaggccgccaccgagaacatcctgaaggccgagctgaccatggccgccctgtgcggcagactgggcctggtgaccagcagagacgccttcatcaccgccatctgcaagggcagcctgcccccccactacgccctgaccgtgctgaacaccaccaccgccgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgagaaccctgctgaacctggcccactgccacggcgccgtgctgggcaccagctggcagctggtgctggccaccctgcagcacctggtgtggatcctgggcctgaagcccagcagcggcggcgccctgaagcccggcagagccgtggagggccccagcaccgtgctgaccaccgccgtgatgaccgacctgcccgtgatcagcaacatcctgagcagactgttcgagagcagccagtacctggacgacgtgagcctgcaccacctgatcaacgccctgtgcagcctgagcctggaggccatggacatggcctacggcaacaacaaggagcccagcctgttcgccgtggccaagctgctggagaccggcctggtgaacatgcacagaatcgagatcctgtggagacccctgaccggccacctgctggagaaggtgtgccagcaccccaacagcagaatgagagagtggggcgccgaggccctgaccagcctgatcaaggccggcctgaccttcaaccacgacccccccctgagccagaaccagagactgcagctgctgctgctgaaccccctgaaggagatgagcaacatcaaccaccccgacatcagactgaagcagctggagtgcgtgctgcagatcctgcagagccagggcgacagcctgggccccggctggcccctggtgctgggcgtgatgggcgccatcagaaacgaccagggcgagagcctgatcagaaccgccttccagtgcctgcagctggtggtgaccgacttcctgcccaccatgccctgcacctgcctgcagatcgtggtggacgtggccggcagcttcggcctgcacaaccaggagctgaacatcagcctgaccagcatcggcctgctgtggaacatcagcgactacttcttccagagaggcgagaccatcgagaaggagctgaacaaggaggaggccgcccagcagaagcaggccgaggagaagggcgtggtgctgaacagacccttccaccccgccccccccttcgactgcctgtggctgtgcctgtacgccaagctgggcgagctgtgcgtggaccccagacccgccgtgagaaagagcgccggccagaccctgttcagcaccatcggcgcccacggcaccctgctgcagcacagcacctggcacaccgtgatctggaaggtgctgttccacctgctggacagagtgagagagagcagcaccaccgccgacaaggagaagatcgagagcggcggcggcaacatcctgatccaccacagcagagacaccgccgagaagcagtgggccgagacctgggtgctgaccctggccggcgtggccagaatcttcaacaccagaagatacctgctgcagcccctgggcgacttcagcagagcctgggacgtgctgctggaccacatccagagcgccgccctgagcaagaacaacgaggtgagcctggccgccctgaagagcttccaggagatcctgcagatcgtgagccccgtgagagacagcgacaagcccgagaccccccccgtggtgaacgtgcccgtgcccgtgctgatcggccccatcagcggcatgagcagacccttcgtgagaaccgacagcatcggcgagaagctgggcagatacagcagcagcgagccccccatcgtgaccgacgagctggaggacctgaacctgtggtgggccgcctggaacacctggtacagaatcggcagcgagagcaccaagccccccatcaccttcgacaagctgaccttcatccccagccagcccttcctgaccgccctgatccagatcttccccgccctgtaccagcacatcaagaccggcttcaacatggacgacctgcagaagctgggcgtgatcctgcacagcgccatcagcgtgcccatcagcagcgacgccagccccttcatcctgcccagctacaccgaggccgtgctgaccagcctgcaggaggccgtgctgaccgccctggacgtgctgcagaaggccatctgcgtgggccccgagaacatgcagatcatgtaccccgccatcttcgaccagctgctggccttcgtggagttcagctgcaagcccccccagtacggccagctggagaccaagcacatcgccaacgccaagtacaaccagatccagctgttcgcccccgccgagtgggtggccctgaactacgtgcccttcgccgagagaagcctggaggtggtggtggacctgtaccagaagaccgcctgccacaaggccgtggtgaacgagaaggtgctgcagaacatcatcaagaccctgagagtgcccctgagcctgaagtacagctgccccagcgagagcacctggaagctggccgtgagcagcctgctgagagtgctgagcatcggcctgcccgtggccagacagcacgccagcagcggcaagttcgacagcatgtggcccgagctggccaacaccttcgaggacttcctgttcaccaagagcatcccccccgacaacctgagcatccaggagttccagagaaacgagaacatcgacgtggaggtggtgcagctgatcagcaacgagatcctgccctacgccaacttcatccccaaggagttcgtgggccagatcatgaccatgctgaacaagggcagcatccacagccagagcagcagcttcaccgaggccgagatcgacatcagactgagagaggagttcagcaagatgtgcttcgagaccctgctgcagttcagcttcagcaacaaggtgaccaccccccaggagggctacatcagcagaatggccctgagcgtgctgctgaagagaagccaggacgtgctgcacagatacatcgaggacgagagactgagcggcaagtgccccctgcccagacagcaggtgaccgagatcatcttcgtgctgaaggccgtgagcaccctgatcgacagcctgaagaagacccagcccgagaacgtggacggcaacacctgggcccaggtgatcgccctgtaccccaccctggtggagtgcatcacctgcagcagcagcgaggtgtgcagcgccctgaaggaggccctggtgcccttcaaggacttcatgcagccccccgccagcagagtgcagaacggcgagagctag

SEQ ID NO: 11343 - DNA, 2100 bp, Artificial Sequence
  Description of Artificial Sequence: Synthetic coding sequence
atgagcagcagaaaggtgctggccatccaggccagaaagagaagacccaagagagagaagcaccccaagaagcccgagccccagcagaaggcccccctggtgcccccccccccccccccccccccccccccccccccccccctgcccgaccccaccccccccgagcccgaggaggagatcctgggcagcgacgacgaggagcaggaggaccccgccgactactgcaagggcggctaccaccccgtgaagatcggcgacctgttcaacggcagataccacgtgatcagaaagctgggctggggccacttcagcaccgtgtggctgtgctgggacatgcagggcaagagattcgtggccatgaaggtggtgaagagcgcccagcactacaccgagaccgccctggacgagatcaagctgctgaagtgcgtgagagagagcgaccccagcgaccccaacaaggacatggtggtgcagctgatcgacgacttcaagatcagcggcatgaacggcatccacgtgtgcatggtgttcgaggtgctgggccaccacctgctgaagtggatcatcaagagcaactaccagggcctgcccgtgagatgcgtgaagagcatcatcagacaggtgctgcagggcctggactacctgcacagcaagtgcaagatcatccacaccgacatcaagcccgagaacatcctgatgtgcgtggacgacgcctacgtgagaagaatggccgccgaggccaccgagtggcagaaggccggcgcccccccccccagcggcagcgccgtgagcaccgccccccagcagaagcccatcggcaagatcagcaagaacaagaagaagaagctgaagaagaagcagaagagacaggccgagctgctggagaagagactgcaggagatcgaggagctggagagagaggccgagagaaagatcatcgaggagaacatcaccagcgccgcccccagcaacgaccaggacggcgagtactgccccgaggtgaagctgaagaccaccggcctggaggaggccgccgaggccgagaccgccaaggacaacggcgaggccgaggaccaggaggagaaggaggacgccgagaaggagaacatcgagaaggacgaggacgacgtggaccaggagctggccaacatcgaccccacctggatcgagagccccaagaccaacggccacatcgagaacggccccttcagcctggagcagcagctggacgacgaggacgacgacgaggaggactgccccaaccccgaggagtacaacctggacgagcccaacgccgagagcgactacacctacagcagcagctacgagcagttcaacggcgagctgcccaacggcagacacaagatccccgagagccagttccccgagttcagcaccagcctgttcagcggcagcctggagcccgtggcctgcggcagcgtgctgagcgagggcagccccctgaccgagcaggaggagagcagccccagccacgacagaagcagaaccgtgagcgccagcagcaccggcgacctgcccaaggccaagaccagagccgccgacctgctggtgaaccccctggaccccagaaacgccgacaagatcagagtgaagatcgccgacctgggcaacgcctgctgggtgcacaagcacttcaccgaggacatccagaccagacagtacagaagcatcgaggtgctgatcggcgccggctacagcacccccgccgacatctggagcaccgcctgcatggccttcgagctggccaccggcgactacctgttcgagccccacagcggcgaggactacagcagagacgaggaccacatcgcccacatcatcgagctgctgggcagcatccccagacacttcgccctgagcggcaagtacagcagagagttcttcaacagaagaggcgagctgagacacatcaccaagctgaagccctggagcctgttcgacgtgctggtggagaagtacggctggccccacgaggacgccgcccagttcaccgacttcctgatccccatgctggagatggtgcccgagaagagagccagcgccggcgagtgcctgagacacccctggctgaacagctag

SEQ ID NO: 11344 - DNA, 1113 bp, Artificial Sequence
  Description of Artificial Sequence: Synthetic coding sequence
atgggcttcaacagacccagcaagatccaggagaacgccctgcccctgatgctggccgagcccccccagaacctgatcgcccagagccagagcggcaccggcaagaccgccgccttcgtgctggccatgctgagccaggtggagcccgccaacaagtacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 11345 - DNA, 2640 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaagagcgtgatgaagaccacctggggcgtgctggacccccccgtgggcaacaccagactgaacgtgatcagactgatcagcagcctgctgcagaccaacaccagcagcatcaacggcgacctgatggagctgaacagcatcggcgtgatcctgaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggtgaccacctgccacatccacagcagcagcgacgacgagatcgacttcaaggagaccggcttcagccaggacagcagcctgcagcaggccttcagcgactaccagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagactgctgggcggctgcagcgaggagggcaagctgagcaccagccaggacgccgcctgcaaggacgccgaggagtgccccgagaccgccgaggccaagtgcgccgcccccagaccccccagcagcagccccgagcagagaaccggccagcccagcgcccccggcgacaccagcgtgaacggccccgtgtag

SEQ ID NO: 11346 - DNA, 2622 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaagagcgtgatgaagaccacctggggcgtgctggacccccccgtgggcaacaccagactgaacgtgatcagactgatcagcagcctgctgcagaccaacaccagcagcatcaacggcgacctgatggagctgaacagcatcggcgtgatcctgaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggtgaccacctgccacatccacagcagcagcgacgacgagatcgacttcaaggagaccggcttcagccaggacagcagcctgcagcaggccttcagcgactaccagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagcgaggagggcaagctgagcaccagccaggacgccgcctgcaaggacgccgaggagtgccccgagaccgccgaggccaagtgcgccgcccccagaccccccagcagcagccccgagcagagaaccggccagcccagcgcccccggcgacaccagcgtgaacggccccgtgtag

SEQ ID NO: 11347 - DNA, 2640 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaagagcgtgatgaagaccacctggggcgtgctggacccccccgtgggcaacaccagactgaacgtgatcagactgatcagcagcctgctgcagaccaacaccagcagcatcaacggcgacctgatggagctgaacagcatcggcgtgatcctgaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggtgaccacctgccacatccacagcagcagcgacgacgagatcgacttcaaggagaccggcttcagccaggacagcagcctgcagcaggccttcagcgactaccagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagagtgctgaagagctacagagaggagggcaagctgagcaccagccaggacgccgcctgcaaggacgccgaggagtgccccgagaccgccgaggccaagtgcgccgcccccagaccccccagcagcagccccgagcagagaaccggccagcccagcgcccccggcgacaccagcgtgaacggccccgtgtag

SEQ ID NO: 11348 - DNA, 1134 bp, Artificial Sequence
  Description of Artificial Sequence: Synthetic coding sequence
atgagcgacgaggtgttcagcaccaccctggcctacaccaagagccccaaggtgaccaagagaaccaccttccaggacgagctgatcagagccatcaccgccagaagcgccagacagagaagcagcgagtacagcgacgacttcgacagcgacgagatcgtgagcctgggcgacttcagcgacaccagcgccgacgagaacagcgtgaacaagaagatgaacgacttccacatcagcgacgacgaggagaagaaccccagcaagctgctgttcctgaagaccaacaagagcaacggcaacatcaccaaggacgagcccgtgtgcgccatcaagaacgaggaggagatggcccccgacggctgcgaggacatcgtggtgaagagcttcagcgagagccagaacaaggacgaggagttcgagaaggacaagatcaagatgaagcccaagcccagaatcctgagcatcaagagcaccagcagcgccgagaacaacagcctggacaccgacgaccacttcaagcccagccccagacccagaagcatgctgaagaagaagagccacatggaggagaaggacggcctggaggacaaggagaccgccctgagcgaggagctggagctgcacagcgcccccagcagcctgcccacccccaacggcatccagctggaggccgagaagaaggccttcagcgagaacctggaccccgaggacagctgcctgaccagcctggccagcagcagcctgaagcagatcctgggcgacagcttcagccccggcagcgagggcaacgccagcggcaaggaccccaacgaggagatcaccgagaaccacaacagcctgaagagcgacgagaacaaggagaacagcttcagcgccgaccacgtgaccaccgccgtggagaagagcaaggagagccaggtgaccgccgacgacctggaggaggagaaggccaaggccgagctgatcatggacgacgacagaaccgtggaccccctgctgagcaagagccagagcatcctgatcagcaccagcgccaccgccagcagcaagaagaccatcgaggacagaaacatcaagaacaagaagagcaccaacaacagagccagcagcgccagcgccagcaaggccagctag

SEQ ID NO: 11349 - DNA, 576 bp, Artificial Sequence; identical to SEQ ID NO: 9798
  Description of Artificial Sequence: Synthetic coding sequence

SEQ ID NO: 11350 - DNA, 576 bp, Artificial Sequence; identical to SEQ ID NO: 9798
  Description of Artificial Sequence: Synthetic coding sequence

SEQ ID NO: 11351 - DNA, 570 bp, Artificial Sequence
  Description of Artificial Sequence: Synthetic coding sequence
atgggcaagagctgcaaggtggtggtgtgcggccaggccagcgtgggcaagaccagcatcctggagcagctgctgtacggcaaccacgtggtggccatgatcgagacccaggaggacatctacgtgggcagcatcgagaccgacagaggcgtgagagagcaggtgagattctacgacaccagaggcctgagagacggcgccgagctgcccagacactgcttcagctgcaccgacggctacgtgctggtgtacagcaccgacagcagagagagcttccagagagtggagctgctgaagaaggagatcgacaagagcaaggacaagaaggaggtgaccatcgtggtgctgggcaacaagtgcgacctgcaggagcagagaagagtggaccccgacgtggcccagcactgggccaagagcgagaaggtgaagctgtgggaggtgagcgtggccgacagaagaagcctgctggagcccttcgtgtacctggccagcaagatgacccagccccagagcaagagcgccttccccctgagcagaaagaacaagggcagcggcagcctggacggctag

SEQ ID NO: 11352 - DNA, 576 bp, Artificial Sequence; identical to SEQ ID NO: 9798
  Description of Artificial Sequence: Synthetic coding sequence

SEQ ID NO: 11353 - DNA, 1005 bp, Artificial Sequence
  Description of Artificial Sequence: Synthetic coding sequence
atggccgaggaggtgagaagagaggaggccagcggcgtgggcagagccagaacccccacccccggcgccctgagagccccccagctggtgaccgaggccccccccctgcaccccggccacaccctgatgaaggccaccgtgctgatgagacagcccggcagagtgcaggagatcgtgggcgccctgagaaagggcggcggcgacagactgcaggtgatcagcgacttcgacatgaccctgagcagattcgcctacaacggcaagagatgccccagcagctacaacatcctggacaacagcaagatcatcagcgaggagtgcagaaaggagctgaccgccctgctgcaccactactaccccatcgagatcgacccccacagaaccgtgaaggagaagctgccccacatggtggagtggtggaccaaggcccacaacctgctgtgccagcagaagatccagaagttccagatcgcccaggtggtgagagagagcaacgccatgctgagagagggctacaagaccttcttcaacaccctgtaccacaacaacatccccctgttcatcttcagcgccggcatcggcgacatcctggaggagatcatcagacagatgaaggtgttccaccccaacatccacatcgtgagcaactacatggacttcaacgaggacggcttcctgcagggcttcaagggccagctgatccacacctacaacaagaacagcagcgcctgcgagaacagcggctacttccagcagctggagggcaagaccaacgtgatcctgctgggcgacagcatcggcgacctgaccatggccgacggcgtgcccggcgtgcagaacatcctgaagatcggcttcctgaacgacaaggtggaggagagaagagagagatacatggacagctacgacatcgtgctggagaaggacgagaccctggacgtggtgaacggcctgctgcagcacatcctgtgccagggcgtgcagctggagatgcagggcccctag

SEQ ID NO: 11354 - DNA, 531 bp, Artificial Sequence; identical to SEQ ID NO: 9640
  Description of Artificial Sequence: Synthetic coding sequence

SEQ ID NO: 11355 - DNA, 912 bp, Artificial Sequence
  Description of Artificial Sequence: Synthetic coding sequence
atggacagcctgcccgacgagttcttcgtgagacaccccgccgtggaggaccagagaaaggaggagaccgagaacaagctggagaagagcagcggccagctgaacaagcaggagaacgacatccccaccgacctggtgcccgtgaacctgctgctggaggtgaagaagctgctgaacgccatcaacaccctgcccaagggcgtggtgccccacatcaagaagttcctgcaggaggacttcagcttccagaccatgcagagagaggtggccgccaacagccagaacggcgaggagatcgtgcccgccctgaccctgagattcctgatcacccagctggaggccgccctgagaaacatccaggccggcaactacaccgcccaccagatcaacatcggctactacctgaccctgctgttcctgtacggcgtggccctgaccgagagaggcaagaaggaggactacaccgaggccgagaacaagttcctggtgatgaagatgatgatccaggagaacgagatctgcgagaacttcatgagcctggtgtacttcggcagaggcctgctgagatgcgcccagaagagatacaacggcggcctgctggagttccacaagagcctgcaggagatcggcgacaagaacgaccactggttcgacatcgaccccaccgaggacgaggacctgcccaccaccttcaaggacctgctgaacaacttcatcaagaccaccgagagcaacatcatgaagcagaccatctgcagctacctggactgcgagagaagctgcgaggccgacatcctgaagaacaccagctacaagggcttcttccagctgatgtgcagcaagagctgctgcgtgtacttccacaagatctgctggaagaagttcaagaacctgaagtaccccggcttctag

SEQ ID NO: 11356 - DNA, 1869 bp, Artificial Sequence
  Description of Artificial Sequence: Synthetic coding sequence
atggacctgctgaccagagagaacgtggccctgaaggtggagagcgcccagcagcccaagcaggtgctgaagatggaggtggccgtgctgaagaagctgcagggcaaggaccacgtgtgcagattcatcggctgcggcagaaacgagaagttcaactacgtggtgatgcagctgcagggcagaaacctggccgacctgagaagaagccagcccagaggcaccttcaccctgagcaccaccctgagactgggcaagcagatcctggagagcatcgaggccatccacagcgtgggcttcctgcacagagacatcaagcccagcaacttcgccatgggcagactgcccagcacctacagaaagtgctacatgctggacttcggcctggccagacagtacaccaacaccaccggcgacgtgagaccccccagaaacgtggccggcttcagaggcaccgtgagatacgccagcgtgaacgcccacaagaacagagagatgggcagacacgacgacctgtggagcctgttctacatgctggtggagttcgccgtgggccagctgccctggagaaagatcaaggacaaggagcaggtgggcatgatcaaggagaagtacgagcacagaatgctgctgaagcacatgcccagcgagttccacctgttcctggaccacatcgccagcctggactacttcaccaagcccgactaccagctgatcatgagcgtgttcgagaacagcatgaaggagagaggcatcgccgagaacgaggccttcgactgggagaaggccggcaccgacgccctgctgagcaccagcaccagcacccccccccagcagaacaccagacagaccgccgccatgttcggcgtggtgaacgtgacccccgtgcccggcgacctgctgagagagaacaccgaggacgtgctgcagggcgagcacctgagcgaccaggagaacgccccccccatcctgcccggcagacccagcgagggcctgggccccagcccccacctggtgccccaccccggcggccccgaggccgaggtgtgggaggagaccgacgtgaacagaaacaagctgagaatcaacatcggcaagagcccctgcgtggaggaggagcagagcagaggcatgggcgtgcccagcagccccgtgagagccccccccgacagccccaccacccccgtgagaagcctgagatacagaagagtgaacagccccgagagcgagagactgagcaccgccgacggcagagtggagctgcccgagagaagaagcagaatggacctgcccggcagccccagcagacaggcctgcagcagccagcccgcccagatgctgagcgtggacaccggccacgccgacagacaggccagcggcagaatggacgtgagcgccagcgtggagcaggaggccctgagcaacgccttcagaagcgtgcccctggccgaggaggaggacttcgacagcaaggagtgggtgatcatcgacaaggagaccgagctgaaggacttcccccccggcgccgagcccagcaccagcggcaccaccgacgaggagcccgaggagctgagacccctgcccgaggagggcgaggagagaagaagactgggcgccgagccccccttccccctgacccccgccctgggcaccccccccagcaccgagagagtgggcccccacagacccaccgagaccgtgggcggcggccagaccctgggcgccctgccccccgccgtgcagccccccgccaccaccggcgtgctgagagtgctgctgctgcacgccggcgacggcgccctgcccagccccagaagaagaagactgctgggcctgctgagattcccccacagcgcccagcccctgggctag

SEQ ID NO: 11357 - DNA, 447 bp, Artificial Sequence
  Description of Artificial Sequence: Synthetic coding sequence
atggccgccgccatggtgcccggcagaagcgagagctgggagagaggcgagcccggcagacccgccctgtacttctgcggcagcatcagaggcggcagagaggacagaaccctgtacgagagaatcgtgagcagactgagaagattcggcaccgtgctgaccgagcacgtggccgccgccgagctgggcgccagaggcgaggaggccgccggcggcgacagactgatccacgagcaggacctggagtggctgcagcaggccgacgtggtggtggccgaggtgacccagcccagcctgggcgtgggctacgagctgggcagagccgtggccttcaacaagagaatcctgtgcctgttcagaccccagagcggcagaggcgagcaccccaagccccccagctggctgagcatggaccccgccctgagcagcttccccggcggcctgtag

SEQ ID NO: 11358 - DNA, 606 bp, Artificial Sequence
  Description of Artificial Sequence: Synthetic coding sequence
atggtgaacagctgctgcggcagcgtgtgcagcgaccagggctgcggcctggagaactgctgcagacccagctgctgccagaccacctgctgcagaaccacctgctgcagacccagctgctgcgtgagcagctgctgcagaccccagtgctgccagagcgtgtgctgccagcccacctgctgcagacccagctgctgccagaccacctgctgcagaaccacctgctgcagacccagctgctgcgtgagcagctgctgcagaccccagtgctgccagagcgtgtgctgccagcccacctgctgcagacccagctgctgccagaccacctgctgcagaaccacctgctgcagacccagctgctgcgtgagcagctgctgcagaccccagtgctgccagagcgtgtgctgccagcccacctgctgcagacccagctgctgcatcagcagcagctgctgccccagctgctgcgagagcagctgctgcagaccctgctgctgcctgagacccgtgtgcggcagagtgagctgccacaccacctgctacagacccacctgcgtgatcagcacctgccccagacccctgtgctgcgccagcagctgctgctag

SEQ ID NO: 11359 - DNA, 387 bp, Artificial Sequence; identical to SEQ ID NO: 11258
  Description of Artificial Sequence: Synthetic coding sequence

SEQ ID NO: 11360 - DNA, 1140 bp, Artificial Sequence
  Description of Artificial Sequence: Synthetic coding sequence
atgagcctgagactgagcagcgccagcagaagaagctgccccagacccaccaccggcagcctgagactgtacggcggcggcaccagcttcggcaccggcaacagctgcggcatcagcggcatcggcagcggcttcagcagcgccttcggcggcagcagcagcggcggcaacaccggcggcggcaacccctgcgccggcttcaccgtgaacgagagaggcctgctgagcggcaacgagaaggtgaccatgcagaacctgaacgacagactggccagctacctggacagcgtgcacgccctggaggaggccaacgccgacctggagcagaagatcaagggctggtacgagaagttcggccccggcagctgcagaggcctggaccacgactacagcagatacttccccatcatcgacgacctgaagaaccagatcatcgccagcaccaccagcaacgccaacgccgtgctgcagatcgacaacgccagactgaccgccgacgacttcagactgaagtacgagaacgagctggccctgcaccagagcgtggaggccgacgtgaacggcctgagaagagtgctggacgagatcaccctgtgcagaaccgacctggagatccagtacgagaccctgagcgaggagatgacctacctgaagaagaaccacaaggaggagatgcaggtgctgcagtgcgccgccggcggcaacgtgaacgtggagatcgagctgcagagcctgctggccaccaagcacagcctggagtgcagcctgaccgagaccgagagcaactactgcgcccagctggcccagatccaggcccagatcggcgccctggaggagcagctgcaccaggtgagaaccgagaccgagggccagaagctggagtacgagcagctgctggacatcaagctgcacctggagaaggagatcgagacctactgcctgctgatcggcggcgacgacggcgcctgcaagagcggcggctacaagagcaaggactacggcagcggcaacgtgggcagccaggtgaaggaccccgccaaggccatcgtggtgaagaaggtgctggaggaggtggaccagagaagcaagatcctgaccaccagactgcacagcctggaggagaagagccagagcaactag

SEQ ID NO: 11361 - DNA, 768 bp, Artificial Sequence
  Description of Artificial Sequence: Synthetic coding sequence
atggacaaggacgaggaggccctgaaggccgcccaggccgagctgaaggaggccagaagacagtggcaccacctgcaggtggagatcgagagcctgcacgccgtggagagaggcctggagaacagcctgcacgccagcgagcagcactaccagatgcagctgcaggacctggagaccgtgatcgagggcctggagaaggagctgcaggaggtgagaagaggcatcgagaagcagctgcaggagcacgagatgctgctgaacaccaagatgagactggagcaggagatcgccacctacagacacctgctggagaaggaggagatcagatactacggctgcatccagggcggcaagaaggacaagaagcccaccaccagcagagtgggcttcgtgctgcccagcgccatcatcaacgagatcagcttcaccaccaaggtgccccagaagtacgagaacgagaacgtggagaccgtgaccaagcaggccatcctgaacggcagcatcgtgaaggagagcaccgaggcccacggcaccatccagaccgagaaggtggacgaggtgatcaaggagtgggagggcagcttcttcaaggacaaccccagactgagaaagaagagcgtgagcctgagattcgacctgcacctggccgccaccgacgagggctgcctggagaccaagcaggacaacctgcccgacatcgaggtgagactgatcatgagaagaagctgcagcatccccagcatcaagccccccagcaccgccaactag

SEQ ID NO: 11362 - DNA, 888 bp, Artificial Sequence
  Description of Artificial Sequence: Synthetic coding sequence
atggagctgagccagctgctgaacgagatcagagccaactacgagaagatcctgaccagaaaccagatcgagaccgtgctgagcaccagaatccagctggaggaggacatcagcaagaagatggacaaggacgaggaggccctgaaggccgcccaggccgagctgaaggaggccagaagacagtggcaccacctgcaggtggagatcgagagcctgcacgccgtggagagaggcctggagaacagcctgcacgccagcgagcagcactaccagatgcagctgcaggacctggagaccgtgatcgagggcctggagaaggagctgcaggaggtgagaagaggcatcgagaagcagctgcaggagcacgagatgctgctgaacaccaagatgagactggagcaggagatcgccacctacagacacctgctggagaaggaggagatcagatactacggctgcatccagggcggcaagaaggacaagaagcccaccaccagcagagtgggcttcgtgctgcccagcgccatcatcaacgagatcagcttcaccaccaaggtgccccagaagtacgagaacgagaacgtggagaccgtgaccaagcaggccatcctgaacggcagcatcgtgaaggagagcaccgaggcccacggcaccatccagaccgagaaggtggacgaggtgatcaaggagtgggagggcagcttcttcaaggacaaccccagactgagaaagaagagcgtgagcctgagattcgacctgcacctggccgccaccgacgagggctgcctggagaccaagcaggacaacctgcccgacatcgaggtgagactgatcatgagaagaagctgcagcatccccagcatcaagccccccagcaccgccaactag

SEQ ID NO: 11363 - DNA, 1860 bp, Artificial Sequence; identical to SEQ ID NO: 10320
  Description of Artificial Sequence: Synthetic coding sequence

SEQ ID NO: 11364 - DNA, 1860 bp, Artificial Sequence; identical to SEQ ID NO: 10320
  Description of Artificial Sequence: Synthetic coding sequence

SEQ ID NO: 11365 - DNA, 1170 bp, Artificial Sequence
  Description of Artificial Sequence: Synthetic coding sequence
atgctgagatggaccgtgcacctggagggcggccccagaagagtgaaccacgccgccgtggccgtgggccacagagtgtacagcttcggcggctactgcagcggcgaggactacgagaccctgagacagatcgacgtgcacatcttcaacgccgtgagcctgagatggaccaagctgccccccgtgaagagcgccatcagaggccaggcccccgtggtgccctacatgagatacggccacagcaccgtgctgatcgacgacaccgtgctgctgtggggcggcagaaacgacaccgagggcgcctgcaacgtgctgtacgccttcgacgtgaacacccacaagtggttcacccccagagtgagcggcaccgtgcccggcgccagagacggccacagcgcctgcgtgctgggcaagatcatgtacatcttcggcggctacgagcagcaggccgactgcttcagcaacgacatccacaagctggacaccagcaccatgacctggaccctgatctgcaccaagggcagccccgccagatggagagacttccacagcgccaccatgctgggcagccacatgtacgtgttcggcggcagagccgacagattcggccccttccacagcaacaacgagatctactgcaacagaatcagagtgttcgacaccagaaccgaggcctggctggactgcccccccacccccgtgctgcccgagggcagaagaagccacagcgccttcggctacaacggcgagctgtacatcttcggcggctacaacgccagactgaacagacacttccacgacctgtggaagttcaaccccgtgagcttcacctggaagaagatcgagcccaagggcaagggcccctgccccagaagaagacagtgctgctgcatcgtgggcgacaagatcgtgctgttcggcggcaccagccccagccccgaggagggcctgggcgacgagttcgacctgatcgaccacagcgacctgcacatcctggacttcagccccagcctgaagaccctgtgcaagctggccgtgatccagtacaacctggaccagagctgcctgccccacgacatcagatgggagctgaacgccatgaccaccaacagcaacatcagcagacccatcgtgagcagccccttcgcctaccccctgcccagcgcctag

SEQ ID NO: 11366 - DNA, 549 bp, Artificial Sequence
  Description of Artificial Sequence: Synthetic coding sequence
atgcccatcccccccccccccccccccccccccggccccccccccccccccaccttccaccaggccaacaccgagcagcccaagctgagcagagacgagcagagaggcagaggcgccctgctgcaggacatctgcaagggcaccaagctgaagaaggtgaccaacatcaacgacagaagcgcccccatcctggagaccccccccccccccccccccgtgatcagaaacggcgccagagacgcccccccccccccccccccctacagaatgcacggcagcgagccccccagcagaggcaagcccccccccccccccagcagaacccccgccggcccccccccccccccccccccccccctgagaaacggccacagagacagcatcaccaccgtgagaagcttcctggacgacttcgagagcaagtacagcttccaccccgtggaggacttccccgcccccgaggagtacaagcacttccagagaatctaccccagcaagaccaacagagccgccagaggcgccccccccctgccccccatcctgagatag

SEQ ID NO: 11367 - DNA, 831 bp, Artificial Sequence
  Description of Artificial Sequence: Synthetic coding sequence
atgaccagcttcagactggccctgatccagctgcagatcagcagcatcaagagcgacaacgtgaccagagcctgcagcttcatcagagaggccgccacccagggcgccaagatcgtgagcctgcccgagtgcttcaacagcccctacggcgccaagtacttccccgagtacgccgagaagatccccggcgagagcacccagaagctgagcgaggtggccaaggagtgcagcatctacctgatcggcggcagcatccccgaggaggacgccggcaagctgtacaacacctgcgccgtgttcggccccgacggcaccctgctggccaagtacagaaagatccacctgttcgacatcgacgtgcccggcaagatcaccttccaggagagcaagaccctgagccccggcgacagcttcagcaccttcgacaccccctactgcagagtgggcctgggcatctgctacgacatgagattcgccgagctggcccagatctacgcccagagaggctgccagctgctggtgtaccccggcgccttcaacctgaccaccggccccgcccactgggagctgctgcagagaagcagagccgtggacaaccaggtgtacgtggccaccgccagccccgccagagacgacaaggccagctacgtggcctggggccacagcaccgtggtgaacccctggggcgaggtgctggccaaggccggcaccgaggaggccatcgtgtacagcgacatcgacctgaagaagctggccgagatcagacagcagatccccgtgttcagacagaagagaagcgacctgtacgccgtggagatgaagaagccctag

SEQ ID NO: 11368 - DNA, 1476 bp, Artificial Sequence; identical to SEQ ID NO: 9340
  Description of Artificial Sequence: Synthetic coding sequence

SEQ ID NO: 11369 - DNA, 1089 bp, Artificial Sequence
  Description of Artificial Sequence: Synthetic coding sequence
atggcccacagcagcttcttccccgacgagtacttcacctgcagcagcctgtgcctgagctgcggcgtgggctgcaagaagagcatgaaccacggcaaggagggcgtgccccacgaggccaagagcagatgcagatacagccaccagtacgacaacagagtgtacacctgcaaggcctgctacgagagaggcgaggaggtgagcgtggtgcccaagaccagcgccagcaccgacagcccctggatgggcctggccaagtacgcctggagcggctacgtgatcgagtgccccaactgcggcgtggtgtacagaagcagacagtactggttcggcaaccaggaccccgtggacaccgtggtgagaaccgagatcgtgcacgtgtggcccggcaccgacggcttcctgaaggacaacaacaacgccgcccagagactgctggacggcatgaacttcatggcccagagcgtgagcgagctgagcctgggccccaccaaggccgtgaccagctggctgaccgaccagatcgcccccgcctactggagacccaacagccagatcctgagctgcaacaagtgcgccaccagcttcaaggacaacgacaccaagcaccactgcagagcctgcggcgagggcttctgcgacagctgcagcagcaagaccagacccgtgcccgagagaggctggggccccgcccccgtgagagtgtgcgacaactgctacgaggccagaaacgtgcagctggccgtgaccgaggcccaggtggacgacgagggcggcaccctgatcgccagaaaggtgggcgaggccgtgcagaacaccctgggcgccgtggtgaccgccatcgacatccccctgggcctggtgaaggacgccgccagacccgcctactgggtgcccgaccacgagatcctgcactgccacaactgcagaaaggagttcagcatcaagctgagcaagcaccactgcagagcctgcggccagggcttctgcgacgagtgcagccacgacagaagagccgtgcccagcagaggctgggaccaccccgtgagagtgtgcttcaactgcaacaagaagcccggcgacctgtag

SEQ ID NO: 11370 - DNA, 348 bp, Artificial Sequence
  Description of Artificial Sequence: Synthetic coding sequence
atgagcggcgagcccggccagaccagcgtggcccccccccccgaggaggtggagcccggcagcggcgtgagaatcgtggtggagtactgcgagccctgcggcttcgaggccacctacctggagctggccagcgccgtgaaggagcagtaccccggcatcgagatcgagagcagactgggcggcaccggcgccttcgagatcgagatcaacggccagctggtgttcagcaagctggagaacggcggcttcccctacgagaaggacctgatcgaggccatcagaagagccagcaacggcgagaccctggagaagatcaccaacagcagacccccctgcgtgatcctgtag

SEQ ID NO: 11371 - DNA, 507 bp, Artificial Sequence
  Description of Artificial Sequence: Synthetic coding sequence
atgctgttcagactgagcgagcacagcagccccgaggaggaggccagcccccaccagagagccagcggcgagggccaccacctgaagagcaagagacccaacccctgcgcctacaccccccccagcctgaaggccgtgcagagaatcgccgagagccacctgcagagcatcagcaacctgaacgagaaccaggccagcgaggaggaggacgagctgggcgagctgagagagctgggctaccccagagaggaggacgaggaggaggaggaggacgacgaggaggaggaggaggaggaggacagccaggccgaggtgctgaaggtgatcagacagagcgccggccagaagaccacctgcggccagggcctggagggcccctgggagagacccccccccctggacgagagcgagagagacggcggcagcgaggaccaggtggaggaccccgccctgagcgagcccggcgaggagccccagagacccagccccagcgagcccggcacctag

SEQ ID NO: 11372 - DNA, 507 bp, Artificial Sequence; identical to SEQ ID NO: 11371
  Description of Artificial Sequence: Synthetic coding sequence

SEQ ID NO: 11373 - DNA, 648 bp, Artificial Sequence
  Description of Artificial Sequence: Synthetic coding sequence
atggaccccaaggacagaaagaagatccagttcagcgtgcccgccccccccagccagctggaccccagacaggtggagatgatcagaagaagaagacccacccccgccatgctgttcagactgagcgagcacagcagccccgaggaggaggccagcccccaccaggtgacccccctgacctggcacttcccctggcagagagccagcggcgagggccaccacctgaagagcaagagacccaacccctgcgcctacaccccccccagcctgaaggccgtgcagagaatcgccgagagccacctgcagagcatcagcaacctgaacgagaaccaggccagcgaggaggaggacgagctgggcgagctgagagagctgggctaccccagagaggaggacgaggaggaggaggaggacgacgaggaggaggaggaggaggaggacagccaggccgaggtgctgaaggtgatcagacagagcgccggccagaagaccacctgcggccagggcctggagggcccctgggagagacccccccccctggacgagagcgagagagacggcggcagcgaggaccaggtggaggaccccgccctgagcgagcccggcgaggagccccagagacccagccccagcgagcccggcacctag

SEQ ID NO: 11374 - DNA, 5169 bp, Artificial Sequence
  Description of Artificial Sequence: Synthetic coding sequence
atggagagcaacttcaaccaggagggcgtgcccagacccagctacgtgttcagcgccgaccccatcgccagacccagcgagatcaacttcgacggcatcaagctggacctgagccacgagttcagcctggtggcccccaacaccgaggccaacagcttcgagagcaaggactacctgcaggtgtgcctgagaatcagacccttcacccagagcgagaaggagctggagagcgagggctgcgtgcacatcctggacagccagaccgtggtgctgaaggagccccagtgcatcctgggcagactgagcgagaagagcagcggccagatggcccagaagttcagcttcagcaaggtgttcggccccgccaccacccagaaggagttcttccagggctgcatcatgcagcccgtgaaggacctgctgaagggccagagcagactgatcttcacctacggcctgaccaacagcggcaagacctacaccttccagggcaccgaggagaacatcggcatcctgcccagaaccctgaacgtgctgttcgacagcctgcaggagagactgtacaccaagatgaacctgaagccccacagaagcagagagtacctgagactgagcagcgagcaggagaaggaggagatcgccagcaagagcgccctgctgagacagatcaaggaggtgaccgtgcacaacgacagcgacgacaccctgtacggcagcctgaccaacagcctgaacatcagcgagttcgaggagagcatcaaggactacgagcaggccaacctgaacatggccaacagcatcaagttcagcgtgtgggtgagcttcttcgagatctacaacgagtacatctacgacctgttcgtgcccgtgagcagcaagttccagaagagaaagatgctgagactgagccaggacgtgaagggctacagcttcatcaaggacctgcagtggatccaggtgagcgacagcaaggaggcctacagactgctgaagctgggcatcaagcaccagagcgtggccttcaccaagctgaacaacgccagcagcagaagccacagcatcttcaccgtgaagatcctgcagatcgaggacagcgagatgagcagagtgatcagagtgagcgagctgagcctgtgcgacctggccggcagcgagagaaccatgaagacccagaacgagggcgagagactgagagagaccggcaacatcaacaccagcctgctgaccctgggcaagtgcatcaacgtgctgaagaacagcgagaagagcaagttccagcagcacgtgcccttcagagagagcaagctgacccactacttccagagcttcttcaacggcaagggcaagatctgcatgatcgtgaacatcagccagtgctacctggcctacgacgagaccctgaacgtgctgaagttcagcgccatcgcccagaaggtgtgcgtgcccgacaccctgaacagcagccaggagaagctgttcggccccgtgaagagcagccaggacgtgagcctggacagcaacagcaacagcaagatcctgaacgtgaagagagccaccatcagctgggagaacagcctggaggacctgatggaggacgaggacctggtggaggagctggagaacgccgaggagacccagaacgtggagaccaagctgctggacgaggacctggacaagaccctggaggagaacaaggccttcatcagccacgaggagaagagaaagctgctggacctgatcgaggacctgaagaagaagctgatcaacgagaagaaggagaagctgaccctggagttcaagatcagagaggaggtgacccaggagttcacccagtactgggcccagagagaggccgacttcaaggagaccctgctgcaggagagagagatcctggaggagaacgccgagagaagactggccatcttcaaggacctggtgggcaagtgcgacaccagagaggaggccgccaaggacatctgcgccaccaaggtggagaccgaggagacccacaactacgtgggcttcgaggacatcatcgacagcctgcaggacaacgtggccgacatcaagaagcaggccgagatcgcccacctgtacatcgccagcctgcccgacccccaggaggccaccgcctgcctggagctgaagttcaaccagatcaaggccgagctggccaagaccaagggcgagctgatcaagaccaaggaggagctgaagaagagagagaacgagagcgacagcctgatccaggagctggagaccagcaacaagaagatcatcacccagaaccagagaatcaaggagctgatcaacatcatcgaccagaaggaggacaccatcaacgagttccagaacctgaagagccacatggagaacaccttcaagtgcaacgacaaggccgacaccagcagcctgatcatcaacaacaagctgatctgcaacgagaccgtggaggtgcccaaggacagcaagagcaagatctgcagcgagagaaagagagtgaacgagaacgagctgcagcaggacgagccccccgccaagaagggcagcatccacgtgagcagcgccatcaccgaggaccagaagaagagcgaggaggtgagacccaacatcgccgagatcgaggacatcagagtgctgcaggagaacaacgagggcctgagagccttcctgctgaccatcgagaacgagctgaagaacgagaaggaggagaaggccgagctgaacaagcagatcgtgcacttccagcaggagctgagcctgagcgagaagaagaacctgaccctgagcaaggaggtgcagcagatccagagcaactacgacatcgccatcgccgagctgcacgtgcagaagagcaagaaccaggagcaggaggagaagatcatgaagctgagcaacgagatcgagaccgccaccagaagcatcaccaacaacgtgagccagatcaagctgatgcacaccaagatcgacgagctgagaaccctggacagcgtgagccagatcagcaacatcgacctgctgaacctgagagacctgagcaacggcagcgaggaggacaacctgcccaacacccagctggacctgctgggcaacgactacctggtgagcaagcaggtgaaggagtacagaatccaggagcccaacagagagaacagcttccacagcagcatcgaggccatctgggaggagtgcaaggagatcgtgaaggccagcagcaagaagagccaccagatcgaggagctggagcagcagatcgagaagctgcaggccgaggtgaagggctacaaggacgagaacaacagactgaaggagaaggagcacaagaaccaggacgacctgctgaaggagaaggagaccctgatccagcagctgaaggaggagctgcaggagaagaacgtgaccctggacgtgcagatccagcacgtggtggagggcaagagagccctgagcgagctgacccagggcgtgacctgctacaaggccaagatcaaggagctggagaccatcctggagacccagaaggtggagtgcagccacagcgccaagctggagcaggacatcctggagaaggagagcatcatcctgaagctggagagaaacctgaaggagttccaggagcacctgcaggacagcgtgaagaacaccaaggacctgaacgtgaaggagctgaagctgaaggaggagatcacccagctgaccaacaacctgcaggacatgaagcacctgctgcagctgaaggaggaggaggaggagaccaacagacaggagaccgagaagctgaaggaggagctgagcgccagcagcgccagaacccagaacctgaaggccgacctgcagagaaaggaggaggactacgccgacctgaaggagaagctgaccgacgccaagaagcagatcaagcaggtgcagaaggaggtgagcgtgatgagagacgaggacaagctgctgagaatcaagatcaacgagctggagaagaagaagaaccagtgcagccaggagctggacatgaagcagagaaccatccagcagctgaaggagcagctgaacaaccagaaggtggaggaggccatccagcagtacgagagagcctgcaaggacctgaacgtgaaggagaagatcatcgaggacatgagaatgaccctggaggagcaggagcagacccaggtggagcaggaccaggtgctggaggccaagctggaggaggtggagagactggccaccgagctggagaagtggaaggagaagtgcaacgacctggagaccaagaacaaccagagaagcaacaaggagcacgagaacaacaccgacgtgctgggcaagctgaccaacctgcaggacgagctgcaggagagcgagcagaagtacaacgccgacagaaagaagtggctggaggagaagatgatgctgatcacccaggccaaggaggccgagaacatcagaaacaaggagatgaagaagtacgccgaggacagagagagattcttcaagcagcagaacgagatggagatcctgaccgcccagctgaccgagaaggacagcgacctgcagaagtggagagaggagagagaccagctggtggccgccctggagatccagctgaaggccctgatcagcagcaacgtgcagaaggacaacgagatcgagcagctgaagagaatcatcagcgagaccagcaagatcgagacccagatcatggacatcaagcccaagagaatcagcagcgccgaccccgacaagctgcagaccgagcccctgagcaccagcttcgagatcagcagaaacaagatcgaggacggcagcgtggtgctggacagctgcgaggtgagcaccgagaacgaccagagcaccagattccccaagcccgagctggagatccagttcacccccctgcagcccaacaagatggccgtgaagcaccccggctgcaccacccccgtgaccgtgaagatccccaaggccagaaagagaaagagcaacgagatggaggagagcgccagccccccccccaaggagtgcagcagcagccccgccatggagcagagctggaaggagaacgacttcgacaagctgagagaggagggcttcagaagaagcaactacagcgagctgcaggaggagatccagaccaagggcaaggaggtggagaacttcgagaagaacctggactag

SEQ ID NO: 11375 - DNA, 1215 bp, Artificial Sequence
  Description of Artificial Sequence: Synthetic coding sequence
atgagaagagacgtgaacggcgtgaccaagagcagattcgagatgttcagcaacagcgacgaggccgtgatcaacaagaagctgcccaaggagctgctgctgagaatcttcagcttcctggacgtggtgaccctgtgcagatgcgcccaggtgagcagagcctggaacgtgctggccctggacggcagcaactggcagagaatcgacctgttcgacttccagagagacatcgagggcagagtggtggagaacatcagcaagagatgcggcggcttcctgagaaagctgagcctgagaggctgcctgggcgtgggcgacaacgccctgagaaccttcgcccagaactgcagaaacatcgaggtgctgaacctgaacggctgcaccaagaccaccgacgccgagggctgccccctgctggagcagctgaacatcagctggtgcgaccaggtgaccaaggacggcatccaggccctggtgagaggctgcggcggcctgaaggccctgttcctgaagggctgcacccagctggaggacgaggccctgaagtacatcggcgcccactgccccgagctggtgaccctgaacctgcagacctgcctgcagatcaccgacgagggcctgatcaccatctgcagaggctgccacaagctgcagagcctgtgcgccagcggctgcagcaacatcaccgacgccatcctgaacgccctgggccagaactgccccagactgagaatcctggaggtggccagatgcagccagctgaccgacgtgggcttcaccaccctggccagaaactgccacgagctggagaagatggacctggaggagtgcgtgcagatcaccgacagcaccctgatccagctgagcatccactgccccagactgcaggtgctgagcctgagccactgcgagctgatcaccgacgacggcatcagacacctgggcaacggcgcctgcgcccacgaccagctggaggtgatcgagctggacaactgccccctgatcaccgacgccagcctggagcacctgaagagctgccacagcctggagagaatcgagctgtacgactgccagcagatcaccagagccggcatcaagagactgagaacccacctgcccaacatcaaggtgcacgcctacttcgcccccgtgacccccccccccagcgtgggcggcagcagacagagattctgcagatgctgcatcatcctgtag

SEQ ID NO: 11376 - DNA, 1251 bp, Artificial Sequence
  Description of Artificial Sequence: Synthetic coding sequence
atggcccacagccccgtggccgtgcaggtgcccggcatgcagaacaacatcgccgaccccgaggagctgttcaccaagctggagagaatcggcaagggcagcttcggcgaggtgttcaagggcatcgacaacagaacccagcaggtggtggccatcaagatcatcgacctggaggaggccgaggacgagatcgaggacatccagcaggagatcaccgtgctgagccagtgcgacagcagctacgtgaccaagtactacggcagctacctgaagggcagcaagctgtggatcatcatggagtacctgggcggcggcagcgccctggacctgctgagagccggccccttcgacgagttccagatcgccaccatgctgaaggagatcctgaagggcctggactacctgcacagcgagaagaagatccacagagacatcaaggccgccaacgtgctgctgagcgagcagggcgacgtgaagctggccgacttcggcgtggccggccagctgaccgacacccagatcaagagaaacaccttcgtgggcacccccttctggatggcccccgaggtgatccagcagagcgcctacgacagcaaggccgacatctggagcctgggcatcaccgccatcgagctggccaagggcgagccccccaacagcgacatgcaccccatgagagtgctgttcctgatccccaagaacaacccccccaccctggtgggcgacttcaccaagagcttcaaggagttcatcgacgcctgcctgaacaaggaccccagcttcagacccaccgccaaggagctgctgaagcacaagttcatcgtgaagaacagcaagaagaccagctacctgaccgagctgatcgacagattcaagagatggaaggccgagggccacagcgacgacgagagcgacagcgagggcagcgacagcgagagcaccagcagagagaacaacacccaccccgagtggagcttcaccaccgtgagaaagaagcccgaccccaagaaggtgcagaacggcgccgagcaggacctggtgcagaccctgagctgcctgagcatgatcatcacccccgccttcgccgagctgaagcagcaggacgagaacaacgccagcagaaaccaggccatcgaggagctggagaagagcatcgccgtggccgaggccgcctgccccggcatcaccgacaagatggtgaagaagctgatcgagaagttccagaagtgcagcgccgacgagagcccctag

SEQ ID NO: 11377 - DNA, 1020 bp, Artificial Sequence
  Description of Artificial Sequence: Synthetic coding sequence
atggcccacagccccgtggccgtgcaggtgcccggcatgcagggcagcaagctgtggatcatcatggagtacctgggcggcggcagcgccctggacctgctgagagccggccccttcgacgagttccagatcgccaccatgctgaaggagatcctgaagggcctggactacctgcacagcgagaagaagatccacagagacatcaaggccgccaacgtgctgctgagcgagcagggcgacgtgaagctggccgacttcggcgtggccggccagctgaccgacacccagatcaagagaaacaccttcgtgggcacccccttctggatggcccccgaggtgatccagcagagcgcctacgacagcaaggccgacatctggagcctgggcatcaccgccatcgagctggccaagggcgagccccccaacagcgacatgcaccccatgagagtgctgttcctgatccccaagaacaacccccccaccctggtgggcgacttcaccaagagcttcaaggagttcatcgacgcctgcctgaacaaggaccccagcttcagacccaccgccaaggagctgctgaagcacaagttcatcgtgaagaacagcaagaagaccagctacctgaccgagctgatcgacagattcaagagatggaaggccgagggccacagcgacgacgagagcgacagcgagggcagcgacagcgagagcaccagcagagagaacaacacccaccccgagtggagcttcaccaccgtgagaaagaagcccgaccccaagaaggtgcagaacggcgccgagcaggacctggtgcagaccctgagctgcctgagcatgatcatcacccccgccttcgccgagctgaagcagcaggacgagaacaacgccagcagaaaccaggccatcgaggagctggagaagagcatcgccgtggccgaggccgcctgccccggcatcaccgacaagatggtgaagaagctgatcgagaagttccagaagtgcagcgccgacgagagcccctag

SEQ ID NO: 11378 - DNA, 2625 bp, Artificial Sequence; identical to SEQ ID NO: 10537
  Description of Artificial Sequence: Synthetic coding sequence

SEQ ID NO: 11379 - DNA, 1449 bp, Artificial Sequence
  Description of Artificial Sequence: Synthetic coding sequence
atggagcagagcaacctggagaagctggagctgaacgtgagaaagctgcagcaggagctggaccagctgaacagagacaagctgagcctgcacaacgacatcagcgccatgcagcagcagctgcaggagaagagagaggccgtgaacagcctgcaggaggagctggccaacgtgcaggaccacctgaacctggccaagcaggacctgctgcacaccaccaagcaccaggacgtgctgctgagcgagcagaccagactgcagaaggacatcagcgagtgggccaacagattcgaggactgccagaaggaggaggagaccaagcagcagcagctgcaggtgctgcagaacgagatcgaggagaacaagctgaagctggtgcagcaggagatgatgttccagagactgcagaaggagagagagagcgagaagagcaagctggaccaggtgctgagcaaggtgctggccgccgaggagagagtgagaaccctgcaggaggaggagagatggtgcgagagcctggagaagaccctgagccagaccaagagacagctgagcgagagagagcagcagctggtggagaagagcggcgagctgctggccctgcagaaggaggccgacagcatgagagccgacttcagcctgctgagaaaccagttcctgaccgagagaaagaaggccgagaagcaggtggccagcctgaaggaggccctgaagatccagagaagccagctggagaagaacctgctggagcagaagcaggagaacagctgcatccagaaggagatggccaccatcgagctggtggcccaggacaaccacgagagagccagaagactgatgaaggagctgaaccagatgcagtacgagtacaccgagctgaagaagcagatggccaaccagaaggacctggagagaagacagatggagatcagcgacgccatgagaaccctgaagagcgaggtgaaggacgagatcagaaccagcctgaagaacctgaaccagttcctgcccgagctgcccgccgacctggaggccatcctggagagaaacgagaacctggagggcgagctggagagcctgaaggagaacctgcccttcaccatgaacgagggccccttcgaggagaagctgaacttcagccaggtgcacatcatggacgagcactggagaggcgaggccctgagagagaagctgagacacagagaggacagactgaaggcccagctgagacactgcatgagcaagcaggccgaggtgctgatcaagggcaagagacagaccgagggcaccctgcacagcctgagaagacaggtggacgccctgggcgagctggtgaccagcaccagcgccgacagcgccagcagccccagcctgagccagctggagagcagcctgaccgaggacagccagctgggccagaaccaggagaagaacgccagcgccagatag

SEQ ID NO: 11380 - DNA, 3780 bp, Artificial Sequence
  Description of Artificial Sequence: Synthetic coding sequence
atggccctgagacccggcgccggcagcggcggcggcggcgccgccggcgccggcgccggcagcgccggcggcggcggcttcatgttccccgtggccggcggcatcagacccccccaggccggcctgatgcccatgcagcagcagggcttccccatggtgagcgtgatgcagcccaacatgcagggcatcatgggcatgaactacagcagccagatgagccagggccccatcgccatgcaggccggcatccccatgggccccatgcccgccgccggcatgccctacctgggccaggcccccttcctgggcatgagaccccccggcccccagtacacccccgacatgcagaagcagttcgccgaggagcagcagaagagattcgagcagcagcagaagctgctggaggaggagagaaagagaagacagttcgaggagcagaagcagaagctgagactgctgagcagcgtgaagcccaagaccggcgagaagagcagagacgacgccctggaggccatcaagggcaacctggacggcttcagcagagacgccaagatgcaccccacccccgccagccaccccaagaagcccggcgtgggcgtgttccccagccaggaccccgcccagcccagaatgcccccctggatctacaacgagagcctggtgcccgacgcctacaagaagatcctggagaccaccatgacccccaccggcatcgacaccgccaagctgtaccccatcctgatgagcagcggcctgcccagagagaccctgggccagatctgggccctggccaacagaaccacccccggcaagctgaccaaggaggagctgtacaccgtgctggccatgatcgccgtgacccagagaggcgtgcccgccatgagccccgacgccctgaaccagttccccgccgcccccatccccaccctgagcggcttcagcatgaccctgcccacccccgtgagccagcccaccgtgatccccagcggccccgccggcagcatgcccctgagcctgggccagcccgtgatgggcatcaacctggtgggccccgtgggcggcgccgccgcccaggccagcagcggcttcatccccacctaccccgccaaccaggtggtgaagcccgaggaggacgacttccaggacttccaggacgccagcaagagcggcagcctggacgacagcttcagcgacttccaggagctgcccgccagcagcaagaccagcaacagccagcacggcaacagcgcccccagcctgctgatgcccctgcccggcaccaaggccctgcccagcatggacaagtacgccgtgttcaagggcatcgccgccgacaagagcagcgagaacaccgtgccccccggcgaccccggcgacaagtacagcgccttcagagagctggagcagaccgccgagaacaagcccctgggcgagagcttcgccgagttcagaagcgccggcaccgacgacggcttcaccgacttcaagaccgccgacagcgtgagccccctggagccccccaccaaggacaagaccttcccccccagcttccccagcggcaccatccagcagaagcagcagacccaggtgaagaaccccctgaacctggccgacctggacatgttcagcagcgtgaactgcagcagcgagaagcccctgagcttcagcgccgtgttcagcaccagcaagagcgtgagcaccccccagagcaccggcagcgccgccaccatgaccgccctggccgccaccaagaccagcagcctggccgacgacttcggcgagttcagcctgttcggcgagtacagcggcctggcccccgtgggcgagcaggacgacttcgccgacttcatggccttcagcaacagcagcatcagcagcgagcagaagcccgacgacaagtacgacgccctgaaggaggaggccagccccgtgcccctgaccagcaacgtgggcagcaccgtgaagggcggccagaacagcaccgccgccagcaccaagtacgacgtgttcagacagctgagcctggagggcagcggcctgggcgtggaggacctgaaggacaacacccccagcggcaagagcgacgacgacttcgccgacttccacagcagcaagttcagcagcatcaacagcgacaagagcctgggcgagaaggccgtggccttcagacacaccaaggaggacagcgccagcgtgaagagcctggacctgcccagcatcggcggcagcagcgtgggcaaggaggacagcgaggacgccctgagcgtgcagttcgacatgaagctggccgacgtgggcggcgacctgaagcacgtgatgagcgacagcagcctggacctgcccaccgtgagcggccagcacccccccgccgccgacatcgaggacctgaagtacgccgccttcggcagctacagcagcaacttcgccgtgagcaccctgaccagctacgactggagcgacagagacgacgccacccagggcagaaagctgagccccttcgtgctgagcgccggcagcggcagccccagcgccaccagcatcctgcagaagaaggagaccagcttcggcagcagcgagaacatcaccatgaccagcctgagcaaggtgaccaccttcgtgagcgaggacgccctgcccgagaccaccttccccgccctggccagcttcaaggacaccatcccccagaccagcgagcagaaggagtacgagaacagagactacaaggacttcaccaagcaggacctgcccaccgccgagagaagccaggaggccacctgccccagccccgccagcagcggcgccagccaggagacccccaacgagtgcagcgacgacttcggcgagttccagagcgagaagcccaagatcagcaagttcgacttcctggtggccaccagccagagcaagatgaagagcagcgaggagatgatcaagagcgagctggccaccttcgacctgagcgtgcagggcagccacaagagaagcctgagcctgggcgacaaggagatcagcagaagcagccccagccccgccctggagcagcccttcagagacagaagcaacaccctgaacgagaagcccgccctgcccgtgatcagagacaagtacaaggacctgaccggcgaggtggaggagaacgagagatacgcctacgagtggcagagatgcctgggcagcgccctgaacgtgatcaagaaggccaacgacaccctgaacggcatcagcagcagcagcgtgtgcaccgaggtgatccagagcgcccagggcatggagtacctgctgggcgtggtggaggtgtacagagtgaccaagagagtggagctgggcatcaaggccaccgccgtgtgcagcgagaagctgcagcagctgctgaaggacatcgacaaggtgtggaacaacctgatcggcttcatgagcctggccaccctgacctgctgctgggagaagatgaccgtgatcaccaagcacctgagcccctaccacgagctgctggaggagaagcccgacgagaacagcctggacttcagcagctgcatgctgagacccggcatcaagaacgcccaggagctggcctgcggcgtgtgcctgctgaacgtggacagcagaagcagaaaggaggagaagcccgccgaggagcaccccaagaaggccttcaacagcgagaccgacagcttcaagctggcctacggcggccaccagtaccacgccagctgcgccaacttctggatcaactgcgtggagcccaagccccccggcctggtgctgcccgacctgctgtag

SEQ ID NO: 11381 - DNA, 1158 bp, Artificial Sequence
  Description of Artificial Sequence: Synthetic coding sequence
atggccctgagacccggcgccggcagcggcggcggcggcgccgccggcgccggcgccggcagcgccggcggcggcggcttcatgttccccgtggccggcggcatcagacccccccaggccggcctgatgcccatgcagcagcagggcttccccatggtgagcgtgatgcagcccaacatgcagggcatcatgggcatgaactacagcagccagatgagccagggccccatcgccatgcaggccggcatccccatgggccccatgcccgccgccggcatgccctacctgggccaggcccccttcctgggcatgagaccccccggcccccagtacacccccgacatgcagaagcagttcgccgaggagcagcagaagagattcgagcagcagcagaagctgctggaggaggagagaaagagaagacagttcgaggagcagaagcagaagctgagactgctgagcagcgtgaagcccaagaccggcgagaagagcagagacgacgccctggaggccatcaagggcaacctggacggcttcagcagagacgccaagatgcaccccacccccgccagccaccccaagaagcccgactgccccaccagcagccacagcaccaagaccgtgagccccagccccgccttcctggacgaggaggagttcagcgacttcatgcagggccccgtggaggtgcccccctgcggccccagcagcaccagccagcccttccagagcttccaccccagcacccccctgggccagctgcacacccagaaggccggcacccagcccctgccccccagccagagccccgtgcccttcgccctgcacggcgtgcccggccagatcccctacttcagcaccgccagcgccagccacagcgtgcccgaggccggccccagcctggaggagaagttcctggtgagctgcgacatcagcaccagcggccaggagcagatcaagctgaacaccagcgaggtgggccacaaggccctgggccccggcagcagcaagaagtaccccagcctgatggccagcaacggcgtggccgtggacggctgcgtgtgggagtacttcccccacagaatcctgctgagccccgagtgcctgctgggcttcaccatgagagtgtggttccagatgcccatcagaaagagctag

SEQ ID NO: 11382 - DNA, 939 bp, Artificial Sequence
  Description of Artificial Sequence: Synthetic coding sequence
atggccgacttcggcatcagcgccggccagttcgtggccgtggtgtgggacaagagcagccccgtggaggccctgaagggcctggtggacaagctgcaggccctgaccggcaacgagggcagagtgagcgtggagaacatcaagcagctgctgcagagcgcccacaaggagagcagcttcgacatcatcctgagcggcctggtgcccggcagcaccaccctgcacagcgccgagatcctggccgagatcgccagaatcctgagacccggcggctgcctgttcctgaaggagcccgtggagaccgccgtggacaacaacagcaaggtgaagaccgccagcaagctgtgcagcgccctgaccctgagcggcctggtggaggtgaaggagctgcagagagagcccctgacccccgaggaggtgcagagcgtgagagagcacctgggccacgagagcgacaacctgctgttcgtgcagatcaccggcaagaagcccaacttcgaggtgggcagcagcagacagctgaagctgagcatcaccaagaagagcagccccagcgtgaagcccgccgtggaccccgccgccgccaagctgtggaccctgagcgccaacgacatggaggacgacagcatggacctgatcgacagcgacgagctgctggaccccgaggacctgaagaagcccgaccccgccagcctgagagccgccagctgcggcgagggcaagaagagaaaggcctgcaagaactgcacctgcggcctggccgaggagctggagaaggagaagagcagagagcagatgagcagccagcccaagagcgcctgcggcaactgctacctgggcgacgccttcagatgcgccagctgcccctacctgggcatgcccgccttcaagcccggcgagaaggtgctgctgagcgacagcaacctgcacgacgcctag

SEQ ID NO: 11383 - DNA, 1056 bp, Artificial Sequence
  Description of Artificial Sequence: Synthetic coding sequence
atgaacgagagcaacgacagcaccaactacgacatggccccctactacgaggccctgtgcaagagcctggactggcagatcgacgtggacctgctgaacaagatgaagaaggccaacgaggacgagctgaagagactggacgaggagctggaggacgccgagaagaacctgggcgagagcgagatcagagacgccatgatggccaaggccgagtacctgtgcagaatcggcgacaaggagggcgccctgaccgccttcagaaagacctacgacaagaccgtggccctgggccacagactggacatcgtgttctacctgctgagaatcggcctgttctacatggacaacgacctgatcaccagaaacaccgagaaggccaagagcctgatcgaggagggcggcgactgggacagaagaaacagactgaaggtgtaccagggcctgtactgcgtggccatcagagacttcaagcaggccgccgagctgttcctggacaccgtgagcaccttcaccagctacgagctgatggactacaagaccttcgtgacctacaccgtgtacgtgagcatgatcgccctggagagacccgacctgagagagaaggtgatcaagggcgccgagatcctggaggtgctgcacagcctgcccgccgtgagacagtacctgttcagcctgtacgagtgcagatacagcgtgttcttccagagcctggccgtggtggagcaggagatgaagaaggactggctgttcgccccccactacagatactacgtgagagagatgagaatccacgcctacagccagctgctggagagctacagaagcctgaccctgggctacatggccgaggccttcggcgtgggcgtggagttcatcgaccaggagctgagcagattcatcgccgccggcagactgcactgcaagatcgacaaggtgaacgagatcgtggagaccaacagacccgacagcaagaactggcagtaccaggagaccatcaagaagggcgacctgctgctgaacagagtgcagaagctgagcagagtgatcaacatgtag

SEQ ID NO: 11384 - DNA, 414 bp, Artificial Sequence; identical to SEQ ID NO: 10430
  Description of Artificial Sequence: Synthetic coding sequence

SEQ ID NO: 11385 - DNA, 2796 bp, Artificial Sequence; identical to SEQ ID NO: 9514
  Description of Artificial Sequence: Synthetic coding sequence

SEQ ID NO: 11386 - DNA, 318 bp, Artificial Sequence; identical to SEQ ID NO: 10324
  Description of Artificial Sequence: Synthetic coding sequence

SEQ ID NO: 11387 - DNA, 663 bp, Artificial Sequence
  Description of Artificial Sequence: Synthetic coding sequence
atgaacagcatggacagacacatccagcagaccaacgacagactgcagtgcatcaagcagcacctgcagaaccccgccaacttccacaacgccgccaccgagctgctggactggtgcggcgaccccagagccttccagagacccttcgagcagagcctgatgggctgcctgaccgtggtgagcagagtggccgcccagcagggcttcgacctggacctgggctacagactgctggccgtgtgcgccgccaacagagacaagttcacccccaagagcgccgccctgctgagcagctggtgcgaggagctgggcagactgctgctgctgagacaccagaagagcagacagagcgacccccccggcaagctgcccatgcagccccccctgagcagcatgagcagcatgaagcccaccctgagccacagcgacggcagcttcccctacgacagcgtgccctggctgcccgcctaccccgcctgcacccccccccccagccagagccaccccaacagctgcagcctgaagcagaagcagcccctggccttccccccccccctgtgcagcatctggctgaccaccctgcagggcctgctgggcagcctgagctgcgtgcacttcgtgagcggctggagcgtgcccagagagccccacggcctgggctag

SEQ ID NO: 11388 - DNA, 354 bp, Artificial Sequence
  Description of Artificial Sequence: Synthetic coding sequence
atggtgcagagactgacctacagaagaagactgagctacaacaccgccagcaacaagaccagactgagcagaacccccggcaacagaatcgtgtacctgtacaccaagaaggtgggcaaggcccccaagagcgcctgcggcgtgtgccccggcagactgagaggcgtgagagccgtgagacccaaggtgctgatgagactgagcaagaccaagaagcacgtgagcagagcctacggcggcagcatgtgcgccaagtgcgtgagagacagaatcaagagagccttcctgatcgaggagcagaagatcgtggtgaaggtgctgaaggcccaggcccagagccagaaggccaagtag

SEQ ID NO: 11389 - DNA, 354 bp, Artificial Sequence; identical to SEQ ID NO: 11388
  Description of Artificial Sequence: Synthetic coding sequence

SEQ ID NO: 11390 - DNA, 354 bp, Artificial Sequence; identical to SEQ ID NO: 11388
  Description of Artificial Sequence: Synthetic coding sequence

SEQ ID NO: 11391 - DNA, 1902 bp, Artificial Sequence; identical to SEQ ID NO: 10526
  Description of Artificial Sequence: Synthetic coding sequence

SEQ ID NO: 11392 - DNA, 1641 bp, Artificial Sequence
  Description of Artificial Sequence: Synthetic coding sequence
atgaaggccatcaagaagagcctgaccgaggaggagtacctgtacctggacttcagccaccagaccgagggctgcatcttccccctgcacaccagcgtgaccctgttcctgctgagctactgcgactgcaagatcttcaagatctgcctggtggtgaccaaggaggtgagccagtggaccagactgtgcgagctgaccatccccctggccatcgagaacttcctgagagagagcagcgaccagccccccaccatccccgtggagatcctgcagctggagaagaagctgagcgagcccgtgagagtgcacaacgacgacaagctgagaagacagaagctgaagcagcagaaggccgacggcgtgggcccccccctgaccaagggcaaggccaagagcaaggtgcacacccaggagaccagcgagggcctggacagcagcagcaagagcctggagctgaaggtggccttcagcaagctgaccgtgcaggaggagcccgccaccaccaacagagagcccagccacatcagaaaggccaaggccagcgacctgccccccctggagcacgtgttcgccgagggcctgtacttcaccctggccgacatcgtgctgctgccctgcatccaccacttcctggtgatcatcagcagaaagttcagcgagaagctggtggagttccccctgctggccagctggtaccagagaatccaggaggtgcccggcgtgaagaccgccgccagcaagtgcggcatccagttcctgcacctgcccaagctgctgaccaccagcaccgagcagcaccccaacctgtgcgaggtgcccggcgtggaggagcagagcgaccccctgttcatcggcggccccagacccaccatggccaagctgatggagaagggcatcgaggtgatgttcagcccccacccctgccccacctggaccctggactggaacgtgctgcccgccgccgtgagccccaaggagggcaagatgagcagcgacagagccctgagaaagcagcagcagctgaacaacctggtgtacgtggtgaccaaccaggccaagcccggcgacagaatcgtggacttctgcagcggcggcggccacgtgggcatcgtgctggcccacatgctgcccagctgccaggtgaccctgatcgagaacaaggagctgagcctgatcagagccaagaagagaagcgacgagctgggcctgagcaacatctggttcatccaggccaacatggagtacttcaccggcatgttcaacatcggcgtggccctgcacgcctgcggcgtggccaccgacatggtgatcgagcactgcatcaagaccagagccagcttcgtgacctgcccctgctgctacggcttcatccagaacaccagcaagttcaacttccccaagagcgagcagttcaagaagaccctgagctacaaggagcacatgatcctgtgcagattcgccgaccagaccgccgtgcagctgcccccccagagaagactgatcggcaagcagtgcatgtgcctggtggacctggacagagccagagccgccgaggagtgcggctacagcgtgcaggtgatcagcatggagcccgagagctgcagccccaagaacaacatgatcgtgggcgtgcccatctag

SEQ ID NO: 11393 - DNA, 1542 bp, Artificial Sequence
  Description of Artificial Sequence: Synthetic coding sequence
atgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaagatgagaggccagatggagagccacctgaaggagctggagagagtgtgcgacagcctgaccgccgccgagagaagactgcacgagtgccaggagagcctgcagtgctgcaagggcaagtgcgccgaccaggagcacaccatcagagagctgcagggccaggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcaaggcccagcaccaggaggtgtgcctgaaggaggtgcagaacagcctggagaagagcgagaaccagaacgagagcatcaagaactacctgcagttcctgaagaccagctacgtgaccatgttcgagtag

SEQ ID NO: 11394 - DNA, 1167 bp, Artificial Sequence
  Description of Artificial Sequence: Synthetic coding sequence
atggccgccgccgccgccctggccagactggagcagaagcagagcagagcctggggccccaccagccaggacaccatcagaaaccaggtgagaaaggagctgcaggccgaggccaccgtgagcggcagccccgaggcccccggcaccaacgtggtgagcgagcccagagaggagggcagcgcccacctggccgtgcccggcgtgtacttcacctgccccctgaccggcgccaccctgagaaaggaccagagagacgcctgcatcaaggaggccatcctgctgcacttcagcaccgaccccgtggccgccagcatcatgaagatctacaccttcaacaaggaccaggacagagtgaagctgggcgtggacaccatcgccaagtacctggacaacatccacctgcaccccgaggaggagaagtacagaaagatcaagctgcagaacaaggtgttccaggagagaatcaactgcctggagggcacccacgagttcttcgaggccatcggcttccagaaggtgctgctgcccgcccaggaccaggaggaccccgaggagttctacgtgctgagcgagaccaccctggcccagccccagagcctggagagacacaaggagcagctgctggccgccgagcccgtgagagccaagctggacagacagagaagagtgttccagcccagccccctggccagccagttcgagctgcccggcgacttcttcaacctgaccgccgaggagatcaagagagagcagagactgagaagcgaggccgtggagagactgagcgtgctgagaaccaaggccatgagagagaaggaggagcagagaggcctgagaaagtacaactacaccctgctgagagtgagactgcccgacggctgcctgctgcagggcaccttctacgccagagagagactgggcgccgtgtacggcttcgtgagagaggccctgcagagcgactggctgcccttcgagctgctggccagcggcggccagaagctgagcgaggacgagaacctggccctgaacgagtgcggcctggtgcccagcgccctgctgaccttcagctgggacatggccgtgctggaggacatcaaggccgccggcgccgagcccgacagcatcctgaagcccgagctgctgagcgccatcgagaagctgctgtag

SEQ ID NO: 11395 - DNA, 2691 bp, Artificial Sequence
  Description of Artificial Sequence: Synthetic coding sequence
atggacggcgccgccggccccggcgacggccccgccagagaggccctgcagagcctgagccagagactgagagtgcaggagcaggagatggagctggtgaaggccgccctggccgaggccctgagactgctgagactgcaggtgccccccagcagcctgcagggcagcggcacccccgccccccccggcgacagcctggccgccccccccggcctgccccccacctgcacccccagcctggtgagcagaggcacccagaccgagaccgaggtggagctgaagagcagccccggcccccccggcctgagcaacggcccccccgccccccagggcgccagcgaggagcccagcggcacccagagcgagggcggcggcagcagcagcagcggcgccggcagccccggcccccccggcatcctgagacccctgcagcccccccagagagccgacacccccagaagaaacagcagcagcagcagcagccccagcgagagacccagacagaagctgagcagaaaggccatcagcagcgccaacctgctggtgagaagcggcagcaccgagagcagaggcggcaaggaccccctgagcagccccggcggccccggcagcagaagaagcaactacaacctggagggcatcagcgtgaagatgttcctgagaggcagacccatcaccatgtacatccccagcggcatcagaagcctggaggagctgcccagcggccccccccccgagaccctgagcctggactgggtgtacggctacagaggcagagacagcagaagcaacctgttcgtgctgagaagcggcgaggtggtgtacttcatcgcctgcgtggtggtgctgtacagacccggcggcggccccggcggccccggcggcggcggccagagacactacagaggccacaccgactgcgtgagatgcctggccgtgcaccccgacggcgtgagagtggccagcggccagaccgccggcgtggacaaggacggcaagcccctgcagcccgtggtgcacatctgggacagcgagaccctgctgaagctgcaggagatcggcctgggcgccttcgagagaggcgtgggcgccctggccttcagcgccgccgaccagggcgccttcctgtgcgtggtggacgacagcaacgagcacatgctgagcgtgtgggactgcagcagaggcatgaagctggccgagatcaagagcaccaacgacagcgtgctggccgtgggcttcaaccccagagacagcagctgcatcgtgaccagcggcaagagccacgtgcacttctggaactggagcggcggcgtgggcgtgcccggcaacggcaccctgaccagaaagcagggcgtgttcggcaagtacaagaagcccaagttcatcccctgcttcgtgttcctgcccgacggcgacatcctgaccggcgacagcgagggcaacatcctgacctggggcagaagccccagcgacagcaagacccccggcagaggcggcgccaaggagacctacggcatcgtggcccaggcccacgcccacgagggcagcatcttcgccctgtgcctgagaagagacggcaccgtgctgagcggcggcggcagagacagaagactggtgcagtggggccccggcctggtggccctgcaggaggccgagatccccgagcacttcggcgccgtgagagccatcgccgagggcctgggcagcgagctgctggtgggcaccaccaagaacgccctgctgagaggcgacctggcccagggcttcagccccgtgatccagggccacaccgacgagctgtggggcctgtgcacccaccccagccagaacagattcctgacctgcggccacgacagacagctgtgcctgtgggacggcgagagccacgccctggcctggagcatcgacctgaaggagaccggcctgtgcgccgacttccaccccagcggcgccgtggtggccgtgggcctgaacaccggcagatggctggtgctggacaccgagaccagagagatcgtgagcgacgtgatcgacggcaacgagcagctgagcgtggtgagatacagccccgacggcctgtacctggccatcggcagccacgacaacgtgatctacatctacagcgtgagcagcgacggcgccaagagcagcagattcggcagatgcatgggccacagcagcttcatcacccacctggactggagcaaggacggcaacttcatcatgagcaacagcggcgactacgagatcctgtactgggacgtggccggcggctgcaagcagctgaagaacagatacgagagcagagacagagagtgggccacctacacctgcgtgctgggcttccacgtgtacggcgtgtggcccgacggcagcgacggcaccgacatcaacagcctgtgcagaagccacaacgagagagtggtggccgtggccgacgacttctgcaaggtgcacctgttccagtacccctgcgccagagccaaggcccccagcagaatgtacggcggccacggcagccacgtgaccagcgtgagattcacccacgacgacagccacctggtgagcctgggcggcaaggacgccagcatcttccagtggagagtgctgggcgccggcggcgccggccccgcccccgccacccccagcagaacccccagcctgagccccgccagcagcctggacgtgtag

SEQ ID NO: 11396 - DNA, 2934 bp, Artificial Sequence
  Description of Artificial Sequence: Synthetic coding sequence
atgggcgccgaggaggaggtgctggtgaccctgagcggcggcgccccctggggcttcagactgcacggcggcgccgagcagagaaagcccctgcaggtgagcaagatcagaagaagaagccaggccggcagagccggcctgagagagagagaccagctgctggccatcaacggcgtgagctgcaccaacctgagccacgccagcgccatgagcctgatcgacgccagcggcaaccagctggtgctgaccgtgcagagactggccgacgagggccccgtgcagagccccagcccccacgagctgcaggtgctgagccccctgagccccctgagccccgagccccccggcgcccccgtgccccagcccctgcagcccggcagcctgagaagcccccccgacagcgaggcctactacggcgagaccgacagcgacgccgacggccccgccacccaggagaagcccagaagacccagaagaagaggccccaccagacccaccccccccggcgccccccccgacgaggtgtacctgagcgacagccccgccgagcccgcccccaccatccccggcccccccagccagggcgacagcagagtgagcagccccagctgggaggacggcgccgccctgcagcccccccccgccgaggccctgctgctgccccacggccccctgagacccggcccccacctgatccccatggtgggccccgtgccccaccccgtggccgaggacctgaccaccacctacacccagaaggccaagcaggccaagctgcagagagccgagagcctgcaggagaagagcatcaaggaggccaagaccaagtgcagaaccatcgccagcctgctgaccgccgcccccaacccccacagcaagggcgtgctgatgttcaagaagagaagacagagagccaagaagtacaccctggtgagcttcggcgccgccgccggcaccggcgccgaggaggaggacggcgtgccccccaccagcgagagcgagctggacgaggaggccttcagcgacgccagaagcctgaccaaccagagcgactgggacagcccctacctggacatggagctggccagagccggcagcagagccagcgagggccagggcagcggcctgggcggccagctgagcgaggtgagcggcagaggcgtgcagctgttcgagcagcagagacagagagccgacagcagcacccaggagctggccagagtggagcccgccgccatgctgaacggcgagggcctgcagagcccccccagagcccagagcgccccccccgaggccgccgtgctgccccccagccccctgcccgcccccgtggccagccccagacccttccagcccggcggcggcgcccccacccccgcccccagcatcttcaacagaagcgccagacccttcacccccggcctgcagggccagagacccaccaccaccagcgtgatcttcagacccctggcccccaagagagccaacgacagcctgggcggcctgagccccgcccccccccccttcctgagcagccagggccccacccccctgcccagcttcaccagcggcgtgcccagccacgcccccgtgagcggcagccccagcacccccagaagcagcggccccgtgaccgccaccagcagcctgtacatccccgcccccagcagacccgtgacccccggcggcgcccccgagccccccgccccccccagcgccgccgccatgaccagcaccgccagcatcttcctgagcgcccccctgagacccagcgccagacccgaggcccccgcccccggccccggcgcccccgagccccccagcgccagagagcagagaatcagcgtgcccgccgccagaaccggcatcctgcaggaggccagaagaagaggcaccagaaagcagatgttcagacccggcaaggaggagaccaagaacagccccaaccccgagctgctgagcctggtgcagaacctggacgagaagcccagagccggcggcgccgagagcggccccgaggaggacgccctgagcctgggcgccgaggcctgcaacttcatgcagcccgtgggcgccagaagctacaagaccctgccccacgtgacccccaagacccccccccccatggcccccaagacccccccccccatgacccccaagacccccccccccgtggcccccaagccccccagcagaggcctgctggacggcctggtgaacggcgccgccagcagcgccggcatccccgagccccccagactgcagggcagaggcggcgagctgttcgccaagagacagagcagagccgacagatacgtggtggagggcacccccggccccggcctgggccccagacccagaagccccagccccacccccagcctgccccccagctggaagtacagccccaacatcagagcccccccccccatcgcctacaaccccctgctgagccccttcttcccccaggccgccagaaccctgcccaaggcccagagccagggccccagagccacccccaagcagggcatcaaggccctggacttcatgagacaccagccctaccagctgaagaccgccatgttctgcttcgacgaggtgccccccacccccggccccatcgccagcggcagccccaagaccgccagagtgcaggagatcagaagattcagcacccccgccccccagcccaccgccgagcccctggcccccaccgtgctggcccccagagccgccaccaccctggacgagcccatctggagaaccgagctggccagcgcccccgtgcccagccccgcccccccccccgaggcccccagaggcctgggcgccagccccagcagctgcggcttccaggtggccagacccagattcagcgccaccagaaccggcctgcaggcccacgtgtggagacccggcgccggccaccagtag

SEQ ID NO: 11397 - DNA, 2757 bp, Artificial Sequence
  Description of Artificial Sequence: Synthetic coding sequence
atgggcaccaccgcccccggccccatccacctgctggagctgtgcgaccagaagctgatggagttcctgtgcaacatggacaacaaggacctggtgtggctggaggagatccaggaggaggccgagagaatgttcaccagagagttcagcaaggagcccgagctgatgcccaagacccccagccagaagaacagaagaaagaagagaagaatcagctacgtgcaggacgagaacagagaccccatcagaagaagactgagcagaagaaagagcagaagcagccagctgagcagcagaagactgagaagcaaggacagcgtggagaagctggccaccgtggtgggcgagaacggcagcgtgctgagaagagtgaccagagccgccgccgccgccgccgccgccaccatggccctggccgcccccagcagccccacccccgagagccccaccatgctgaccaagaagcccgaggacaaccacacccagtgccagctggtgcccgtggtggagatcggcatcagcgagagacagaacgccgagcagcacgtgacccagctgatgagcaccgagcccctgcccagaaccctgagccccacccccgccagcgccaccgcccccaccagccagggcatccccaccagcgacgaggagagcacccccaagaagagcaaggccagaatcctggagagcatcaccgtgagcagcctgatggccaccccccaggaccccaagggccagggcgtgggcaccggcagaagcgccagcaagctgagaatcgcccaggtgagccccggccccagagacagccccgccttccccgacagcccctggagagagagagtgctggcccccatcctgcccgacaacttcagcacccccaccggcagcagaaccgacagccagagcgtgagacacagccccatcgcccccagcagccccagcccccaggtgctggcccagaagtacagcctggtggccaagcaggagagcgtggtgagaagagccagcagaagactggccaagaagaccgccgaggagcccgccgccagcggcagaatcatctgccacagctacctggagagactgctgaacgtggaggtgccccagaaggtgggcagcgagcagaaggagccccccgaggaggccgagcccgtggccgccgccgagcccgaggtgcccgagaacaacggcaacaacagctggccccacaacgacaccgagatcgccaacagcacccccaaccccaagcccgccgccagcagccccgagacccccagcgccggccagcaggaggccaagaccgaccaggccgacggccccagagagcccccccagagcgccagaagaaagagaagctacaagcaggccgtgagcgagctggacgaggagcagcacctggaggacgaggagctgcagccccccagaagcaagacccccagcagcccctgccccgccagcaaggtggtgagacccctgagaaccttcctgcacaccgtgcagagaaaccagatgctgatgacccccaccagcgcccccagaagcgtgatgaagagcttcatcaagagaaacacccccctgagaatggaccccaagtgcagcttcgtggagaaggagagacagagactggagaacctgagaagaaaggaggaggccgagcagctgagaagacagaaggtggaggaggacaagagaagaagactggaggaggtgaagctgaagagagaggagagactgagaaaggtgctgcaggccagagagagagtggagcagatgaaggaggagaagaagaagcagatcgagcagaagttcgcccagatcgacgagaagaccgagaaggccaaggaggagagactggccgaggagaaggccaagaagaaggccgccgccaagaagatggaggaggtggaggccagaagaaagcaggaggaggaggccagaagactgagatggctgcagcaggaggaggaggagagaagacaccaggagctgctgcagaagaagaaggaggaggagcaggagagactgagaaaggccgccgaggccaagagactggccgagcagagagagcaggagagaagagagcaggagagaagagagcaggagagaagagagcaggagagaagagagcaggagagaagagagcaggagagacagctggccgagcaggagagaagaagagagcaggagagactgcaggccgagagagagctgcaggagagagagaaggccctgagactgcagaaggagcagctgcagagagagctggaggagaagaagaagaaggaggagcagcagagactggccgagagacagctgcaggaggagcaggagaagaaggccaaggaggccgccggcgccagcaaggccctgaacgtgaccgtggacgtgcagagccccgcctgcaccagctaccagatgaccccccagggccacagagccccccccaagatcaaccccgacaactacggcatggacctgaacagcgacgacagcaccgacgacgaggcccaccccagaaagcccatccccacctgggccagaggcacccccctgagccaggccatcatccaccagtactaccacccccccaacctgctggagctgttcggcaccatcctgcccctggacctggaggacatcttcaagaagagcaagcccagataccacaagagaaccagcagcgccgtgtggaacagcccccccctgcagggcgccagagtgcccagcagcctggcctacagcctgaagaagcactag

SEQ ID NO: 11398 - DNA, 1728 bp, Artificial Sequence
  Description of Artificial Sequence: Synthetic coding sequence
atgaccagcaagaagctggtgaacagcgtggccggctgcgccgacgacgccctggccggcctggtggcctgcaaccccaacctgcagctgctgcagggccacagagtggccctgagaagcgacctggacagcctgaagggcagagtggccctgctgagcggcggcggcagcggccacgagcccgcccacgccggcttcatcggcaagggcatgctgaccggcgtgatcgccggcgccgtgttcaccagccccgccgtgggcagcatcctggccgccatcagagccgtggcccaggccggcaccgtgggcaccctgctgatcgtgaagaactacaccggcgacagactgaacttcggcctggccagagagcaggccagagccgagggcatccccgtggagatggtggtgatcggcgacgacagcgccttcaccgtgctgaagaaggccggcagaagaggcctgtgcggcaccgtgctgatccacaaggtggccggcgccctggccgaggccggcgtgggcctggaggagatcgccaagcaggtgaacgtggtggccaaggccatgggcaccctgggcgtgagcctgagcagctgcagcgtgcccggcagcaagcccaccttcgagctgagcgccgacgaggtggagctgggcctgggcatccacggcgaggccggcgtgagaagaatcaagatggccaccgccgacgagatcgtgaagctgatgctggaccacatgaccaacaccaccaacgccagccacgtgcccgtgcagcccggcagcagcgtggtgatgatggtgaacaacctgggcggcctgagcttcctggagctgggcatcatcgccgacgccaccgtgagaagcctggagggcagaggcgtgaagatcgccagagccctggtgggcaccttcatgagcgccctggagatgcccggcatcagcctgaccctgctgctggtggacgagcccctgctgaagctgatcgacgccgagaccaccgccgccgcctggcccaacgtggccgccgtgagcatcaccggcagaaagagaagcagagtggcccccgccgagccccaggaggcccccgacagcaccgccgccggcggcagcgccagcaagagaatggccctggtgctggagagagtgtgcagcaccctgctgggcctggaggagcacctgaacgccctggacagagccgccggcgacggcgactgcggcaccacccacagcagagccgccagagccatccaggagtggctgaaggagggccccccccccgccagccccgcccagctgctgagcaagctgagcgtgctgctgctggagaagatgggcggcagcagcggcgccctgtacggcctgttcctgaccgccgccgcccagcccctgaaggccaagaccagcctgcccgcctggagcgccgccatggacgccggcctggaggccatgcagaagtacggcaaggccgcccccggcgacagaaccatgctggacagcctgtgggccgccggccaggagctgcaggcctggaagagccccggcgccgacctgctgcaggtgctgaccaaggccgtgaagagcgccgaggccgccgccgaggccaccaagaacatggaggccggcgccggcagagccagctacatcagcagcgccagactggagcagcccgaccccggcgccgtggccgccgccgccatcctgagagccatcctggaggtgctgcagagctag

SEQ ID NO: 11399 - DNA, 1080 bp, Artificial Sequence
  Description of Artificial Sequence: Synthetic coding sequence
atggccgccccctgcgccgaggaccccagcctggagagacacttcaagggccacagagacgccgtgacctgcgtggacttcagcatcaacaccaagcagctggccagcggcagcatggacagctgcctgatggtgtggcacatgaagccccagagcagagcctacagattcaccggccacaaggacgccgtgacctgcgtgaacttcagccccagcggccacctgctggccagcggcagcagagacaagaccgtgagaatctgggtgcccaacgtgaagggcgagagcaccgtgttcagagcccacaccgccaccgtgagaagcgtgcacttctgcagcgacggccagagcttcgtgaccgccagcgacgacaagaccgtgaaggtgtgggccacccacagacagaagttcctgttcagcctgagccagcacatcaactgggtgagatgcgccaagttcagccccgacggcagactgatcgtgagcgccagcgacgacaagaccgtgaagctgtgggacaagagcagcagagagtgcgtgcacagctactgcgagcacggcggcttcgtgacctacgtggacttccaccccagcggcacctgcatcgccgccgccggcatggacaacaccgtgaaggtgtgggacgtgagaacccacagactgctgcagcactaccagctgcacagcgccgccgtgaacggcctgagcttccaccccagcggcaactacctgatcaccgccagcagcgacagcaccctgaagatcctggacctgatggagggcagactgctgtacaccctgcacggccaccagggccccgccaccaccgtggccttcagcagaaccggcgagtacttcgccagcggcggcagcgacgagcaggtgatggtgtggaagagcaacttcgacatcgtggaccacggcgaggtgaccaaggtgcccagaccccccgccaccctggccagcagcatgggcaacctgaccgtgagcatcctggagcagagactgaccctgaccgaggacaagctgaagcagtgcctggagaaccagcagctgatcatgcagagagccaccccctag

SEQ ID NO: 11400 - DNA, 633 bp, Artificial Sequence; identical to SEQ ID NO: 10549
  Description of Artificial Sequence: Synthetic coding sequence

SEQ ID NO: 11401 - DNA, 1491 bp, Artificial Sequence
  Description of Artificial Sequence: Synthetic coding sequence
atggaccaggactacgagagaagactgctgagacagatcgtgatccagaacgagaacaccatgcccagagtgaccgagatgagaagaaccctgacccccgccagcagccccgtgagcagccccagcaagcacggcgacagattcatccccagcagagccggcgccaactggagcgtgaacttccacagaatcaacgagaacgagaagagccccagccagaacagaaaggccaaggacgccaccagcgacaacggcaaggacggcctggcctacagcgccctgctgaagaacgagctgctgggcgccggcatcgagaaggtgcaggacccccagaccgaggacagaagactgcagcccagcacccccgagaagaagggcctgttcacctacagcctgagcaccaagagaagcagccccgacgacggcaacgacgtgagcccctacagcctgagccccgtgagcaacaagagccagaagctgctgagaagccccagaaagcccaccagaaagatcagcaagatccccttcaaggtgctggacgcccccgagctgcaggacgacttctacctgaacctggtggactggagcagcctgaacgtgctgagcgtgggcctgggcacctgcgtgtacctgtggagcgcctgcaccagccaggtgaccagactgtgcgacctgagcgtggagggcgacagcgtgaccagcgtgggctggagcgagagaggcaacctggtggccgtgggcacccacaagggcttcgtgcagatctgggacgccgccgccggcaagaagctgagcatgctggagggccacaccgccagagtgggcgccctggcctggaacgccgagcagctgagcagcggcagcagagacagaatgatcctgcagagagacatcagaaccccccccctgcagagcgagagaagactgcagggccacagacaggaggtgtgcggcctgaagtggagcaccgaccaccagctgctggccagcggcggcaacgacaacaagctgctggtgtggaaccacagcagcctgagccccgtgcagcagtacaccgagcacctggccgccgtgaaggccatcgcctggagcccccaccagcacggcctgctggccagcggcggcggcaccgccgacagatgcatcagattctggaacaccctgaccggccagcccctgcagtgcatcgacaccggcagccaggtgtgcaacctggcctggagcaagcacgccaacgagctggtgagcacccacggctacagccagaaccagatcctggtgtggaagtaccccagcctgacccaggtggccaagctgaccggccacagctacagagtgctgtacctggccatgagccccgacggcgaggccatcgtgaccggcgccggcgacgagaccctgagattctggaacgtgttcagcaagaccagaagcaccaaggtgaagtgggagagcgtgagcgtgctgaacctgttcaccagaatcagatag

SEQ ID NO: 11402 - DNA, 390 bp, Artificial Sequence; identical to SEQ ID NO: 10956
  Description of Artificial Sequence: Synthetic coding sequence

SEQ ID NO: 11403 - DNA, 888 bp, Artificial Sequence; identical to SEQ ID NO: 10194
  Description of Artificial Sequence: Synthetic coding sequence

SEQ ID NO: 11404 - DNA, 888 bp, Artificial Sequence; identical to SEQ ID NO: 10194
  Description of Artificial Sequence: Synthetic coding sequence

SEQ ID NO: 11405 - DNA, 354 bp, Artificial Sequence
  Description of Artificial Sequence: Synthetic coding sequence
atgctgtgctggggcaacgccagcttcggccagctgggcctgggcggcatcgacgaggagatcgtgctggagcccagaaagagcgacttcttcatcaacaagagagtgagagacgtgggctgcggcctgagacacaccgtgttcgtgctggacgacggcaccgtgtacacctgcggctgcaacgacctgggccagctgggccacgagaagagcagaaagaagcccgagatcctgaaggtgtgccagatcagcagactgtacagactgctggtggtgaccatcatccacctgcacttcctgaagcaggtgaagagcagcgtgggcgacagaatcaacatggccaactgggtgtag

SEQ ID NO: 11406 - DNA, 3174 bp, Artificial Sequence
  Description of Artificial Sequence: Synthetic coding sequence
atgctgtgctggggcaacgccagcttcggccagctgggcctgggcggcatcgacgaggagatcgtgctggagcccagaaagagcgacttcttcatcaacaagagagtgagagacgtgggctgcggcctgagacacaccgtgttcgtgctggacgacggcaccgtgtacacctgcggctgcaacgacctgggccagctgggccacgagaagagcagaaagaagcccgagcaggtggtggccctggacgcccagaacatcgtggccgtgagctgcggcgaggcccacaccctggccctgaacgacaagggccaggtgtacgcctggggcctggacagcgacggccagctgggcctggtgggcagcgaggagtgcatcagagtgcccagaaacatcaagagcctgagcgacatccagatcgtgcaggtggcctgcggctactaccacagcctggccctgagcaaggccagcgaggtgttctgctggggccagaacaagtacggccagctgggcctgggcaccgactgcaagaagcagaccagcccccagctgctgaagagcctgctgggcatccccttcatgcaggtggccgccggcggcgcccacagcttcgtgctgaccctgagcggcgccatcttcggctggggcagaaacaagttcggccagctgggcctgaacgacgagaacgacagatacgtgcccaacctgctgaagagcctgagaagccagaagatcgtgtacatctgctgcggcgaggaccacaccgccgccctgaccaaggagggcggcgtgttcaccttcggcgccggcggctacggccagctgggccacaacagcaccagccacgagatcaaccccagaaaggtgttcgagctgatgggcagcatcgtgaccgagatcgcctgcggcagacagcacaccagcgccttcgtgcccagcagcggcagaatctacagcttcggcctgggcggcaacggccagctgggcaccggcagcaccagcaacagaaagagccccttcaccgtgaagggcaactggtacccctacaacggccagtgcctgcccgacatcgacagcgaggagtacttctgcgtgaagagaatcttcagcggcggcgaccagagcttcagccactacagcagcccccagaactgcggcccccccgacgacttcagatgccccaaccccaccaagcagatctggaccgtgaacgaggccctgatccagaagtggctgagctaccccagcggcagattccccgtggagatcgccaacgagatcgacggcaccttcagcagcagcggctgcctgaacggcagcttcctggccgtgagcaacgacgaccactacagaaccggcaccagattcagcggcgtggacatgaacgccgccagactgctgttccacaagctgatccagcccgaccacccccagatcagccagcaggtggccgccagcctggagaagaacctgatccccaagctgaccagcagcctgcccgacgtggaggccctgagattctacctgaccctgcccgagtgccccctgatgagcgacagcaacaacttcaccaccatcgccatccccttcggcaccgccctggtgaacctggagaaggcccccctgaaggtgctggagaactggtggagcgtgctggagccccccctgttcctgaagatcgtggagctgttcaaggaggtggtggtgcacctgctgaagctgtacaagatcggcatcccccccagcgagagaagaatcttcaacagcttcctgcacaccgccctgaaggtgctggagatcctgcacagagtgaacgagaagatgggccagatcatccagtacgacaagttctacatccacgaggtgcaggagctgatcgacatcagaaacgactacatcaactgggtgcagcagcaggcctacggcatggacgtgaaccacggcctgaccgagctggccgacatccccgtgaccatctgcacctaccccttcgtgttcgacgcccaggccaagaccaccctgctgcagaccgacgccgtgctgcagatgcagatggccatcgaccaggcccacagacagaacgtgagcagcctgttcctgcccgtgatcgagagcgtgaacccctgcctgatcctggtggtgagaagagagaacatcgtgggcgacgccatggaggtgctgagaaagaccaagaacatcgactacaagaagcccctgaaggtgatcttcgtgggcgaggacgccgtggacgccggcggcgtgagaaaggagttcttcctgctgatcatgagagagctgctggaccccaagtacggcatgttcagatactacgaggacagcagactgatctggttcagcgacaagaccttcgaggacagcgacctgttccacctgatcggcgtgatctgcggcctggccatctacaactgcaccatcgtggacctgcacttccccctggccctgtacaagaagctgctgaagaagaagcccagcctggacgacctgaaggagctgatgcccgacgtgggcagaagcatgcagcagctgctggactaccccgaggacgacatcgaggagaccttctgcctgaacttcaccatcaccgtggagaacttcggcgccaccgaggtgaaggagctggtgctgaacggcgccgacaccgccgtgaacaagcagaacagacaggagttcgtggacgcctacgtggactacatcttcaacaagagcgtggccagcctgttcgacgccttccacgccggcttccacaaggtgtgcggcggcaaggtgctgctgctgttccagcccaacgagctgcaggccatggtgatcggcaacaccaactacgactggaaggagctggagaagaacaccgagtacaagggcgagtactgggccgagcaccccaccatcaagatcttctgggaggtgttccacgagctgcccctggagaagaagaagcagttcctgctgttcctgaccggcagcgacagaatccccatcctgggcatgaagagcctgaagctggtgatccagagcaccggcggcggcgaggagtacctgcccgtgagccacacctgcttcaacctgctggacctgcccaagtacaccgagaaggagaccctgagaagcaagctgatccaggccatcgaccacaacgagggcttcagcctgatctag

SEQ ID NO: 11407 - DNA, 1080 bp, Artificial Sequence; identical to SEQ ID NO: 9386
  Description of Artificial Sequence: Synthetic coding sequence

SEQ ID NO: 11408 - DNA, 714 bp, Artificial Sequence
  Description of Artificial Sequence: Synthetic coding sequence
atggaggtgatggagggccccctgaacctggcccaccagcagagcagaagagccgacagactgctggccgccggcaagtacgaggaggccatcagctgccacaagaaggccgccgcctacctgagcgaggccatgaagctgacccagagcgagcaggcccacctgagcctggagctgcagagagacagccacatgaagcagctgctgctgatccaggagagatggaagagagcccagagagaggagagactgaaggcccagcagaacaccgtgctgtacctgctgcagcagaagagcgagcccgccgagccctgcatcggcagcaaggcccccaaggacgacaagaccatcatcgaggagcaggccaccaagatcgccgacctgaagagacacgtggagttcctggtggccgagaacgagagactgagaaaggagaacaagcagctgaaggccgagaaggccagactgctgaagggccccatcgagaaggagctggacgtggacgccgacttcgtggagaccagcgagctgtggagcctgcccccccacgccgagaccgccaccgccagcagcacctggcagaagttcgccgccaacaccggcaaggccaaggacatccccatccccaacctgccccccctggacttccccagccccgagctgcccctgatggagctgagcgaggacatcctgaagggcttcatgaacaactag

SEQ ID NO: 11409 - DNA, 1458 bp, Artificial Sequence
  Description of Artificial Sequence: Synthetic coding sequence
atgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgcacaacatgaaggtgctgcccggcatgcaccaccccatccagatgaagcccgccgacagcgagaagaacaacgtggaggacagaaagctgttcatcggcatgatcagcaagaagtgcaccgagaacgacatcagagtgatgttcagcagcttcggccagatcgaggagtgcagaatcctgagaggccccgacggcctgagcagaggctgcgccttcgtgaccttcaccaccagagccatggcccagaccgccatcaaggccatgcaccaggcccagaccatggagggctgcagcagccccatggtggtgaagttcgccgacacccagaaggacaaggagcagaagagaatggcccagcagctgcagcagcagatgcagcagatcagcgccgccagcgtgtggggcaacctggccggcctgaacaccctgggcccccagtacctggccctgtacctgcagctgctgcagcagaccgccagcagcggcaacctgaacaccctgagcagcctgcaccccatgggcggcctgaacgccatgcagctgcagaacctggccgccctggccgccgccgccagcgccgcccagaacacccccagcggcaccaacgccctgaccaccagcagcagccccctgagcgtgctgaccagcagcggcagcagccccagcagcagcagcagcaacagcgtgaaccccatcgccagcctgggcgccctgcagaccctggccggcgccaccgccggcctgaacgtgggcagcctggccggcatggccgccctgaacggcggcctgggcagcagcggcctgagcaacggcaccggcagcaccatggaggccctgacccaggcctacagcggcatccagcagtacgccgccgccgccctgcccaccctgtacaaccagaacctgctgacccagcagagcatcggcgccgccggcagccagaaggagggccccgagggcgccaacctgttcatctaccacctgccccaggagttcggcgaccaggacctgctgcagatgttcatgcccttcggcaacgtggtgagcgccaaggtgttcatcgacaagcagaccaacctgagcaagtgcttcggcttcgtgagctacgacaaccccgtgagcgcccaggccgccatccagagcatgaacggcttccagatcggcatgaagagactgaaggtgcagctgaagagaagcaagaacgacagcaagccctactag

SEQ ID NO: 11410 - DNA, 1452 bp, Artificial Sequence
  Description of Artificial Sequence: Synthetic coding sequence
atgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgcacaacatgaaggtgctgcccggcatgcaccaccccatccagatgaagcccgccgacagcgagaagaacaacgccgtggaggacagaaagctgttcatcggcatgatcagcaagaagtgcaccgagaacgacatcagagtgatgttcagcagcttcggccagatcgaggagtgcagaatcctgagaggccccgacggcctgagcagaggctgcgccttcgtgaccttcaccaccagagccatggcccagaccgccatcaaggccatgcaccaggcccagaccatggagggctgcagcagccccatggtggtgaagttcgccgacacccagaaggacaaggagcagaagagaatggcccagcagctgcagcagcagatgcagcagatcagcgccgccagcgtgtggggcaacctggccggcctgaacaccctgggcccccagtacctggccctgctgcagcagaccgccagcagcggcaacctgaacaccctgagcagcctgcaccccatgggcggcctgaacgccatgcagctgcagaacctggccgccctggccgccgccgccagcgccgcccagaacacccccagcggcaccaacgccctgaccaccagcagcagccccctgagcgtgctgaccagcagcgccggcagcagccccagcagcagcagcagcaacagcgtgaaccccatcgccagcctgggcgccctgcagaccctggccggcgccaccgccggcctgaacgtgggcagcctggccggcatggccgccctgaacggcggcctgggcagcagcggcctgagcaacggcaccggcagcaccatggaggccctgacccaggcctacagcggcatccagcagtacgccgccgccgccctgcccaccctgtacaaccagaacctgctgacccagcagagcatcggcgccgccggcagccagaaggagggccccgagggcgccaacctgttcatctaccacctgccccaggagttcggcgaccaggacctgctgcagatgttcatgcccttcggcaacgtggtgagcgccaaggtgttcatcgacaagcagaccaacctgagcaagtgcttcggcttcgtgagctacgacaaccccgtgagcgcccaggccgccatccagagcatgaacggcttccagatcggcatgaagagactgaaggtgcagctgaagagaagcaagaacgacagcaagccctactag

SEQ ID NO: 11411 - DNA, 3570 bp, Artificial Sequence
  Description of Artificial Sequence: Synthetic coding sequence
atggacgacaagggcgaccccagcaacgaggaggcccccaaggccatcaagcccaccagcaaggagttcagaaagacctggggcttcagaagaaccaccatcgccaagagagagggcgccggcgacgccgaggccgaccccctggagcccccccccccccagcagcagctgggcctgagcctgagaagaagcggcagacagcccaagagaaccgagagagtggagcagttcctgaccatcgccagaagaagaggcagaagaagcatgcccgtgagcctggaggacagcggcgagcccaccagctgccccgccaccgacgccgagaccgccagcgagggcagcgtggagagcgccagcgagaccagaagcggcccccagagcgccagcaccgccgtgaaggagagacccgccagcagcgagaaggtgaagggcggcgacgaccacgacgacaccagcgacagcgacagcgacggcctgaccctgaaggagctgcagaacagactgagaagaaagagagagcaggagcccaccgagagacccctgaagggcatccagagcagactgagaaagaagagaagagaggagggccccgccgagaccgtgggcagcgaggccagcgacaccgtggagggcgtgctgcccagcaagcaggagcccgagaacgaccagggcgtggtgagccaggccggcaaggacgacagagagagcaagctggagggcaaggccgcccaggacatcaaggacgaggagcccggcgacctgggcagacccaagcccgagtgcgagggctacgaccccaacgccctgtactgcatctgcagacagccccacaacaacagattcatgatctgctgcgacagatgcgaggagtggttccacggcgactgcgtgggcatcagcgaggccagaggcagactgctggagagaaacggcgaggactacatctgccccaactgcaccatcctgcaggtgcaggacgagacccacagcgagaccgccgaccagcaggaggccaagtggagacccggcgacgccgacggcaccgactgcaccagcatcggcaccatcgagcagaagagcagcgaggaccagggcatcaagggcagaatcgagaaggccgccaaccccagcggcaagaagaagctgaagatcttccagcccgtgatcgaggcccccggcgccagcaagtgcatcggccccggctgctgccacgtggcccagcccgacagcgtgtactgcagcaacgactgcatcctgaagcacgccgccgccaccatgaagttcctgagcagcggcaaggagcagaagcccaagcccaaggagaagatgaagatgaagcccgagaagcccagcctgcccaagtgcggcgcccaggccggcatcaagatcagcagcgtgcacaagagacccgcccccgagaagaaggagaccaccgtgaagaaggccgtggtggtgcccgccagaagcgaggccctgggcaaggaggccgcctgcgagagcagcacccccagctgggccagcgaccacaactacaacgccgtgaagcccgagaagaccgccgcccccagccccagcctgctgtacaagagcaccaaggaggacagaagaagcgaggagaaggccgccgccatggccgccagcaagaagaccgccccccccggcagcgccgtgggcaagcagcccgcccccagaaacctggtgcccaagaagagcagcttcgccaacgtggccgccgccacccccgccatcaagaagccccccagcggcttcaagggcaccatccccaagagaccctggctgagcgccacccccagcagcggcgccagcgccgccagacaggccggccccgcccccgccgccgccaccgccgccagcaagaagttccccggcagcgccgccctggtgggcgccgtgagaaagcccgtggtgcccagcgtgcccatggccagccccgcccccggcagactgggcgccatgagcgccgcccccagccagcccaacagccagatcagacagaacatcagaagaagcctgaaggagatcctgtggaagagagtgaacgacagcgacgacctgatcatgaccgagaacgaggtgggcaagatcgccctgcacatcgagaaggagatgttcaacctgttccaggtgaccgacaacagatacaagagcaagtacagaagcatcatgttcaacctgaaggaccccaagaaccagggcctgttccacagagtgctgagagaggagatcagcctggccaagctggtgagactgaagcccgaggagctggtgagcaaggagctgagcacctggaaggagagacccgccagaagcgtgatggagagcagaaccaagctgcacaacgagagcaagaagaccgcccccagacaggaggccatccccgacctggaggacagcccccccgtgagcgacagcgaggagcagcaggagagcgccagagccgtgcccgagaagagcaccgcccccctgctggacgtgttcagcagcatgctgaaggacaccaccagccagcacagagcccacctgttcgacctgaactgcaagatctgcaccggccaggtgcccagcgccgaggacgagcccgcccccaagaagcagaagctgagcgccagcgtgaagaaggaggacctgaagagcaagcacgacagcagcgcccccgaccccgcccccgacagcgccgacgaggtgatgcccgaggccgtgcccgaggtggccagcgagcccggcctggagagcgccagccaccccaacgtggacagaacctacttccccggcccccccggcgacggccaccccgagcccagccccctggaggacctgagcccctgccccgccagctgcggcagcggcgtggtgaccaccgtgaccgtgagcggcagagaccccagaaccgcccccagcagcagctgcaccgccgtggccagcgccgccagcagacccgacagcacccacatggtggaggccagacaggacgtgcccaagcccgtgctgaccagcgtgatggtgcccaagagcatcctggccaagcccagcagcagccccgaccccagatacctgagcgtgccccccagccccaacatcagcaccagcgagagcagaagcccccccgagggcgacaccaccctgttcctgagcagactgagcaccatctggaagggcttcatcaacatgcagagcgtggccaagttcgtgaccaaggcctaccccgtgagcggctgcttcgactacctgagcgaggacctgcccgacaccatccacatcggcggcagaatcgcccccaagaccgtgtgggactacgtgggcaagctgaagagcagcgtgagcaaggagctgtgcctgatcagattccaccccgccaccgaggaggaggaggtggcctacatcagcctgtacagctacttcagcagcagaggcagattcggcgtggtggccaacaacaacagacacgtgaaggacctgtacctgatccccctgagcgcccaggaccccgtgcccagcaagctgctgcccttcgagggccccggcaagagaagactgagcggctggagatag

SEQ ID NO: 11412 - DNA, 3570 bp, Artificial Sequence; identical to SEQ ID NO: 11411
  Description of Artificial Sequence: Synthetic coding sequence

SEQ ID NO: 11413 - DNA, 6723 bp, Artificial Sequence; identical to SEQ ID NO: 9498
  Description of Artificial Sequence: Synthetic coding sequence

SEQ ID NO: 11414 - DNA, 888 bp, Artificial Sequence; identical to SEQ ID NO: 10194
  Description of Artificial Sequence: Synthetic coding sequence

SEQ ID NO: 11415 - DNA, 834 bp, Artificial Sequence; identical to SEQ ID NO: 10915
  Description of Artificial Sequence: Synthetic coding sequence

SEQ ID NO: 11416 - DNA, 1245 bp, Artificial Sequence
  Description of Artificial Sequence: Synthetic coding sequence
atgggcaccgtgaccgaggacctgatcagaagaaacgccgagcacaacgactgcgtgatcttcagcctggaggagctgagcctgcaccagcaggagatcgagagactggagcacatcgacaagtggtgcagagacctgaagatcctgtacctgcagaacaacctgatcggcaagatcgagaacgtgagcaagctgaagaagctggagtacctgaacctggccctgaacaacatcgagaagatcgagaacctggagggctgcgaggagctggccaagctggacctgaccgtgaacttcatcggcgagctgagcagcatcaagaacctgcagcacaacatccacctgaaggagctgttcctgatgggcaacccctgcgccagcttcgaccactacagagagttcgtggtggccaccctgccccagctgaagtggctggacggcaaggagatcgagcccagcgagagaatcaaggccctgcaggactacagcgtgatcgagccccagatcagagagcaggagaaggaccactgcctgaagagagccaagctgaaggaggaggcccagagaaagcaccaggaggaggacaagaacgaggacaagagaagcaacgccggcttcgacggcagatggtacaccgacatcaacgccaccctgagcagcctggagagcaaggaccacctgcaggcccccgacaccgaggagcacaacaccaagaagctggacaacagcgaggacgacctggagttctggaacaagccctgcctgttcacccccgagagcagactggagaccctgagacacatggagaagcagagaaagaagcaggagaagctgagcgagaagaagaagaaggtgaagccccccagaaccctgatcaccgaggacggcaaggccctgaacgtgaacgagcccaagatcgacttcagcctgaaggacaacgagaagcagatcatcctggacctggccgtgtacagatacatggacaccagcctgatcgacgtggacgtgcagcccacctacgtgagagtgatgatcaagggcaagcccttccagctggtgctgcccgccgaggtgaagcccgacagcagcagcgccaagagaagccagaccaccggccacctggtgatctgcatgcccaaggtgggcgaggtgatcaccggcggccagagagccttcaagagcatgaagaccaccagcgacagaagcagagagcagaccaacaccagctacagcaccggcttctag

SEQ ID NO: 11417 - DNA, 2529 bp, Artificial Sequence
  Description of Artificial Sequence: Synthetic coding sequence
atgagcagcagccacttcgccagcagacacagaaaggacatcagcaccgagatgatcagaaccaagatcgcccacagaaagagcctgagccagaaggagaacagacacaaggagtacgagagaaacagacacttcggcctgaaggacgtgaacatccccaccctggagggcagaatcctggtggagctggacgagaccagccagggcctggtgcccgagaagaccaacgtgaagcccagagccatgaagaccatcctgggcgaccagagaaagcagatgctgcagaagtacaaggaggagaagcagctgcagaagctgaaggagcagagagagaaggccaagagaggcatcttcaaggtgggcagatacagacccgacatgccctgcttcctgctgagcaaccagaacgccgtgaaggccgagcccaagaaggccatccccagcagcgtgagaatcaccagaagcaaggccaaggaccagatggagcagaccaagatcgacaacgagagcgacgtgagagccatcagacccggccccagacagaccagcgagaagaaggtgagcgacaaggagaagaaggtggtgcagcccgtgatgcccaccagcctgagaatgaccagaagcgccacccaggccgccaagcaggtgcccagaaccgtgagcagcaccaccgccagaaagcccgtgaccagagccgccaacgagaacgagcccgagggcaaggtgcccagcaagggcagacccgccaagaacgtggagaccaagcccgacaagggcatcagctgcaaggtggacagcgaggagaacaccctgaacagccagaccaacgccaccagcggcatgaaccccgacggcgtgctgagcaagatggagaacctgcccgagatcaacaccgccaagatcaagggcaagaacagcttcgcccccaaggacttcatgttccagcccctggacggcctgaagacctaccaggtgacccccatgacccccagaagcgccaacgccttcctgacccccagctacacctggacccccctgaagaccgaggtggacgagagccaggccaccaaggagatcctggcccagaagtgcaagacctacagcaccaagaccatccagcaggacagcaacaagctgccctgccccctgggccccctgaccgtgtggcacgaggagcacgtgctgaacaagaacgaggccaccaccaagaacctgaacggcctgcccatcaaggaggtgcccagcctggagagaaacgagggcagaatcgcccagccccaccacggcgtgccctacttcagaaacatcctgcagagcgagaccgagaagctgaccagccactgcttcgagtgggacagaaagctggagctggacatccccgacgacgccaaggacctgatcagaaccgccgtgggccagaccagactgctgatgaaggagagattcaagcagttcgagggcctggtggacgactgcgagtacaagagaggcatcaaggagaccacctgcaccgacctggacggcttctgggacatggtgagcttccagatcgaggacgtgatccacaagttcaacaacctgatcaagctggaggagagcggctggcaggtgaacaacaacatgaaccacaacatgaacaagaacgtgttcagaaagaaggtggtgagcggcatcgccagcaagcccaagcaggacgacgccggcagaatcgccgccagaaacagactggccgccatcaagaacgccatgagagagagaatcagacaggaggagtgcgccgagaccgccgtgagcgtgatccccaaggaggtggacaagatcgtgttcgacgccggcttcttcagagtggagagccccgtgaagctgttcagcggcctgagcgtgagcagcgagggccccagccagagactgggcacccccaagagcgtgaacaaggccgtgagccagagcagaaacgagatgggcatcccccagcagaccaccagccccgagaacgccggcccccagaacaccaagagcgagcacgtgaagaagaccctgttcctgagcatccccgagagcagaagcagcatcgaggacgcccagtgccccggcctgcccgacctgatcgaggagaaccacgtggtgaacaagaccgacctgaaggtggactgcctgagcagcgagagaatgagcctgcccctgctggccggcggcgtggccgacgacatcaacaccaacaagaaggagggcatcagcgacgtggtggagggcatggagctgaacagcagcatcaccagccaggacgtgctgatgagcagccccgagaagaacaccgccagccagaacagcatcctggaggagggcgagaccaagatcagccagagcgagctgttcgacaacaagagcctgaccaccgagtgccacctgctggacagcgtgggcagctgctacgtggccagagccggcctggaggtgctgggcagcagcgaccccaccaccagcgccagcagagtggccggcaccaccgccagaagcaagctgcagtag

SEQ ID NO: 11418 - DNA, 1710 bp, Artificial Sequence
  Description of Artificial Sequence: Synthetic coding sequence
atgctgtgcagccccagcttctgcaagctgtgctggaagagacagagagagaacggccagagaaagtacggcggccccccccccggctgggacgccgccccccccgagagaggctgcgagatcttcatcggcaagctgcccagagacctgttcgaggacgagctgatccccctgtgcgagaagatcggcaagatctacgagatgagaatgatgatggacttcaacggcaacaacagaggctacgccttcgtgaccttcagcaacaaggtggaggccaagaacgccatcaagcagctgaacaactacgagatcagaaacggcagactgctgggcgtgtgcgccagcgtggacaactgcagactgttcgtgggcggcatccccaagaccaagaagagagaggagatcctgagcgagatgaagaaggtgaccgagggcgtggtggacgtgatcgtgtaccccagcgccgccgacaagaccaagaacagaggcttcgccttcgtggagtacgagagccacagagccgccgccatggccagaagaaagctgctgcccggcagaatccagctgtggggccacggcatcgccgtggactgggccgagcccgaggtggaggtggacgaggacaccatgagcagcgtgaagatcctgtacgtgagaaacctgatgctgagcaccagcgaggagatgatcgagaaggagttcaacaacatcaagcccggcgccgtggagagagtgaagaagatcagagactacgccttcgtgcacttcagcaacagagaggacgccgtggaggccatgaaggccctgaacggcaaggtgctggacggcagccccatcgaggtgaccctggccaagcccgtggacaaggacagctacgtgagatacaccagaggcaccggcggcagaggcaccatgctgcagggcgagtacacctacagcctgggccaggtgtacgaccccaccaccacctacctgggcgcccccgtgttctacgccccccagacctacgccgccatccccagcctgcacttccccgccaccaagggccacctgagcaacagagccatcatcagagcccccagcgtgagaggcgccgccggcgtgagaggcctgggcggcagaggctacctggcctacaccggcctgggcagaggctaccaggtgaagggcgacaagagagaggacaagctgtacgacatcctgcccggcatggagctgacccccatgaaccccgtgaccctgaagccccagggcatcaagctggccccccagatcctggaggagatctgccagaagaacaactggggccagcccgtgtaccagctgcacagcgccatcggccaggaccagagacagctgttcctgtacaagatcaccatccccgccctggccagccagaaccccgccatccaccccttcaccccccccaagctgagcgccttcgtggacgaggccaagacctacgccgccgagtacaccctgcagaccctgggcatccccaccgacggcggcgacggcaccatggccaccgccgccgccgccgccaccgccttccccggctacgccgtgcccaacgccaccgcccccgtgagcgccgcccagctgaagcaggccgtgaccctgggccaggacctggccgcctacaccacctacgaggtgtaccccaccttcgccgtgaccgccagaggcgacggctacggcaccttctag

SEQ ID NO: 11419 - DNA, 1764 bp, Artificial Sequence
  Description of Artificial Sequence: Synthetic coding sequence
atgagcaccgccatccccggcctgaagaagggcaacaacgccctgcagagcatcatcctgcagaccctgctggagaaggagaacggccagagaaagtacggcggccccccccccggctgggacgccgccccccccgagagaggctgcgagatcttcatcggcaagctgcccagagacctgttcgaggacgagctgatccccctgtgcgagaagatcggcaagatctacgagatgagaatgatgatggacttcaacggcaacaacagaggctacgccttcgtgaccttcagcaacaaggtggaggccaagaacgccatcaagcagctgaacaactacgagatcagaaacggcagactgctgggcgtgtgcgccagcgtggacaactgcagactgttcgtgggcggcatccccaagaccaagaagagagaggagatcctgagcgagatgaagaaggtgaccgagggcgtggtggacgtgatcgtgtaccccagcgccgccgacaagaccaagaacagaggcttcgccttcgtggagtacgagagccacagagccgccgccatggccagaagaaagctgctgcccggcagaatccagctgtggggccacggcatcgccgtggactgggccgagcccgaggtggaggtggacgaggacaccatgagcagcgtgaagatcctgtacgtgagaaacctgatgctgagcaccagcgaggagatgatcgagaaggagttcaacaacatcaagcccggcgccgtggagagagtgaagaagatcagagactacgccttcgtgcacttcagcaacagagaggacgccgtggaggccatgaaggccctgaacggcaaggtgctggacggcagccccatcgaggtgaccctggccaagcccgtggacaaggacagctacgtgagatacaccagaggcaccggcggcagaggcaccatgctgcagggcgagtacacctacagcctgggccaggtgtacgaccccaccaccacctacctgggcgcccccgtgttctacgccccccagacctacgccgccatccccagcctgcacttccccgccaccaagggccacctgagcaacagagccatcatcagagcccccagcgtgagagagatctacatgaacgtgcccgtgggcgccgccggcgtgagaggcctgggcggcagaggctacctggcctacaccggcctgggcagaggctaccaggtgaagggcgacaagagagaggacaagctgtacgacatcctgcccggcatggagctgacccccatgaaccccgtgaccctgaagccccagggcatcaagctggccccccagatcctggaggagatctgccagaagaacaactggggccagcccgtgtaccagctgcacagcgccatcggccaggaccagagacagctgttcctgtacaagatcaccatccccgccctggccagccagaaccccgccatccaccccttcaccccccccaagctgagcgccttcgtggacgaggccaagacctacgccgccgagtacaccctgcagaccctgggcatccccaccgacggcggcgacggcaccatggccaccgccgccgccgccgccaccgccttccccggctacgccgtgcccaacgccaccgcccccgtgagcgccgcccagctgaagcaggccgtgaccctgggccaggacctggccgcctacaccacctacgaggtgtaccccaccttcgccgtgaccgccagaggcgacggctacggcaccttctag

SEQ ID NO: 11420 - DNA, 1620 bp, Artificial Sequence
  Description of Artificial Sequence: Synthetic coding sequence
atggagagcaaccacaagagcggcgacggcctgagcggcacccagaaggaggccgccctgagagccctggtgcagagaaccggctacagcctggtgcaggagaacggccagagaaagtacggcggccccccccccggctgggacgccgccccccccgagagaggctgcgagatcttcatcggcaagctgcccagagacctgttcgaggacgagctgatccccctgtgcgagaagatcggcaagatctacgagatgagaatgatgatggacttcaacggcaacaacagaggctacgccttcgtgaccttcagcaacaaggtggaggccaagaacgccatcaagcagctgaacaactacgagatcagaaacggcagactgctgggcgtgtgcgccagcgtggacaactgcagactgttcgtgggcggcatccccaagaccaagaagagagaggagatcctgagcgagatgaagaaggtgaccgagggcgtggtggacgtgatcgtgtaccccagcgccgccgacaagaccaagaacagaggcttcgccttcgtggagtacgagagccacagagccgccgccatggccagaagaaagctgctgcccggcgccgtggagagagtgaagaagatcagagactacgccttcgtgcacttcagcaacagagaggacgccgtggaggccatgaaggccctgaacggcaaggtgctggacggcagccccatcgaggtgaccctggccaagcccgtggacaaggacagctacgtgagatacaccagaggcaccggcggcagaggcaccatgctgcagggcgagtacacctacagcctgggccaggtgtacgaccccaccaccacctacctgggcgcccccgtgttctacgccccccagacctacgccgccatccccagcctgcacttccccgccaccaagggccacctgagcaacagagccatcatcagagcccccagcgtgagagagatctacatgaacgtgcccgtgggcgccgccggcgtgagaggcctgggcggcagaggctacctggcctacaccggcctgggcagaggctaccaggtgaagggcgacaagagagaggacaagctgtacgacatcctgcccggcatggagctgacccccatgaaccccgtgaccctgaagccccagggcatcaagctggccccccagatcctggaggagatctgccagaagaacaactggggccagcccgtgtaccagctgcacagcgccatcggccaggaccagagacagctgttcctgtacaagatcaccatccccgccctggccagccagaaccccgccatccaccccttcaccccccccaagctgagcgccttcgtggacgaggccaagacctacgccgccgagtacaccctgcagaccctgggcatccccaccgacggcggcgacggcaccatggccaccgccgccgccgccgccaccgccttccccggctacgccgtgcccaacgccaccgcccccgtgagcgccgcccagctgaagcaggccgtgaccctgggccaggacctggccgcctacaccacctacgaggtgtaccccaccttcgccgtgaccgccagaggcgacggctacggcaccttctag

SEQ ID NO: 11421 - DNA, 1044 bp, Artificial Sequence
  Description of Artificial Sequence: Synthetic coding sequence
ttcagcctgttccccgccgtggacaacgaggaggccgccctgctgcacgaggaggccaccatgaccatcgaggagctgctgaccagatacggccagaactgccacaagggccccccccacagcaagagcggcgccagcgacaagctgcccagagtggccaagagcaagttcttcgaggacagcgaggacgagagcgacgaggccgaggaggaggaggaggacagcgaggagtgcagcgaggaggaggacggctacagcagcgaggaggccgagaacgaggaggacgaggacgacaccgaggaggccgaggaggacgacgaggaggaggaggaggagatgatggtgcccggcatggagggcaaggaggagcccggcagcgacagcggcaccaccgccgtggtggccctgatcagaggcaagcagctgatcgtggccaacgccggcgacagcagatgcgtggtgagcgaggccggcaaggccctggacatgagctacgaccacaagcccgaggacgaggtggagctggccagaatcaagaacgccggcggcaaggtgaccatggacggcagagtgaacggcggcctgaacctgagcagagccatcggcgaccacttctacaagagaaacaagaacctgccccccgaggagcagatgatcagcgccctgcccgacatcaaggtgctgaccctgaccgacgaccacgagttcatggtgatcgcctgcgacggcatctggaacgtgatgagcagccaggaggtggtggacttcatccagagcaagatcagccagagagacgagaacggcgagctgagactgctgagcagcatcgtggaggagctgctggaccagtgcctggcccccgacaccagcggcgacggcaccggctgcgacaacatgacctgcatcatcatctgcttcaagcccagaaacaccgccgagctgcagcccgagagcggcaagagaaagctggaggaggtgctgagcaccgagggcgccgaggagaacggcaacagcgacaagaagaagaaggccaagagagactag

SEQ ID NO: 11422 - DNA, 1218 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccccccatcatgggcatcatcatcgaccacttcgtggacagaccctaccccagcagcagccccatgcacccctgcaactacagaaccgccggcgaggacaccggcgtgatctaccccagcgtggaggacagccaggaggtgtgcaccaccagcttcagcaccagcccccccagccagctgatggtgcccggcaaggagggcggcgtgcccctggcccccaaccagcccgtgcacggcacccaggccgaccaggagagactggccacctgcacccccagcgacagaacccactgcgccgccacccccagcagcagcgaggacaccgagaccgtgagcaacagcagcgagggcagagccagcccccacgacgtgctggagaccatcttcgtgagaaaggtgggcgccttcgtgaacaagcccatcaaccaggtgaccctgaccagcctggacatccccttcgccatgttcgcccccaagaacctggagctggaggacaccgaccccatggtgaacccccccgacagccccgagaccgagagccccctgcagggcagcctgccctgcagctggcccctgccctgcctgctgagccccagcaccgtgtag

SEQ ID NO: 11423 - DNA, 2025 bp, Artificial Sequence; identical to SEQ ID NO: 10426
  Description of Artificial Sequence: Synthetic coding sequence

SEQ ID NO: 11424 - DNA, 2640 bp, Artificial Sequence
  Description of Artificial Sequence: Synthetic coding sequence
atgaactaccccggcagaggcagccccagaagccccgagcacaacggcagaggcggcggcggcggcgcctgggagctgggcagcgacgccagacccgccttcggcggcggcgtgtgctgcttcgagcacctgcccggcggcgaccccgacgacggcgacgtgcccctggccctgctgagaggcgagcccggcctgcacctggcccccggcaccgacgaccacaaccaccacctggccctggacccctgcctgagcgacgagaactacgacttcagcagcgccgagagcggcagcagcctgagatactacagcgagggcgagagcggcggcggcggcagcagcctgagcctgcaccccccccagcagccccccctggtgcccaccaacagcggcggcggcggcgccaccggcggcagccccggcgagagaaagagaaccagactgggcggccccgccgccagacacagatacgaggtggtgaccgagctgggccccgaggaggtgagatggttctacaaggaggacaagaagacctggaagcccttcatcggctacgacagcctgagaatcgagctggccttcagaaccctgctgcagaccaccggcgccagaccccagggcggcgacagagacggcgaccacgtgtgcagccccaccggccccgccagcagcagcggcgaggacgacgacgaggacagagcctgcggcttctgccagagcaccaccggccacgagcccgagatggtggagctggtgaacatcgagcccgtgtgcgtgagaggcggcctgtacgaggtggacgtgacccagggcgagtgctaccccgtgtactggaaccaggccgacaagatccccgtgatgagaggccagtggttcatcgacggcacctggcagcccctggaggaggaggagagcaacctgatcgagcaggagcacctgaactgcttcagaggccagcagatgcaggagaacttcgacatcgaggtgagcaagagcatcgacggcaaggacggcagcggcatcaactacagcgccgtgcacagcttcaagctgagcagaaaccacgtggactggcacagcgtggacgaggtgtacctgtacagcgacgccaccaccagcaagatcgccagaaccgtgacccagaagctgggcttcagcaaggccagcagcagcggcaccagactgcacagaggctacgtggaggaggccaccctggaggacaagcccagccagaccacccacatcgtgttcgtggtgcacggcatcggccagaagatggaccagggcagaatcatcaagaacaccgccatgatgagagaggccgccagaaagatcgaggagagacacttcagcaaccacgccacccacgtggagttcctgcccgtggagtggagaagcaagctgaccctggacggcgacaccgtggacagcatcacccccgacaaggtgagaggcctgagagacatgctgaacagcagcgccatggacatcatgtactacaccagccccctgtacagagacgagctggtgaagggcctgcagcaggagctgaacagactgtacagcctgttctgcagcagaaaccccgacttcgaggagaagggcggcaaggtgagcatcgtgagccacagcctgggctgcgtgatcacctacgacatcatgaccggctggaaccccgtgagactgtacgagcagctgctgcagaaggaggaggagctgcccgacgagagatggatgagctacgaggagagacacctgctggacgagctgtacatcaccaagagaagactgaaggagatcgaggagagactgcacggcctgaaggccagcagcatgacccagacccccgccctgaagttcaaggtggagaacttcttctgcatgggcagccccctggccgtgttcctggccctgagaggcatcagacccggcaacaccggcagccaggaccacatcctgcccagagagatctgcaacagactgctgaacatcttccaccccaccgaccccgtggcctacagactggagcccctgatcctgaagcactacagcaacatcagccccgtgcagatccactggtacaacaccagcaaccccctgccctacgagcacatgaagcccagcttcctgaaccccgccaaggagcccaccagcgtgagcgagaacgagggcatcagcaccatccccagccccgtgaccagccccgtgctgagcagaagacactacggcgagagcatcaccaacatcggcaaggccagcatcctgggcgccgccagcatcggcaagggcctgggcggcatgctgttcagcagattcggcagaagcagcaccacccagagcagcgagaccagcaaggacagcatggaggacgagaagaagcccgtggccagccccagcgccaccaccgtgggcacccagaccctgccccacagcagcagcggcttcctggacagcgccctggagctggaccacagaatcgacttcgagctgagagagggcctggtggagagcagatactggagcgccgtgaccagccacaccgcctactggagcagcctggacgtggccctgttcctgctgaccttcatgtacaagcacgagcacgacgacgacgccaagcccaacctggaccccatctag

SEQ ID NO: 11425 - DNA, 2316 bp, Artificial Sequence
  Description of Artificial Sequence: Synthetic coding sequence
atgaactaccccggcagaggcagccccagaagccccgagcacaacggcagaggcggcggcggcggcgcctgggagctgggcagcgacgccagacccgccttcggcggcggcgtgtgctgcttcgagcacctgcccggcggcgaccccgacgacggcgacgtgcccctggccctgctgagaggcgagcccggcctgcacctggcccccggcaccgacgaccacaaccaccacctggccctggacccctgcctgagcgacgagaactacgacttcagcagcgccgagagcggcagcagcctgagatactacagcgagggcgagagcggcggcggcggcagcagcctgagcctgcaccccccccagcagccccccctggtgcccaccaacagcggcggcggcctgtacgaggtggacgtgacccagggcgagtgctaccccgtgtactggaaccaggccgacaagatccccgtgatgagaggccagtggttcatcgacggcacctggcagcccctggaggaggaggagagcaacctgatcgagcaggagcacctgaactgcttcagaggccagcagatgcaggagaacttcgacatcgaggtgagcaagagcatcgacggcaaggacgccgtgcacagcttcaagctgagcagaaaccacgtggactggcacagcgtggacgaggtgtacctgtacagcgacgccaccaccagcaagatcgccagaaccgtgacccagaagctgggcttcagcaaggccagcagcagcggcaccagactgcacagaggctacgtggaggaggccaccctggaggacaagcccagccagaccacccacatcgtgttcgtggtgcacggcatcggccagaagatggaccagggcagaatcatcaagaacaccgccatgatgagagaggccgccagaaagatcgaggagagacacttcagcaaccacgccacccacgtggagttcctgcccgtggagtggagaagcaagctgaccctggacggcgacaccgtggacagcatcacccccgacaaggtgagaggcctgagagacatgctgaacagcagcgccatggacatcatgtactacaccagccccctgtacagagacgagctggtgaagggcctgcagcaggagctgaacagactgtacagcctgttctgcagcagaaaccccgacttcgaggagaagggcggcaaggtgagcatcgtgagccacagcctgggctgcgtgatcacctacgacatcatgaccggctggaaccccgtgagactgtacgagcagctgctgcagaaggaggaggagctgcccgacgagagatggatgagctacgaggagagacacctgctggacgagctgtacatcaccaagagaagactgaaggagatcgaggagagactgcacggcctgaaggccagcagcatgacccagacccccgccctgaagttcaaggtggagaacttcttctgcatgggcagccccctggccgtgttcctggccctgagaggcatcagacccggcaacaccggcagccaggaccacatcctgcccagagagatctgcaacagactgctgaacatcttccaccccaccgaccccgtggcctacagactggagcccctgatcctgaagcactacagcaacatcagccccgtgcagatccactggtacaacaccagcaaccccctgccctacgagcacatgaagcccagcttcctgaaccccgccaaggagcccaccagcgtgagcgagaacgagggcatcagcaccatccccagccccgtgaccagccccgtgctgagcagaagacactacggcgagagcatcaccaacatcggcaaggccagcatcctgggcgccgccagcatcggcaagggcctgggcggcatgctgttcagcagattcggcagaagcagcaccacccagagcagcgagaccagcaaggacagcatggaggacgagaagaagcccgtggccagccccagcgccaccaccgtgggcacccagaccctgccccacagcagcagcggcttcctggacagcgcctacttcagactgcaggagagcttcttcaacctgccccagctgctgttccccgagaacgtgatgcagaacaaggacaacgccctggtggagctggaccacagaatcgacttcgagctgagagagggcctggtggagagcagatactggagcgccgtgaccagccacaccgcctactggagcagcctggacgtggccctgttcctgctgaccttcatgtacaagcacgagcacgacgacgacgccaagcccaacctggaccccatctag

SEQ ID NO: 11426 - DNA, 1179 bp, Artificial Sequence
  Description of Artificial Sequence: Synthetic coding sequence
atgggcaccacctgcctgcacctgggcaccctggagcagagcctggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgccctacgacagcaccagagtgcccctgggcaagagcaaggactacatcaacgccagctacatcagaatcgtgaactgcggcgaggagtacttctacatcgccacccagggccccctgctgagcaccatcgacgacttctggcagatggtgctggagaacaacagcaacgtgatcgccatgatcaccagagagatcgagggcggcatcatcaagtgctaccactactggcccatcagcctgaagaagcccctggagctgaagcacttcagagtgttcctggagaactaccagatcctgcagtacttcatcatcagaatgttccaggtggtggagaagagcaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 11427 - DNA, 621 bp, Artificial Sequence
  Description of Artificial Sequence: Synthetic coding sequence
atgagcagccccagagacttcagagccgagcccgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatgttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 11428 - DNA, 438 bp, Artificial Sequence
  Description of Artificial Sequence: Synthetic coding sequence
atgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgcccttccagcaccacggctacagcggccccaacgagagaaccaccttctggcacggcagcaacgagggcgccgtgagcctgctgctgagatactgcgcctag

SEQ ID NO: 11429 - DNA, 1020 bp, Artificial Sequence; identical to SEQ ID NO: 10066
  Description of Artificial Sequence: Synthetic coding sequence

SEQ ID NO: 11430 - DNA, 1047 bp, Artificial Sequence
  Description of Artificial Sequence: Synthetic coding sequence
atgcagttcggcgagctgctggccgccgtgagaaaggcccaggccaacgtgatgctgttcctggaggagaaggagcaggccgccctgagccaggccaacggcatcaaggcccacctggagtacagaagcgccgagatggagaagagcaagcaggagctggagaccatggccgccatcagcaacaccgtgcagttcctggaggagtactgcaagttcaagaacaccgaggacatcaccttccccagcgtgtacatcggcctgaaggacaagctgagcggcatcagaaaggtgatcaccgagagcaccgtgcacctgatccagctgctggagaactacaagaagaagctgcaggagttcagcaaggaggaggagtacgacatcagaacccaggtgagcgccatcgtgcagagaaagtactggaccagcaagcccgagcccagcaccagagagcagttcctgcagtacgtgcacgacatcaccttcgaccccgacaccgcccacaagtacctgagactgcaggaggagaacagaaaggtgaccaacaccaccccctgggagcacccctaccccgacctgcccagcagattcctgcactggagacaggtgctgagccagcagagcctgtacctgcacagatactacttcgaggtggagatcttcggcgccggcacctacgtgggcctgacctgcaagggcatcgaccagaagggcgaggagagaagcagctgcatcagcggcaacaacttcagctggagcctgcagtggaacggcaaggagttcaccgcctggtacagcgacatggagacccccctgaaggccggccccttctggagactgggcgtgtacatcgacttccccggcggcatcctgagcttctacggcgtggagtacgacagcatgaccctggtgcacaagttcgcctgcaagttcagcgagcccgtgtacgccgccttctggctgagcaagaaggagaacgccatcagaatcgtggacctgggcgaggagcccgagaagcccgcccccagcctggtgggcaccgccccctag

SEQ ID NO: 11431 - DNA, 1047 bp, Artificial Sequence; identical to SEQ ID NO: 11430
  Description of Artificial Sequence: Synthetic coding sequence

SEQ ID NO: 11432 - DNA, 687 bp, Artificial Sequence
  Description of Artificial Sequence: Synthetic coding sequence
atgatcgacgacagcaccagagtgcccctgggcaagagcaaggactacatcaacgccagctacatcagaatcgtgaactgcggcgaggagtacttctacatcgccacccagggccccctgctgagcaccatcgacgacttctggcagatggtgctggagaacaacagcaacgtgatcgccatgatcaccagagagatcgagggcggcatcatcaagtgctaccactactggcccatcagcctgaagaagcccctggagctgaagcacttcagagtgttcctggagaactaccagatcctgcagtacttcatcatcagaatgttccaggtggtggagaagagcaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 11433 - DNA, 1449 bp, Artificial Sequence; identical to SEQ ID NO: 10502
  Description of Artificial Sequence: Synthetic coding sequence

SEQ ID NO: 11434 - DNA, 1020 bp, Artificial Sequence; identical to SEQ ID NO: 10066
  Description of Artificial Sequence: Synthetic coding sequence

SEQ ID NO: 11435 - DNA, 621 bp, Artificial Sequence; identical to SEQ ID NO: 11427
  Description of Artificial Sequence: Synthetic coding sequence

SEQ ID NO: 11436 - DNA, 438 bp, Artificial Sequence; identical to SEQ ID NO: 11428
  Description of Artificial Sequence: Synthetic coding sequence

SEQ ID NO: 11437 - DNA, 687 bp, Artificial Sequence; identical to SEQ ID NO: 11432
  Description of Artificial Sequence: Synthetic coding sequence

SEQ ID NO: 11438 - DNA, 2802 bp, Artificial Sequence
  Description of Artificial Sequence: Synthetic coding sequence
atgttctggaagttcgacctgaacaccaccagccacgtggacaagctgctggacaaggagcacgtgaccctgcaggagctgatggacgaggacgacatcctgcaggagtgcaaggcccagaaccagaagctgctggacttcctgtgcagacagcagtgcatggaggagctggtgagcctgatcacccaggacccccccctggacatggaggagaaggtgagattcaagtaccccaacaccgcctgcgagctgctgacctgcgacgtgccccagatcagcgacagactgggcggcgacgagagcctgctgagcctgctgtacgacttcctggaccacgagccccccctgaaccccctgctggccagcttcttcagcaagaccatcggcaacctgatcgccagaaagaccgagcaggtgatcaccttcctgaagaagaaggacaagttcatcagcctggtgctgaagcacatcggcaccagcgccctgatggacctgctgctgagactggtgagctgcgtggagcccgccggcctgagacaggacgtgctgcactggctgaacgaggagaaggtgatccagagactggtggagctgatccaccccagccaggacgaggacagacagagcaacgccagccagaccctgtgcgacatcgtgagactgggcagagaccagggcagccagctgcaggaggccctggagcccgaccccctgctgaccgccctggagagcagacaggactgcgtggagcagctgctgaagaacatgttcgacggcgacagaaccgagagctgcctggtgagcggcacccaggtgctgctgaccctgctggagaccagaagagtgggcaccgagggcctggtggacagcttcagccagggcctggagagaagctacgccgtgagcagcagcgtgctgcacggcatcgagcccagactgaaggacttccaccagctgctgctgaacccccccaagaagaaggccatcctgaccaccatcggcgtgctggaggagcccctgggcaacgccagactgcacggcgccagactgatggccgccctgctgcacaccaacacccccagcatcaaccaggagctgtgcagactgaacaccatggacctgctgctggacctgttcttcaagtacacctggaacaacttcctgcacttccaggtggagctgtgcatcgccgccatcctgagccacgccgccagagaggagagaaccgaggccagcggcagcgagagcagagtggagcccccccacgagaacggcaacagaagcctggagaccccccagcccgccgccagcctgcccgacaacaccatggtgacccacctgttccagaagtgctgcctggtgcagagaatcctggaggcctgggaggccaacgaccacacccaggccgccggcggcatgagaagaggcaacatgggccacctgaccagaatcgccaacgccgtggtgcagaacctggagagaggccccgtgcagacccacatcagcgaggtgatcagaggcctgcccgccgactgcagaggcagatgggagagcttcgtggaggagaccctgaccgagaccaacagaagaaacaccgtggacctggccttcagcgactaccagatccagcagatgaccgccaacttcgtggaccagttcggcttcaacgacgaggagttcgccgaccaggacgacaacatcaacgcccccttcgacagaatcgccgagatcaacttcaacatcgacgccgacgaggacagccccagcgccgccctgttcgaggcctgctgcagcgacagaatccagcccttcgacgacgacgaggacgaggacatctgggaggacagcgacaccagatgcgccgccagagtgatggccagacccagattcggcgccccccacgccagcgagagctgcagcaagaacggccccgagagaggcggccaggacggcaaggccagcctggaggcccacagagacgcccccggcgccggcgccccccccgcccccggcaagaaggaggccccccccgtggagggcgacagcgagggcgccatgtggaccgccgtgttcgacgagcccgccaacagcacccccaccgcccccggcgtggtgagagacgtgggcagcagcgtgtgggccgccggcaccagcgcccccgaggagaagggctgggccaagttcaccgacttccagcccttctgctgcagcgagagcggccccagatgcagcagccccgtggacaccgagtgcagccacgccgagggcagcagaagccagggccccgagaaggccttcagccccgccagcccctgcgcctggaacgtgtgcgtgaccagaaaggcccccctgctggccagcgacagcagcagcagcggcggcagccacagcgaggacggcgaccagaaggccgccagcgccatggacgccgtgagcagaggccccggcagagaggccccccccctgcccaccgtggccagaaccgaggaggccgtgggcagagtgggctgcgccgacagcagactgctgagccccgcctgccccgcccccaaggaggtgaccgccgcccccgccgtggccgtgccccccgaggccaccgtggccatcaccaccgccctgagcaaggccggccccgccatccccacccccgccgtgagcagcgccctggccgtggccgtgcccctgggccccatcatggccgtgaccgccgcccccgccatggtggccaccctgggcaccgtgaccaaggacggcaagaccgacgccccccccgagggcgccgccctgaacggccccgtgtag

SEQ ID NO: 11439 - DNA, 2799 bp, Artificial Sequence
  Description of Artificial Sequence: Synthetic coding sequence
atgttctggaagttcgacctgaacaccaccagccacgtggacaagctgctggacaaggagcacgtgaccctgcaggagctgatggacgaggacgacatcctgcaggagtgcaaggcccagaaccagaagctgctggacttcctgtgcagacagcagtgcatggaggagctggtgagcctgatcacccaggacccccccctggacatggaggagaaggtgagattcaagtaccccaacaccgcctgcgagctgctgacctgcgacgtgccccagatcagcgacagactgggcggcgacgagagcctgctgagcctgctgtacgacttcctggaccacgagccccccctgaaccccctgctggccagcttcttcagcaagaccatcggcaacctgatcgccagaaagaccgagcaggtgatcaccttcctgaagaagaaggacaagttcatcagcctggtgctgaagcacatcggcaccagcgccctgatggacctgctgctgagactggtgagctgcgtggagcccgccggcctgagacaggacgtgctgcactggctgaacgaggagaaggtgatccagagactggtggagctgatccaccccagccaggacgaggacagacagagcaacgccagccagaccctgtgcgacatcgtgagactgggcagagaccagggcagccagctgcaggaggccctggagcccgaccccctgctgaccgccctggagagccaggactgcgtggagcagctgctgaagaacatgttcgacggcgacagaaccgagagctgcctggtgagcggcacccaggtgctgctgaccctgctggagaccagaagagtgggcaccgagggcctggtggacagcttcagccagggcctggagagaagctacgccgtgagcagcagcgtgctgcacggcatcgagcccagactgaaggacttccaccagctgctgctgaacccccccaagaagaaggccatcctgaccaccatcggcgtgctggaggagcccctgggcaacgccagactgcacggcgccagactgatggccgccctgctgcacaccaacacccccagcatcaaccaggagctgtgcagactgaacaccatggacctgctgctggacctgttcttcaagtacacctggaacaacttcctgcacttccaggtggagctgtgcatcgccgccatcctgagccacgccgccagagaggagagaaccgaggccagcggcagcgagagcagagtggagcccccccacgagaacggcaacagaagcctggagaccccccagcccgccgccagcctgcccgacaacaccatggtgacccacctgttccagaagtgctgcctggtgcagagaatcctggaggcctgggaggccaacgaccacacccaggccgccggcggcatgagaagaggcaacatgggccacctgaccagaatcgccaacgccgtggtgcagaacctggagagaggccccgtgcagacccacatcagcgaggtgatcagaggcctgcccgccgactgcagaggcagatgggagagcttcgtggaggagaccctgaccgagaccaacagaagaaacaccgtggacctggccttcagcgactaccagatccagcagatgaccgccaacttcgtggaccagttcggcttcaacgacgaggagttcgccgaccaggacgacaacatcaacgcccccttcgacagaatcgccgagatcaacttcaacatcgacgccgacgaggacagccccagcgccgccctgttcgaggcctgctgcagcgacagaatccagcccttcgacgacgacgaggacgaggacatctgggaggacagcgacaccagatgcgccgccagagtgatggccagacccagattcggcgccccccacgccagcgagagctgcagcaagaacggccccgagagaggcggccaggacggcaaggccagcctggaggcccacagagacgcccccggcgccggcgccccccccgcccccggcaagaaggaggccccccccgtggagggcgacagcgagggcgccatgtggaccgccgtgttcgacgagcccgccaacagcacccccaccgcccccggcgtggtgagagacgtgggcagcagcgtgtgggccgccggcaccagcgcccccgaggagaagggctgggccaagttcaccgacttccagcccttctgctgcagcgagagcggccccagatgcagcagccccgtggacaccgagtgcagccacgccgagggcagcagaagccagggccccgagaaggccttcagccccgccagcccctgcgcctggaacgtgtgcgtgaccagaaaggcccccctgctggccagcgacagcagcagcagcggcggcagccacagcgaggacggcgaccagaaggccgccagcgccatggacgccgtgagcagaggccccggcagagaggccccccccctgcccaccgtggccagaaccgaggaggccgtgggcagagtgggctgcgccgacagcagactgctgagccccgcctgccccgcccccaaggaggtgaccgccgcccccgccgtggccgtgccccccgaggccaccgtggccatcaccaccgccctgagcaaggccggccccgccatccccacccccgccgtgagcagcgccctggccgtggccgtgcccctgggccccatcatggccgtgaccgccgcccccgccatggtggccaccctgggcaccgtgaccaaggacggcaagaccgacgccccccccgagggcgccgccctgaacggccccgtgtag

SEQ ID NO: 11440 - DNA, 789 bp, Artificial Sequence; identical to SEQ ID NO: 10456
  Description of Artificial Sequence: Synthetic coding sequence

SEQ ID NO: 11441 - DNA, 2718 bp, Artificial Sequence
  Description of Artificial Sequence: Synthetic coding sequence
atggaggtgcaggtgagccaggccagcctgggcttcgagctgaccagcgtggagaagagcctgagagagtggagcagactgagcagagaggtgatcgcctggctgtgccccagcagccccaacttcatcctgaacttcccccccccccccagcgccagcagcgtgagcatggtgcagctgttcagcagccccttcggctaccagagccccagcggccacagcgaggaggagagagagggcaacatgaagagcgccaagccccaggtgaaccacagccagcacggcgagagccagagagccctgagccccctgcagagcaccctgagcagcgccgccagccccagccaggcctacgagacctacatcgagaacggcctgatctgcctgaagcacaagatcagaaacatcgagaagaagaagctgaagctggaggactacaaggacagactgaagagcggcgagcacctgaaccccgaccagctggaggccgtggagaagtacgaggaggtgctgcacaacctggagttcgccaaggagctgcagaagaccttcagcggcctgagcctggacctgctgaaggcccagaagaaggcccagagaagagagcacatgctgaagctggaggccgagaagaagaagctgagaaccatcctgcaggtgcagtacgtgctgcagaacctgacccaggagcacgtgcagaaggacttcaagggcggcctgaacggcgccgtgtacctgcccagcaaggagctggactacctgatcaagttcagcaagctgacctgccccgagagaaacgagagcctgagcgtggaggaccagatggagcagagcagcctgtacttctgggacctgctggagggcagcgagaaggccgtggtgggcaccacctacaagcacctgaaggacctgctgagcaagctgctgaacagcggctacttcgagagcatccccgtgcccaagaacgccaaggagaaggaggtgcccctggaggaggagatgctgatccagagcgagaagaagacccagctgagcaagaccgagagcgtgaaggagagcgagagcctgatggagttcgcccagcccgagatccagccccaggagttcctgaacagaagatacatgaccgaggtggactacagcaacaagcagggcgaggagcagccctgggaggccgactacgccagaaagcccaacctgcccaagagatgggacatgctgaccgagcccgacggccaggagaagaagcaggagagcttcaagagctgggaggccagcggcaagcaccaggaggtgagcaagcccgccgtgagcctggagcagagaaagcaggacaccagcaagctgagaagcaccctgcccgaggagcagaagaagcaggagatcagcaagagcaagcccagccccagccagtggaagcaggacacccccaagagcaaggccggctacgtgcaggaggagcagaagaagcaggagacccccaagctgtggcccgtgcagctgcagaaggagcaggaccccaagaagcagacccccaagagctggacccccagcatgcagagcgagcagaacaccaccaagagctggaccacccccatgtgcgaggagcaggacagcaagcagcccgagacccccaagagctgggagaacaacgtggagagccagaagcacagcctgaccagccagagccagatcagccccaagagctggggcgtggccaccgccagcctgatccccaacgaccagctgctgcccagaaagctgaacaccgagcccaaggacgtgcccaagcccgtgcaccagcccgtgggcagcagcagcaccctgcccaaggaccccgtgctgagaaaggagaagctgcaggacctgatgacccagatccagggcacctgcaacttcatgcaggagagcgtgctggacttcgacaagcccagcagcgccatccccaccagccagccccccagcgccacccccggcagccccgtggccagcaaggagcagaacctgagcagccagagcgacttcctgcaggagcccctgcaggccgccatcccccccggcaagcagcccagcagcctggccagccccaacccccccatggccaagggcagcgagcagggcttccagagcccccccgccagcagcagcagcgtgaccatcaacaccgcccccttccaggccatgcagaccgtgttcaacgtgaacgcccccctgccccccagaaaggagcaggagatcaaggagagcccctacagccccggctacaaccagagcttcaccaccgccagcacccagacccccccccagtgccagctgcccagcatccacgtggagcagaccgtgcacagccaggagaccgcccagaccaacgtgttccccagacccacccagcccttcgtgaacagcagaggcagcgtgagaggctgcaccagaggcggcagactgatcaccaacagctacagaagccccggcggctacaagggcttcgacacctacagaggcctgcccagcatcagcaacggcaactacagccagctgcagttccaggccagagagtacagcggcgccccctacagccagagagacaacttccagcagtgctacaagagaggcggcaccagcggcggccccagagccaacagcagagccaactgcttcatcatgagaaacagcctgctgctgatcaagcagcagggcggcgtgatcctgctgagatag

SEQ ID NO: 11442 - DNA, 1107 bp, Artificial Sequence; identical to SEQ ID NO: 10791
  Description of Artificial Sequence: Synthetic coding sequence

SEQ ID NO: 11443 - DNA, 1107 bp, Artificial Sequence; identical to SEQ ID NO: 10791
  Description of Artificial Sequence: Synthetic coding sequence

SEQ ID NO: 11444 - DNA, 2745 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggaccccgccttcggcggcaagcacgaggcccccagcagccccatcagcggccagccctgcggcgacgaccagaacgccagccccagcaagctgagcaaggaggagctgatccagagcatggacagagtggacagagagatcgccaaggtggagcagcagatcctgaagctgaagaagaagcagcagcagctggaggaggaggccgccaagccccccgagcccgagaagcccgtgagccccccccccgtggagcagaagcacagaagcatcgtgcagatcatctacgacgagaacagaaagaaggccgaggaggcccacaagatcttcgagggcctgggccccaaggtggagctgcccctgtacaaccagcccagcgacaccaaggtgtaccacgagaacatcaagaccaaccaggtgatgagaaagaagctgatcctgttcttcaagagaagaaaccacgccagaaagcagagagagcagaagatctgccagagatacgaccagctgatggaggcctgggagaagaaggtggacagaatcgagaacaaccccagaagaaaggccaaggagagcaagaccagagagtactacgagaagcagttccccgagatcagaaagcagagagagcagcaggagagattccagagagtgggccagagaggcgccggcctgagcgccaccatcgccagaagcgagcacgagatcagcgagatcatcgacggcctgagcgagcaggagaacaacgagaagcagatgagacagctgagcgtgatcccccccatgatgttcgacgccgagcagagaagagtgaagttcatcaacatgaacggcctgatggaggaccccatgaaggtgtacaaggacagacagttcatgaacgtgtggaccgaccacgagaaggagatcttcaaggacaagttcatccagcaccccaagaacttcggcctgatcgccagctacctggagagaaagagcgtgcccgactgcgtgctgtactactacctgaccaagaagaacgagaactacaaggccctggtgagaagaaactacggcaagagaagaggcagaaaccagcagatcgccagacccagccaggaggagaaggtggaggagaaggaggaggacaaggccgagaagaccgagaagaaggaggaggagaagaaggacgaggaggagaaggacgagaaggaggacagcaaggagaacaccaaggagaaggacaagatcgacggcaccgccgaggagaccgaggagagagagcaggccacccccagaggcagaaagaccgccaacagccagggcagaagaaagggcagaatcaccagaagcatgaccaacgaggccgccgccgccagcgccgccgccgccgccgccaccgaggagccccccccccccctgccccccccccccgagcccatcagcaccgagcccgtggagaccagcagatggaccgaggaggagatggaggtggccaagaagggcctggtggagcacggcagaaactgggccgccatcgccaagatggtgggcaccaagagcgaggcccagtgcaagaacttctacttcaactacaagagaagacacaacctggacaacctgctgcagcagcacaagcagaagaccagcagaaagcccagagaggagagagacgtgagccagtgcgagagcgtggccagcaccgtgagcgcccaggaggacgaggacatcgaggccagcaacgaggaggagaaccccgaggacagcgagggcgccgagaacagcagcgacaccgagagcgcccccagccccagccccgtggaggccgtgaagcccagcgaggacagccccgagaacgccaccagcagaggcaacaccgagcccgccgtggagctggagcccaccaccgagaccgcccccagcaccagccccagcctggccgtgcccagcaccaagcccgccgaggacgagagcgtggagacccaggtgaacgacagcatcagcgccgagaccgccgagcagatggacgtggaccagcaggagcacagcgccgaggagggcagcgtgtgcgaccccccccccgccaccaaggccgacagcgtggacgtggaggtgagagtgcccgagaaccacgccagcaaggtggagggcgacaacaccaaggagagagacctggacagagccagcgagaaggtggagcccagagacgaggacctggtggtggcccagcagatcaacgcccagagacccgagccccagagcgacaacgacagcagcgccacctgcagcgccgacgaggacgtggacggcgagcccgagagacagagaatgttccccatggacagcaagcccagcctgctgaaccccaccggcagcatcctggtgagcagccccctgaagcccaaccccctggacctgccccagctgcagcacagagccgccgtgatcccccccatggtgagctgcaccccctgcaacatccccatcggcacccccgtgagcggctacgccctgtaccagagacacatcaaggccatgcacgagagcgccctgctggaggagcagagacagagacaggagcagatcgacctggagtgcagaagcagcaccagcccctgcggcaccagcaagagccccaacagagagtgggagggcagatag

SEQ ID NO: 11445 - DNA, 7032 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggaccccgccttcggcggcaagcacgaggcccccagcagccccatcagcggccagccctgcggcgacgaccagaacgccagccccagcaagctgagcaaggaggagctgatccagagcatggacagagtggacagagagatcgccaaggtggagcagcagatcctgaagctgaagaagaagcagcagcagctggaggaggaggccgccaagccccccgagcccgagaagcccgtgagccccccccccgtggagcagaagcacagaagcatcgtgcagatcatctacgacgagaacagaaagaaggccgaggaggcccacaagatcttcgagggcctgggccccaaggtggagctgcccctgtacaaccagcccagcgacaccaaggtgtaccacgagaacatcaagaccaaccaggtgatgagaaagaagctgatcctgttcttcaagagaagaaaccacgccagaaagcagagagagcagaagatctgccagagatacgaccagctgatggaggcctgggagaagaaggtggacagaatcgagaacaaccccagaagaaaggccaaggagagcaagaccagagagtactacgagaagcagttccccgagatcagaaagcagagagagcagcaggagagattccagagagtgggccagagaggcgccggcctgagcgccaccatcgccagaagcgagcacgagatcagcgagatcatcgacggcctgagcgagcaggagaacaacgagaagcagatgagacagctgagcgtgatcccccccatgatgttcgacgccgagcagagaagagtgaagttcatcaacatgaacggcctgatggaggaccccatgaaggtgtacaaggacagacagttcatgaacgtgtggaccgaccacgagaaggagatcttcaaggacaagttcatccagcaccccaagaacttcggcctgatcgccagctacctggagagaaagagcgtgcccgactgcgtgctgtactactacctgaccaagaagaacgagaactacaaggccctggtgagaagaaactacggcaagagaagaggcagaaaccagcagatcgccagacccagccaggaggagaaggtggaggagaaggaggaggacaaggccgagaagaccgagaagaaggaggaggagaagaaggacgaggaggagaaggacgagaaggaggacagcaaggagaacaccaaggagaaggacaagatcgacggcaccgccgaggagaccgaggagagagagcaggccacccccagaggcagaaagaccgccaacagccagggcagaagaaagggcagaatcaccagaagcatgaccaacgaggccgccgccgccagcgccgccgccgccgccgccaccgaggagccccccccccccctgccccccccccccgagcccatcagcaccgagcccgtggagaccagcagatggaccgaggaggagatggaggtggccaagaagggcctggtggagcacggcagaaactgggccgccatcgccaagatggtgggcaccaagagcgaggcccagtgcaagaacttctacttcaactacaagagaagacacaacctggacaacctgctgcagcagcacaagcagaagaccagcagaaagcccagagaggagagagacgtgagccagtgcgagagcgtggccagcaccgtgagcgcccaggaggacgaggacatcgaggccagcaacgaggaggagaaccccgaggacagcgagggcgccgagaacagcagcgacaccgagagcgcccccagccccagccccgtggaggccgtgaagcccagcgaggacagccccgagaacgccaccagcagaggcaacaccgagcccgccgtggagctggagcccaccaccgagaccgcccccagcaccagccccagcctggccgtgcccagcaccaagcccgccgaggacgagagcgtggagacccaggtgaacgacagcatcagcgccgagaccgccgagcagatggacgtggaccagcaggagcacagcgccgaggagggcagcgtgtgcgaccccccccccgccaccaaggccgacagcgtggacgtggaggtgagagtgcccgagaaccacgccagcaaggtggagggcgacaacaccaaggagagagacctggacagagccagcgagaaggtggagcccagagacgaggacctggtggtggcccagcagatcaacgcccagagacccgagccccagagcgacaacgacagcagcgccacctgcagcgccgacgaggacgtggacggcgagcccgagagacagagaatgttccccatggacagcaagcccagcctgctgaaccccaccggcagcatcctggtgagcagccccctgaagcccaaccccctggacctgccccagctgcagcacagagccgccgtgatcccccccatggtgagctgcaccccctgcaacatccccatcggcacccccgtgagcggctacgccctgtaccagagacacatcaaggccatgcacgagagcgccctgctggaggagcagagacagagacaggagcagatcgacctggagtgcagaagcagcaccagcccctgcggcaccagcaagagccccaacagagagtgggaggtgctgcagcccgccccccaccaggtgatcaccaacctgcccgagggcgtgagactgcccaccaccagacccaccagaccccccccccccctgatccccagcagcaagaccaccgtggccagcgagaagcccagcttcatcatgggcggcagcatcagccagggcacccccggcacctacctgaccagccacaaccaggccagctacacccaggagacccccaagcccagcgtgggcagcatcagcctgggcctgcccagacagcaggagagcgccaagagcgccaccctgccctacatcaagcaggaggagttcagccccagaagccagaacagccagcccgagggcctgctggtgagagcccagcacgagggcgtggtgagaggcaccgccggcgccatccaggagggcagcatcaccagaggcacccccaccagcaagatcagcgtggagagcatccccagcctgagaggcagcatcacccagggcacccccgccctgccccagaccggcatccccaccgaggccctggtgaagggcagcatcagcagaatgcccatcgaggacagcagccccgagaagggcagagaggaggccgccagcaagggccacgtgatctacgagggcaagagcggccacatcctgagctacgacaacatcaagaacgccagagagggcaccagaagccccagaaccgcccacgagatcagcctgaagagaagctacgagagcgtggagggcaacatcaagcagggcatgagcatgagagagagccccgtgagcgcccccctggagggcctgatctgcagagccctgcccagaggcagcccccacagcgacctgaaggagagaaccgtgctgagcggcagcatcatgcagggcacccccagagccaccaccgagagcttcgaggacggcctgaagtaccccaagcagatcaagagagagagcccccccatcagagccttcgagggcgccatcaccaagggcaagccctacgacggcatcaccaccatcaaggagatgggcagaagcatccacgagatccccagacaggacatcctgacccaggagagcagaaagacccccgaggtggtgcagagcaccagacccatcatcgagggcagcatcagccagggcacccccatcaagttcgacaacaacagcggccagagcgccatcaagcacaacgtgaagagcctgatcaccggccccagcaagctgagcagaggcatgccccccctggagatcgtgcccgagaacatcaaggtggtggagagaggcaagtacgaggacgtgaaggccggcgagaccgtgagaagcagacacaccagcgtggtgagcagcggccccagcgtgctgagaagcaccctgcacgaggcccccaaggcccagctgagccccggcatctacgacgacaccagcgccagaagaacccccgtgagctaccagaacaccatgagcagaggcagccccatgatgaacagaaccagcgacgtgagcagcaacaagagcaccaaccacgagagaaagagcaccctgacccccacccagagagagagcatccccgccaagagccccgtgcccggcgtggaccccgtggtgagccacagccccttcgacccccaccacagaggcagcaccgccggcgaggtgtacagaagccacctgcccacccacctggaccccgccatgcccttccacagagccctggaccccgccgccgcctacctgttccagagacagctgagccccacccccggctaccccagccagtaccagctgtacgccatggagaacaccagacagaccatcctgaacgactacatcaccagccagcagatgcaggtgaacctgagacccgacgtggccagaggcctgagccccagagagcagcccctgggcctgccctaccccgccaccagaggcatcatcgacctgaccaacatgccccccaccatcctggtgccccaccccggcggcaccagcaccccccccatggacagaatcacctacatccccggcacccagatcaccttcccccccagaccctacaacagcgccagcatgagccccggccaccccacccacctggccgccgccgccagcgccgagagagagagagagagagagagagagaaggagagagagagagagagaatcgccgccgccagcagcgacctgtacctgagacccggcagcgagcagcccggcagacccggcagccacggctacgtgagaagccccagccccagcgtgagaacccaggagaccatgctgcagcagagacccagcgtgttccagggcaccaacggcaccagcgtgatcacccccctggaccccaccgcccagctgagaatcatgcccctgcccgccggcggccccagcatcagccagggcctgcccgccagcagatacaacaccgccgccgacgccctggccgccctggtggacgccgccgccagcgccccccagatggacgtgagcaagaccaaggagagcaagcacgaggccgccagactggaggagaacctgagaagcagaagcgccgccgtgagcgagcagcagcagctggagcagaagaccctggaggtggagaagagaagcgtgcagtgcctgtacaccagcagcgccttccccagcggcaagccccagccccacagcagcgtggtgtacagcgaggccggcaaggacaagggccccccccccaagagcagatacgaggaggagctgagaaccagaggcaagaccaccatcaccgccgccaacttcatcgacgtgatcatcaccagacagatcgccagcgacaaggacgccagagagagaggcagccagagcagcgacagcagcagcagcctgagcagccacagatacgagacccccagcgacgccatcgaggtgatcagccccgccagcagccccgcccccccccaggagaagctgcagacctaccagcccgaggtggtgaaggccaaccaggccgagaacgaccccaccagacagtacgagggccccctgcaccactacagaccccagcaggagagccccagcccccagcagcagctgccccccagcagccaggccgagggcatgggccaggtgcccagaacccacagactgatcaccctggccgaccacatctgccagatcatcacccaggacttcgccagaaaccaggtgagcagccagaccccccagcagccccccaccagcaccttccagaacagccccagcgccctggtgagcacccccgtgagaaccaagaccagcaacagatacagccccgagagccaggcccagagcgtgcaccaccagagacccggcagcagagtgagccccgagaacctggtggacaagagcagaggcagcagacccggcaagagccccgagagaagccacgtgagcagcgagccctacgagcccatcagccccccccaggtgcccgtggtgcacgagaagcaggacagcctgctgctgctgagccagagaggcgccgagcccgccgagcagagaaacgacgccagaagccccggcagcatcagctacctgcccagcttcttcaccaagctggagaacaccagccccatggtgaagagcaagaagcaggagatcttcagaaagctgaacagcagcggcggcggcgacagcgacatggccgccgcccagcccggcaccgagatcttcaacctgcccgccgtgaccaccagcggcagcgtgagcagcagaggccacagcttcgccgaccccgccagcaacctgggcctggaggacatcatcagaaaggccctgatgggcagcttcgacgacaaggtggaggaccacggcgtggtgatgagccagcccatgggcgtggtgcccggcaccgccaacaccagcgtggtgaccagcggcgagaccagaagagaggagggcgaccccagcccccacagcggcgtgtgcaagcccaagctgatcagcaagagcaacagcagaaagagcaagagccccatccccggccagggctacctgggcaccgagagacccagcagcgtgagcagcgtgcacagcgagggcgactaccacagacagacccccggctgggcctgggaggacagacccagcagcaccggcagcacccagttcccctacaaccccctgaccatgagaatgctgagcagcaccccccccacccccatcgcctgcgcccccagcgccgtgaaccaggccgccccccaccagcagaacagaatctgggagagagagcccgcccccctgctgagcgcccagtacgagaccctgagcgacagcgacgactag

SEQ ID NO: 11446 - DNA, 7014 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggagttcgccgtgcccgactacagaagcagccacctggaggtgagccaggccagccagctgctgcagcagcagcagcagcagcagctgagaagaagacccagcctgctgagcgagttccaccccggcagcgacagaccccaggagagaagaaccagctacgagcccttccaccccggccccagccccgtggaccacgacagcctggagagcaagagacccagactggagcaggtgagcgacagccacttccagagagtgagcgccgccgtgctgcccctggtgcaccccctgcccgagggcctgagagccagcgccgacgccaagaaggaccccgccttcggcggcaagcacgaggcccccagcagccccatcagcggccagccctgcggcgacgaccagaacgccagccccagcaagctgagcaaggaggagctgatccagagcatggacagagtggacagagagatcgccaaggtggagcagcagatcctgaagctgaagaagaagcagcagcagctggaggaggaggccgccaagccccccgagcccgagaagcccgtgagccccccccccgtggagcagaagcacagaagcatcgtgcagatcatctacgacgagaacagaaagaaggccgaggaggcccacaagatcttcgagggcctgggccccaaggtggagctgcccctgtacaaccagcccagcgacaccaaggtgtaccacgagaacatcaagaccaaccaggtgatgagaaagaagctgatcctgttcttcaagagaagaaaccacgccagaaagcagagagagcagaagatctgccagagatacgaccagctgatggaggcctgggagaagaaggtggacagaatcgagaacaaccccagaagaaaggccaaggagagcaagaccagagagtactacgagaagcagttccccgagatcagaaagcagagagagcagcaggagagattccagagagtgggccagagaggcgccggcctgagcgccaccatcgccagaagcgagcacgagatcagcgagatcatcgacggcctgagcgagcaggagaacaacgagaagcagatgagacagctgagcgtgatcccccccatgatgttcgacgccgagcagagaagagtgaagttcatcaacatgaacggcctgatggaggaccccatgaaggtgtacaaggacagacagttcatgaacgtgtggaccgaccacgagaaggagatcttcaaggacaagttcatccagcaccccaagaacttcggcctgatcgccagctacctggagagaaagagcgtgcccgactgcgtgctgtactactacctgaccaagaagaacgagaactacaaggccctggtgagaagaaactacggcaagagaagaggcagaaaccagcagatcgccagacccagccaggaggagaaggtggaggagaaggaggaggacaaggccgagaagaccgagaagaaggaggaggagaagaaggacgaggaggagaaggacgagaaggaggacagcaaggagaacaccaaggagaaggacaagatcgacggcaccgccgaggagaccgaggagagagagcaggccacccccagaggcagaaagaccgccaacagccagggcagaagaaagggcagaatcaccagaagcatgaccaacgaggccgccgccgccagcgccgccgccgccgccgccaccgaggagccccccccccccctgccccccccccccgagcccatcagcaccgagcccgtggagaccagcagatggaccgaggaggagatggaggtggccaagaagggcctggtggagcacggcagaaactgggccgccatcgccaagatggtgggcaccaagagcgaggcccagtgcaagaacttctacttcaactacaagagaagacacaacctggacaacctgctgcagcagcacaagcagaagaccagcagaaagcccagagaggagagagacgtgagccagtgcgagagcgtggccagcaccgtgagcgcccaggaggacgaggacatcgaggccagcaacgaggaggagaaccccgaggacagcgagggcgccgagaacagcagcgacaccgagagcgcccccagccccagccccgtggaggccgtgaagcccagcgaggacagccccgagaacgccaccagcagaggcaacaccgagcccgccgtggagctggagcccaccaccgagaccgcccccagcaccagccccagcctggccgtgcccagcaccaagcccgccgaggacgagagcgtggagacccaggtgaacgacagcatcagcgccgagaccgccgagcagatggacgtggaccagcaggagcacagcgccgaggagggcagcgtgtgcgaccccccccccgccaccaaggccgacagcgtggacgtggaggtgagagtgcccgagaaccacgccagcaaggtggagggcgacaacaccaaggagagagacctggacagagccagcgagaaggtggagcccagagacgaggacctggtggtggcccagcagatcaacgcccagagacccgagccccagagcgacaacgacagcagcgccacctgcagcgccgacgaggacgtggacggcgagcccgagagacagagaatgttccccatggacagcaagcccagcctgctgaaccccaccggcagcatcctggtgagcagccccctgaagcccaaccccctggacctgccccagctgcagcacagagccgccgtgatcccccccatggtgagctgcaccccctgcaacatccccatcggcacccccgtgagcggctacgccctgtaccagagacacatcaaggccatgcacgagagcgccctgctggaggagcagagacagagacaggagcagatcgacctggagtgcagaagcagcaccagcccctgcggcaccagcaagagccccaacagagagtgggaggtgctgcagcccgccccccaccaggtgatcaccaacctgcccgagggcgtgagactgcccaccaccagacccaccagaccccccccccccctgatccccagcagcaagaccaccgtggccagcgagaagcccagcttcatcatgggcggcagcatcagccagggcacccccggcacctacctgaccagccacaaccaggccagctacacccaggagacccccaagcccagcgtgggcagcatcagcctgggcctgcccagacagcaggagagcgccaagagcgccaccctgccctacatcaagcaggaggagttcagccccagaagccagaacagccagcccgagggcctgctggtgagagcccagcacgagggcgtggtgagaggcaccgccggcgccatccaggagggcagcatcaccagaggcacccccaccagcaagatcagcgtggagagcatccccagcctgagaggcagcatcacccagggcacccccgccctgccccagaccggcatccccaccgaggccctggtgaagggcagcatcagcagaatgcccatcgaggacagcagccccgagaagggcagagaggaggccgccagcaagggccacgtgatctacgagggcaagagcggccacatcctgagctacgacaacatcaagaacgccagagagggcaccagaagccccagaaccgcccacgagatcagcctgaagagaagctacgagagcgtggagggcaacatcaagcagggcatgagcatgagagagagccccgtgagcgcccccctggagggcctgatctgcagagccctgcccagaggcagcccccacagcgacctgaaggagagaaccgtgctgagcggcagcatcatgcagggcacccccagagccaccaccgagagcttcgaggacggcctgaagtaccccaagcagatcaagagagagagcccccccatcagagccttcgagggcgccatcaccaagggcaagccctacgacggcatcaccaccatcaaggagatgggcagaagcatccacgagatccccagacaggacatcctgacccaggagagcagaaagacccccgaggtggtgcagagcaccagacccatcatcgagggcagcatcagccagggcacccccatcaagttcgacaacaacagcggccagagcgccatcaagcacaacgtgaagagcctgatcaccggccccagcaagctgagcagaggcatgccccccctggagatcgtgcccgagaacatcaaggtggtggagagaggcaagtacgaggacgtgaaggccggcgagaccgtgagaagcagacacaccagcgtggtgagcagcggccccagcgtgctgagaagcaccctgcacgaggcccccaaggcccagctgagccccggcatctacgacgacaccagcgccagaagaacccccgtgagctaccagaacaccatgagcagaggcagccccatgatgaacagaaccagcgacgtgaccatcagcagcaacaagagcaccaaccacgagagaaagagcaccctgacccccacccagagagagagcatccccgccaagagccccgtgcccggcgtggaccccgtggtgagccacagccccttcgacccccaccacagaggcagcaccgccggcgaggtgtacagaagccacctgcccacccacctggaccccgccatgcccttccacagagccctggaccccgccgccgccgcctacctgttccagagacagctgagccccacccccggctaccccagccagtaccagctgtacgccatggagaacaccagacagaccatcctgaacgactacatcaccagccagcagatgcaggtgaacctgagacccgacgtggccagaggcctgagccccagagagcagcccctgggcctgccctaccccgccaccagaggcatcatcgacctgaccaacatgccccccaccatcctggtgccccaccccggcggcaccagcaccccccccatggacagaatcacctacatccccggcacccagatcaccttcccccccagaccctacaacagcgccagcatgagccccggccaccccacccacctggccgccgccgccagcgccgagagagagagagagagagagagagagaaggagagagagagagagagaatcgccgccgccagcagcgacctgtacctgagacccggcagcgagcagcccggcagacccggcagccacggctacgtgagaagccccagccccagcgtgagaacccaggagaccatgctgcagcagagacccagcgtgttccagggcaccaacggcaccagcgtgatcacccccctggaccccaccgcccagctgagaatcatgcccctgcccgccggcggccccagcatcagccagggcctgcccgccagcagatacaacaccgccgccgacgccctggccgccctggtggacgccgccgccagcgccccccagatggacgtgagcaagaccaaggagatcagcagccacagatacgagacccccagcgacgccatcgaggtgatcagccccgccagcagccccgcccccccccaggagaagctgcagacctaccagcccgaggtggtgaaggccaaccaggccgagaacgaccccaccagacagtacgagggccccctgcaccactacagaccccagcaggagagccccagcccccagcagcagctgccccccagcagccaggccgagggcatgggccaggtgcccagaacccacagactgatcaccctggccgaccacatctgccagatcatcacccaggacttcgccagaaaccaggtgagcagccagaccccccagcagccccccaccagcaccttccagaacagccccagcgccctggtgagcacccccgtgagaaccaagaccagcaacagatacagccccgagagccaggcccagagcgtgcaccaccagagacccggcagcagagtgagccccgagaacctggtggacaagagcagaggcagcagacccggcaagagccccgagagaagccacgtgagcagcgagccctacgagcccatcagccccccccaggtgcccgtggtgcacgagaagcaggacagcctgctgctgctgagccagagaggcgccgagcccgccgagcagagaaacgacgccagaagccccggcagcatcagctacctgcccagcttcttcaccaagctggagaacaccagccccatggtgaagagcaagaagcaggagatcttcagaaagctgaacagcagcggcggcggcgacagcgacatggccgccgcccagcccggcaccgagatcttcaacctgcccgccgtgaccaccagcggcagcgtgagcagcagaggccacagcttcgccgaccccgccagcaacctgggcctggaggacatcatcagaaaggccctgatgggcagcttcgacgacaaggtggaggaccacggcgtggtgatgagccagcccatgggcgtggtgcccggcaccgccaacaccagcgtggtgaccagcggcgagaccagaagagaggagggcgaccccagcccccacagcggcggcgtgtgcaagcccaagctgatcagcaagagcaacagcagaaagagcaagagccccatccccggccagggctacctgggcaccgagagacccagcagcgtgagcagcgtgcacagcgagggcgactaccacagacagacccccggctgggcctgggaggacagacccagcagcaccggcagcacccagttcccctacaaccccctgaccatgagaatgctgagcagcaccccccccacccccatcgcctgcgcccccagcgccgtgaaccaggccgccccccaccagcagaacagaatctgggagagagagcccgcccccctgctgagcgcccagtacgagaccctgagcgacagcgacgactag

SEQ ID NO: 11447 - DNA, 3075 bp, Artificial Sequence
  Description of Artificial Sequence: Synthetic coding sequence
atgccccccctggagatcgtgcccgagaacatcaaggtggtggagagaggcaagtacgaggacgtgaaggccggcgagaccgtgagaagcagacacaccagcgtggtgagcagcggccccagcgtgctgagaagcaccctgcacgaggcccccaaggcccagctgagccccggcatctacgacgacaccagcgccagaagaacccccgtgagctaccagaacaccatgagcagaggcagccccatgatgaacagaaccagcgacgtgaccatcagcagcaacaagagcaccaaccacgagagaaagagcaccctgacccccacccagagagagagcatccccgccaagagccccgtgcccggcgtggaccccgtggtgagccacagccccttcgacccccaccacagaggcagcaccgccggcgaggtgtacagaagccacctgcccacccacctggaccccgccatgcccttccacagagccctggaccccgccgccgccgcctacctgttccagagacagctgagccccacccccggctaccccagccagtaccagctgtacgccatggagaacaccagacagaccatcctgaacgactacatcaccagccagcagatgcaggtgaacctgagacccgacgtggccagaggcctgagccccagagagcagcccctgggcctgccctaccccgccaccagaggcatcatcgacctgaccaacatgccccccaccatcctggtgccccaccccggcggcaccagcaccccccccatggacagaatcacctacatccccggcacccagatcaccttcccccccagaccctacaacagcgccagcatgagccccggccaccccacccacctggccgccgccgccagcgccgagagagagagagagagagagagagagaaggagagagagagagagagaatcgccgccgccagcagcgacctgtacctgagacccggcagcgagcagcccggcagacccggcagccacggctacgtgagaagccccagccccagcgtgagaacccaggagaccatgctgcagcagagacccagcgtgttccagggcaccaacggcaccagcgtgatcacccccctggaccccaccgcccagctgagaatcatgcccctgcccgccggcggccccagcatcagccagggcctgcccgccagcagatacaacaccgccgccgacgccctggccgccctggtggacgccgccgccagcgccccccagatggacgtgagcaagaccaaggagagcaagcacgaggccgccagactggaggagaacctgagaagcagaagcgccgccgtgagcgagcagcagcagctggagcagaagaccctggaggtggagaagagaagcgtgcagtgcctgtacaccagcagcgccttccccagcggcaagccccagccccacagcagcgtggtgtacagcgaggccggcaaggacaagggccccccccccaagagcagatacgaggaggagctgagaaccagaggcaagaccaccatcaccgccgccaacttcatcgacgtgatcatcaccagacagatcgccagcgacaaggacgccagagagagaggcagccagagcagcgacagcagcagcagcctgagcagccacagatacgagacccccagcgacgccatcgaggtgatcagccccgccagcagccccgcccccccccaggagaagctgcagacctaccagcccgaggtggtgaaggccaaccaggccgagaacgaccccaccagacagtacgagggccccctgcaccactacagaccccagcaggagagccccagcccccagcagcagctgccccccagcagccaggccgagggcatgggccaggtgcccagaacccacagactgatcaccctggccgaccacatctgccagatcatcacccaggacttcgccagaaaccaggtgagcagccagaccccccagcagccccccaccagcaccttccagaacagccccagcgccctggtgagcacccccgtgagaaccaagaccagcaacagatacagccccgagagccaggcccagagcgtgcaccaccagagacccggcagcagagtgagccccgagaacctggtggacaagagcagaggcagcagacccggcaagagccccgagagaagccacgtgagcagcgagccctacgagcccatcagccccccccaggtgcccgtggtgcacgagaagcaggacagcctgctgctgctgagccagagaggcgccgagcccgccgagcagagaaacgacgccagaagccccggcagcatcagctacctgcccagcttcttcaccaagctggagaacaccagccccatggtgaagagcaagaagcaggagatcttcagaaagctgaacagcagcggcggcggcgacagcgacatggccgccgcccagcccggcaccgagatcttcaacctgcccgccgtgaccaccagcggcagcgtgagcagcagaggccacagcttcgccgaccccgccagcaacctgggcctggaggacatcatcagaaaggccctgatgggcagcttcgacgacaaggtggaggaccacggcgtggtgatgagccagcccatgggcgtggtgcccggcaccgccaacaccagcgtggtgaccagcggcgagaccagaagagaggagggcgaccccagcccccacagcggcggcgtgtgcaagcccaagctgatcagcaagagcaacagcagaaagagcaagagccccatccccggccagggctacctgggcaccgagagacccagcagcgtgagcagcgtgcacagcgagggcgactaccacagacagacccccggctgggcctgggaggacagacccagcagcaccggcagcacccagttcccctacaaccccctgaccatgagaatgctgagcagcaccccccccacccccatcgcctgcgcccccagcgccgtgaaccaggccgccccccaccagcagaacagaatctgggagagagagcccgcccccctgctgagcgcccagtacgagaccctgagcgacagcgacgactag

SEQ ID NO: 11448 - DNA, 4821 bp, Artificial Sequence
  Description of Artificial Sequence: Synthetic coding sequence
atgctgctgcacctgtgcagcgtgaagaacctgtaccagaacagattcctgggcctggccgccatggccagccccagcagaaacagccagagcagaagaagatgcaaggagcccctgagatacagctacaaccccgaccagttccacaacatggacctgagaggcggcccccacgacggcgtgaccatccccagaagcaccagcgacaccgacctggtgaccagcgacagcagaagcaccctgatggtgagcagcagctactacagcatcggccacagccaggacctggtgatccactgggacatcaaggaggaggtggacgccggcgactggatcggcatgtacctgatcgacgaggtgctgagcgagaacttcctggactacaagaacagaggcgtgaacggcagccacagaggccagatcatctggaagatcgacgccagcagctacttcgtggagcccgagaccaagatctgcttcaagtactaccacggcgtgagcggcgccctgagagccaccacccccagcgtgaccgtgaagaacagcgccgcccccatcttcaagagcatcggcgccgacgagaccgtgcagggccagggcagcagaagactgatcagcttcagcctgagcgacttccaggccatgggcctgaagaagggcatgttcttcaaccccgacccctacctgaagatcagcatccagcccggcaagcacagcatcttccccgccctgccccaccacggccaggagagaagaagcaagatcatcggcaacaccgtgaaccccatctggcaggccgagcagttcagcttcgtgagcctgcccaccgacgtgctggagatcgaggtgaaggacaagttcgccaagagcagacccatcatcaagagattcctgggcaagctgagcatgcccgtgcagagactgctggagagacacgccatcggcgacagagtggtgagctacaccctgggcagaagactgcccaccgaccacgtgagcggccagctgcagttcagattcgagatcaccagcagcatccaccccgacgacgaggagatcagcctgagcaccgagcccgagagcgcccagatccaggacagccccatgaacaacctgatggagagcggcagcggcgagcccagaagcgaggcccccgagagcagcgagagctggaagcccgagcagctgggcgagggcagcgtgcccgacggccccggcaaccagagcatcgagctgagcagacccgccgaggaggccgccgtgatcaccgaggccggcgaccagggcatggtgagcgtgggccccgagggcgccggcgagctgctggcccaggtgcagaaggacatccagcccgcccccagcgccgaggagctggccgagcagctggacctgggcgaggaggccagcgccctgctgctggaggacggcgaggcccccgccagcaccaaggaggagcccctggaggaggaggccaccacccagagcagagccggcagagaggaggaggagaaggagcaggaggaggagggcgacgtgagcaccctggagcagggcgagggcagactgcagctgagagccagcgtgaagagaaagagcagaccctgcagcctgcccgtgagcgagctggagaccgtgatcgccagcgcctgcggcgaccccgagacccccagaacccactacatcagaatccacaccctgctgcacagcatgcccagcgcccagggcggcagcgccgccgaggaggaggacggcgccgaggaggagagcaccctgaaggacagcagcgagaaggacggcctgagcgaggtggacaccgtggccgccgaccccagcgccctggaggaggacagagaggagcccgagggcgccacccccggcaccgcccaccccggccacagcggcggccacttccccagcctggccaacggcgccgcccaggacggcgacacccaccccagcaccggcagcgagagcgacagcagccccagacagggcggcgaccacagctgcgagggctgcgacgccagctgctgcagccccagctgctacagcagcagctgctacagcaccagctgctacagcagcagctgctacagcgccagctgctacagccccagctgctacaacggcaacagattcgccagccacaccagattcagcagcgtggacagcgccaagatcagcgagagcaccgtgttcagcagccaggacgacgaggaggaggagaacagcgccttcgagagcgtgcccgacagcatgcagagccccgagctggaccccgagagcaccaacggcgccggcccctggcaggacgagctggccgcccccagcggccacgtggagagaagccccgagggcctggagagccccgtggccggccccagcaacagaagagagggcgagtgccccatcctgcacaacagccagcccgtgagccagctgcccagcctgagacccgagcaccaccactaccccaccatcgacgagcccctgccccccaactgggaggccagaatcgacagccacggcagagtgttctacgtggaccacgtgaacagaaccaccacctggcagagacccaccgccgccgccacccccgacggcatgagaagaagcggcagcatccagcagatggagcagctgaacagaagataccagaacatccagagaaccatcgccaccgagagaagcgaggaggacagcggcagccagagctgcgagcaggcccccgccggcggcggcggcggcggcggcagcgacagcgaggccgagagcagccagagcagcctggacctgagaagagagggcagcctgagccccgtgaacagccagaagatcaccctgctgctgcagagccccgccgtgaagttcatcaccaaccccgagttcttcaccgtgctgcacgccaactacagcgcctacagagtgttcaccagcagcacctgcctgaagcacatgatcctgaaggtgagaagagacgccagaaacttcgagagataccagcacaacagagacctggtgaacttcatcaacatgttcgccgacaccagactggagctgcccagaggctgggagatcaagaccgaccagcagggcaagagcttcttcgtggaccacaacagcagagccaccaccttcatcgaccccagaatccccctgcagaacggcagactgcccaaccacctgacccacagacagcacctgcagagactgagaagctacagcgccggcgaggccagcgaggtgagcagaaacagaggcgccagcctgctggccagacccggccacagcctggtggccgccatcagaagccagcaccagcacgagagcctgcccctggcctacaacgacaagatcgtggccttcctgagacagcccaacatcttcgagatgctgcaggagagacagcccagcctggccagaaaccacaccctgagagagaagatccactacatcagaaccgagggcaaccacggcctggagaagctgagctgcgacgccgacctggtgatcctgctgagcctgttcgaggaggagatcatgagctacgtgcccctgcaggccgccttccaccccggctacagcttcagccccagatgcagcccctgcagcagcccccagaacagccccggcctgcagagagccagcgccagagcccccagcccctacagaagagacttcgaggccaagctgagaaacttctacagaaagctggaggccaagggcttcggccagggccccggcaagatcaagctgatcatcagaagagaccacctgctggagggcaccttcaaccaggtgatggcctacagcagaaaggagctgcagagaaacaagctgtacgtgaccttcgtgggcgaggagggcctggactacagcggccccagcagagagttcttcttcctgctgagccaggagctgttcaacccctactacggcctgttcgagtacagcgccaacgacacctacaccgtgcagatcagccccatgagcgccttcgtggagaaccacctggagtggttcagattcagcggcagaatcctgggcctggccctgatccaccagtacctgctggacgccttcttcaccagacccttctacaaggccctgctgagactgccctgcgacctgagcgacctggagtacctggacgaggagttccaccagagcctgcagtggatgaaggacaacaacatcaccgacatcctggacctgaccttcaccgtgaacgaggaggtgttcggccaggtgaccgagagagagctgaagagcggcggcgccaacacccaggtgaccgagaagaacaagaaggagtacatcgagagaatggtgaagtggagagtggagagaggcgtggtgcagcagaccgaggccctggtgagaggcttctacgaggtggtggacagcagactggtgagcgtgttcgacgccagagagctggagctggtgatcgccggcaccgccgagatcgacctgaacgactggagaaacaacaccgagtacagaggcggctaccacgacggccacctggtgatcagatggttctgggccgccgtggagagattcaacaacgagcagagactgagactgctgcagttcgtgaccggcaccagcagcgtgccctacgagggcttcgccgccctgagaggcagcaacggcctgagaagattctgcatcgagaagtggggcaagatcaccagcctgcccagagcccacacctgcttcaacagactggacctgcccccctaccccagctacagcatgctgtacgagaagctgctgaccgccgtggaggagaccagcaccttcggcctggagtag

SEQ ID NO: 11449 - DNA, 1209 bp, Artificial Sequence
  Description of Artificial Sequence: Synthetic coding sequence
atggccgccctgtgcagaaccgccgagagccaggccgagctgcagtgcacccagctggacctggagagaaagctgaagctgaacgagaacgccatcagcagactgcaggccaaccagaagagcgtgctggtgagcgtgagcgaggtgaaggccgtggccgagatgcagttcggcgagctgctggccgccgtgagaaaggcccaggccaacgtgatgctgttcctggaggagaaggagcaggccgccctgagccaggccaacggcatcaaggcccacctggagtacagaagcgccgagatggagaagagcaagcaggagctggagaccatggccgccatcagcaacaccgtgcagttcctggaggagtactgcaagttcaagaacaccgaggacatcaccttccccagcgtgtacatcggcctgaaggacaagctgagcggcatcagaaaggtgatcaccgagagcaccgtgcacctgatccagctgctggagaactacaagaagaagctgcaggagttcagcaaggaggaggagtacgacatcagaacccaggtgagcgccatcgtgcagagaaagtactggaccagcaagcccgagcccagcaccagagagcagttcctgcagtacgtgcacgacatcaccttcgaccccgacaccgcccacaagtacctgagactgcaggaggagaacagaaaggtgaccaacaccaccccctgggagcacccctaccccgacctgcccagcagattcctgcactggagacaggtgctgagccagcagagcctgtacctgcacagatactacttcgaggtggagatcttcggcgccggcacctacgtgggcctgacctgcaagggcatcgaccagaagggcgaggagagaagcagctgcatcagcggcaacaacttcagctggagcctgcagtggaacggcaaggagttcaccgcctggtacagcgacatggagacccccctgaaggccggccccttctggagactgggcgtgtacatcgacttccccggcggcatcctgagcttctacggcgtggagtacgacagcatgaccctggtgcacaagttcgcctgcaagttcagcgagcccgtgtacgccgccttctggctgagcaagaaggagaacgccatcagaatcgtggacctgggcgaggagcccgagaagcccgcccccagcctggtgggcaccgccccctag

SEQ ID NO: 11450 - DNA, 1677 bp, Artificial Sequence
  Description of Artificial Sequence: Synthetic coding sequence
atgcacagaagcgcccccagccagaccaccaagagaagcagaagccccttcagcaccaccagaagaagctgggacgacagcgagagcagcggcaccaacctgaacatcgacaacgaggactacagcagatacccccccagagagtacagagccagcggcagcagaagaggcatggcctacggccacatcgacagctacggcgccgacgacagcgaggaggagggcgccggccccgtggagagaccccccgtgagaggcaagaccggcaagttcaaggacgacaagctgctggaccccgtgcccgccgccagatgcagcgccagcagagccgacttcctgccccagagcagcgtggccagccagagcagcagcgagggcaagctggccaccaagggcgacagcagcgagagagagagaagagagcagaacctgcccgccagacccagcagagcccccgtgagcatctgcggcggcggcgagaacaccagcaagagcgccgaggagcccgtggtgagacccaagatcagaaacctggccagccccaactgcgtgaagcccaagatcttcttcgacaccgacgacgacgacgacatgccccacagcaccagcagatggagagacaccgccaacgacaacgagggccacagcgacggcctggccagaagaggcagaggcgagagcagcagcggctaccccgagcccaagtaccccgaggacaagagagaggccagaagcgaccaggtgaagcccgagaaggtgcccagaagaagaagaaccatggccgaccccgacttctggacccacagcgacgactactacaagtactgcgacgaggacagcgacagcgacaaggagtggatcgccgccctgagaagaaagtacagaagcagagagcagaccctgagcagcagcggcgagagctgggagaccctgcccggcaaggaggagagagagcccccccaggccaaggtgagcgccagcaccggcaccagccccggccccggcgccagcgccagcgccggcgccggcgccggcgccagcgccggcagcaacggcagcaactacctggaggaggtgagagagcccagcctgcaggaggagcaggccagcctggaggagggcgagatcccctggctgcagtaccacgagaacgacagcagcagcgagggcgacaacgacagcggccacgagctgatgcagcccggcgtgttcatgctggacggcaacaacaacctggaggacgacagcagcgtgagcgaggacctggaggtggactggagcctgttcgacggcttcgccgacggcctgggcgtggccgaggccatcagctacgtggacccccagttcctgacctacatggccctggaggagagactggcccaggccatggagaccgccctggcccacctggagagcctggccgtggacgtggaggtggccaacccccccgccagcaaggagagcatcgacgccctgcccgagatcctggtgaccgaggaccacggcgccgtgggccaggagatgtgctgccccatctgctgcagcgagtacgtgaagggcgaggtggccaccgagctgccctgccaccactacttccacaagccctgcgtgagcatctggctgcagaagagcggcacctgccccgtgtgcagatgcatgttccccccccccctgtag

SEQ ID NO: 11451 - DNA, 3591 bp, Artificial Sequence
  Description of Artificial Sequence: Synthetic coding sequence
gtgcccccctgccccgccgagctgagaagcgtgaccaacggccagagcaaccagcccagcaacgagggcgacgccatcaaggtgttcgtgagaatcagaccccccgccgagagaagcggcagcgccgacggcgagcagaacctgtgcctgagcgtgctgagcagcaccagcctgagactgcacagcaaccccgagcccaagaccttcaccttcgaccacgtggccgacgtggacaccacccaggagagcgtgttcgccaccgtggccaagagcatcgtggagagctgcatgagcggctacaacggcaccatcttcgcctacggccagaccggcagcggcaagaccttcaccatgatgggccccagcgagagcgacaacttcagccacaacctgagaggcgtgatccccagaagcttcgagtacctgttcagcctgatcgacagagagaaggagaaggccggcgccggcaagagcttcctgtgcaagtgcagcttcatcgagatctacaacgagcagatctacgacctgctggacagcgccagcgccggcctgtacctgagagagcacatcaagaagggcgtgttcgtggtgggcgccgtggagcaggtggtgaccagcgccgccgaggcctaccaggtgctgagcggcggctggagaaacagaagagtggccagcaccagcatgaacagagagagcagcagaagccacgccgtgttcaccatcaccatcgagagcatggagaagagcaacgagatcgtgaacatcagaaccagcctgctgaacctggtggacctggccggcagcgagagacagaaggacacccacgccgagggcatgagactgaaggaggccggcaacatcaacagaagcctgagctgcctgggccaggtgatcaccgccctggtggacgtgggcaacggcaagcagagacacgtgtgctacagagacagcaagctgaccttcctgctgagagacagcctgggcggcaacgccaagaccgccatcatcgccaacgtgcaccccggcagcagatgcttcggcgagaccctgagcaccctgaacttcgcccagagagccaagctgatcaagaacaaggccgtggtgaacgaggacacccagggcaacgtgagccagctgcaggccgaggtgaagagactgaaggagcagctggccgagctggccagcggccagaccccccccgagagcttcctgaccagagacaagaagaagaccaactacatggagtacttccaggaggccatgctgttcttcaagaagagcgagcaggagaagaagagcctgatcgagaaggtgacccagctggaggacctgaccctgaagaaggagaagttcatccagagcaacaagatgatcgtgaagttcagagaggaccagatcatcagactggagaagctgcacaaggagagcagaggcggcttcctgcccgaggagcaggacagactgctgagcgagctgagaaacgagatccagaccctgagagagcagatcgagcaccaccccagagtggccaagtacgccatggagaaccacagcctgagagaggagaacagaagactgagactgctggagcccgtgaagagagcccaggagatggacgcccagaccatcgccaagctggagaaggccttcagcgagatcagcggcatggagaagagcgacaagaaccagcagggcttcagccccaaggcccagaaggagccctgcctgttcgccaacaccgagaagctgaaggcccagctgctgcagatccagaccgagctgaacaacagcaagcaggagtacgaggagttcaaggagctgaccagaaagagacagctggagctggagagcgagctgcagagcctgcagaaggccaacctgaacctggagaacctgctggaggccaccaaggcctgcaagagacaggaggtgagccagctgaacaagatccacgccgagaccctgaagatcatcaccacccccaccaaggcctaccagctgcacagcagacccgtgcccaagctgagccccgagatgggcagcttcggcagcctgtacacccagaacagcagcatcctggacaacgacatcctgaacgagcccgtgccccccgagatgaacgagcaggccttcgaggccatcagcgaggagctgagaaccgtgcaggagcagatgagcgccctgcaggccaagctggacgaggaggagcacaagaacctgaagctgcagcagcacgtggacaagctggagcaccacagcacccagatgcaggagctgttcagcagcgagagaatcgactggaccaagcagcaggaggagctgctgagccagctgaacgtgctggagaagcagctgcaggagacccagaccaagaacgacttcctgaagagcgaggtgcacgacctgagagtggtgctgcacagcgccgacaaggagctgagcagcgtgaagctggagtacagcagcttcaagaccaaccaggagaaggagttcaacaagctgagcgagagacacatgcacgtgcagctgcagctggacaacctgagactggagaacgagaagctgctggagagcaaggcctgcctgcaggacagctacgacaacctgcaggagatcatgaagttcgagatcgaccagctgagcagaaacctgcagaacttcaagaaggagaacgagaccctgaagagcgacctgaacaacctgatggagctgctggaggccgagaaggagagaaacaacaagctgagcctgcagttcgaggaggacaaggagaacagcagcaaggagatcctgaaggtgctggaggccgtgagacaggagaagcagaaggagaccgccaagtgcgagcagcagatggccaaggtgcagaagctggaggagagcctgctggccaccgagaaggtgatcagcagcctggagaagagcagagacagcgacaagaaggtggtggccgacctgatgaaccagatccaggagctgagaaccagcgtgtgcgagaagaccgagaccatcgacaccctgaagcaggagctgaaggacatcaactgcaagtacaacagcgccctggtggacagagaggagagcagagtgctgatcaagaagcaggaggtggacatcctggacctgaaggagaccctgagactgagaatcctgagcgaggacatcgagagagacatgctgtgcgaggacctggcccacgccaccgagcagctgaacatgctgaccgaggccagcaagaagcacagcggcctgctgcagagcgcccagagaaccgaccaggagggcagccccgacagcggcaccagcgcccaggccaagcccaaggagagaggcagcagaaccgaggaggagtacaacttcaagatgagacagctggagcacgtgatggacagcgccgccgaggacccccagagccccaagacccccccccacttccagacccacctggccaagctgctggagacccaggagcaggagatcgaggacggcagagccagcaagaccagcctggagcacctggtgaccaagctgaacgaggacagagaggtgaagaacgccgagatcctgagaatgaaggagcagctgagatag

SEQ ID NO: 11452 - DNA, 3264 bp, Artificial Sequence
  Description of Artificial Sequence: Synthetic coding sequence
atggaccccttcaccgagaagctgctggagagaaccagagccagaagagagaacctgcagagaaagatggccgagagacccaccgccgcccccagaagcatgacccacgccaagagagccagacagcccctgagcgaggccagcaaccagcagcccctgagcggcggcgaggagaagagctgcaccaagcccagccccagcaagaagagatgcagcgacaacaccgaggtggaggtgagcaacctggagaacaagcagcccgtggagagcaccagcgccaagagctgcagccccagccccgtgagcccccaggtgcagccccaggccgccgacaccatcagcgacagcgtggccgtgcccgccagcctgctgggcatgagaagaggcctgaacagcagactggaggccaccgccgccagcagcgtgaagaccagaatgcagaagctggccgagcagagaagaagatgggacaacgacgacatgaccgacgacatccccgagagcagcctgttcagccccatgcccagcgaggagaaggccgccagcccccccagacccctgctgagcaacgccagcgccacccccgtgggcagaagaggcagactggccaacctggccgccaccatctgcagctgggaggacgacgtgaaccacagcttcgccaagcagaacagcgtgcaggagcagcccggcaccgcctgcctgagcaagttcagcagcgccagcggcgccagcgccagaatcaacagcagcagcgtgaagcaggaggccaccttctgcagccagagagacggcgacgccagcctgaacaaggccctgagcagcagcgccgacgacgccagcctggtgaacgccagcatcagcagcagcgtgaaggccaccagccccgtgaagagcaccaccagcatcaccgacgccaagagctgcgagggccagaaccccgagctgctgcccaagacccccatcagccccctgaagaccggcgtgagcaagcccatcgtgaagagcaccctgagccagaccgtgcccagcaagggcgagctgagcagagagatctgcctgcagagccagagcaaggacaagagcaccacccccggcggcaccggcatcaagcccttcctggagagattcggcgagagatgccaggagcacagcaaggagagccccgccagaagcaccccccacagaacccccatcatcacccccaacaccaaggccatccaggagagactgttcaagcaggacaccagcagcagcaccacccacctggcccagcagctgaagcaggagagacagaaggagctggcctgcctgagaggcagattcgacaagggcaacatctggagcgccgagaagggcggcaacagcaagagcaagcagctggagaccaagcaggagacccactgccagagcacccccctgaagaagcaccagggcgtgagcaagacccagagcctgcccgtgaccgagaaggtgaccgagaaccagatccccgccaagaacagcagcaccgagcccaaggaggtgatcagagagatcgagatgagcgtggacgacgacgacatcaacagcagcaaggtgatcaacgacctgttcagcgacgtgctggaggagggcgagctggacatggagaagagccaggaggagatggaccaggccctggccgagagcagcgaggagcaggaggacgccctgaacatcagcagcatgagcctgctggcccccctggcccagaccgtgggcgtggtgagccccgagagcctggtgagcacccccagactggagctgaaggacaccagcagaagcgacgagagccccaagcccggcaagttccagagaaccagagtgcccagagccgagagcggcgacagcctgggcagcgaggacagagacctgctgtacagcatcgacgcctacagaagccagagattcaaggagaccgagagacccagcatcaagcaggtgatcgtgagaaaggaggacgtgaccagcaagctggacgagaagaacaacgccttcccctgccaggtgaacatcaagcagaagatgcaggagctgaacaacgagatcaacatgcagcagaccgtgatctaccaggccagccaggccctgaactgctgcgtggacgaggagcacggcaagggcagcctggaggaggccgaggccgagagactgctgctgatcgccaccggcaagagaaccctgctgatcgacgagctgaacaagctgaagaacgagggcccccagagaaagaacaaggccagcccccagagcgagttcatgcccagcaagggcagcgtgaccctgagcgagatcagactgcccctgaaggccgacttcgtgtgcagcaccgtgcagaagcccgacgccgccaactactactacctgatcatcctgaaggccggcgccgagaacatggtggccacccccctggccagcaccagcaacagcctgaacggcgacgccctgaccttcaccaccaccttcaccctgcaggacgtgagcaacgacttcgagatcaacatcgaggtgtacagcctggtgcagaagaaggaccccagcggcctggacaagaagaagaagaccagcaagagcaaggccatcacccccaagagactgctgaccagcatcaccaccaagagcaacatccacagcagcgtgatggccagccccggcggcctgagcgccgtgagaaccagcaacttcgccctggtgggcagctacaccctgagcctgagcagcgtgggcaacaccaagttcgtgctggacaaggtgcccttcctgagcagcctggagggccacatctacctgaagatcaagtgccaggtgaacagcagcgtggaggagagaggcttcctgaccatcttcgaggacgtgagcggcttcggcgcctggcacagaagatggtgcgtgctgagcggcaactgcatcagctactggacctaccccgacgacgagaagagaaagaaccccatcggcagaatcaacctggccaactgcaccagcagacagatcgagcccgccaacagagagttctgcgccagaagaaacaccttcgagctgatcaccgtgagaccccagagagaggacgacagagagaccctggtgagccagtgcagagacaccctgtgcgtgaccaagaactggctgagcgccgacaccaaggaggagagagacctgtggatgcagaagctgaaccaggtgctggtggacatcagactgtggcagcccgacgcctgctacaagcccatcggcaagccctag

SEQ ID NO: 11453 - DNA, 648 bp, Artificial Sequence; identical to SEQ ID NO: 10193
  Description of Artificial Sequence: Synthetic coding sequence

SEQ ID NO: 11454 - DNA, 2976 bp, Artificial Sequence
  Description of Artificial Sequence: Synthetic coding sequence
atggaggagtacgagaagttctgcgagaagagcctggccagaatccaggaggccagcctgagcaccgagagcttcctgcccgcccagagcgagagcatcagcctgatcagattccacggcgtggccatcctgagccccctgctgaacatcgagaagagaaaggagatgcagcaggagaagcagaaggccctggacgtggaggccagaaagcaggtgaacagaaagaaggccctgctgaccagagtgcaggagatcctggacaacgtgcaggtgagaaaggcccccaacgccagcgacttcgaccagtgggagatggagaccgtgtacagcaacagcgaggtgagaaacctgaacgtgcccgccaccttccccaacagcttccccagccacaccgagcacagcaccgccgccaagctggacaagatcgccggcatcctgcccctggacaacgaggaccagtgcaagaccgacggcatcgacctggccagagacagcgagggcttcaacagccccaagcagtgcgacagcagcaacatcagccacgtggagaacgaggccttccccaagaccagcagcgccaccccccaggagaccctgatcagcgacggccccttcagcgtgaacgagcagcaggacctgcccctgctggccgaggtgatccccgacccctacgtgatgagcctgcagaacctgatgaagaagagcaaggagtacatcgagagagagcagagcagaagaagcctgagaggcagcatcaacagaatcgtgaacgagagccacctggacaaggagcacgacgccgtggaggtggccgactgcgtgaaggagaagggccagctgaccggcaagcactgcgtgagcgtgatccccgacaagcccagcctgaacaagagcaacgtgctgctgcagggcgccagcacccaggccagcagcatgagcatgcccgtgctggccagcttcagcaaggtggacatccccatcagaaccggccaccccaccgtgctggagagcaacagcgacttcaaggtgatccccaccttcgtgaccgagaacaacgtgatcaagagcctgaccggcagctacgccaagctgcccagccccgagcccagcatgagccccaagatgcacagaagaagaagcagaaccagcagcgcctgccacatcctgatcaacaaccccatcaacgcctgcgagctgagccccaagggcaaggagcaggccatggacctgatcatccaggacaccgacgagaacaccaacgtgcccgagatcatgcccaagctgcccaccgacctggccggcgtgtgcagcagcaaggtgtacgtgggcaagaacaccagcgaggtgaaggaggacgtggtgctgggcaagagcaaccaggtgtgccagagcagcggcaaccacctggagaacaaggtgacccacggcctggtgaccgtggagggccagctgaccagcgacgagagaggcgcccacatcatgaacagcacctgcgccgccatgcccaagctgcacgagccctacgccagcagccagtgcatcgccagccccaacttcggcaccgtgagcggcctgaagcccgccagcatgctggagaagaactgcagcctgcagaccgagctgaacaagagctacgacgtgaagaaccccagccccctgctgatgcagaaccagaacaccagacagcagatggacacccccatggtgagctgcggcaacgagcagttcctggacaacagcttcgagaaggtgaagagaagactggacctggacatcgacggcctgcagaaggagaactgcccctacgtgatcaccagcggcatcaccgagcaggagagacagcacctgcccgagaagagataccccaagggcagcggcttcgtgaacaagaacaagatgctgggcaccagcagcaaggagagcgaggagctgctgaagagcaagatgctggccttcgaggagatgagaaagagactggaggagcagcacgcccagcagctgagcctgctgatcgccgagcaggagagagagcaggagagactgcagaaggagatcgaggagcaggagaagatgctgaaggagaagaaggccatgaccgccgaggccagcgagctggacatcaacaacgccgtggagctggagtggagaaagatcagcgacagcagcctgctggagaccatgctgagccaggccgacagcctgcacaccagcaacagcaacagcagcggcttcaccaacagcgccatgcagtacagcttcgtgagcgccaacgaggcccccttctacctgtggggcagcagcaccagcggcctgaccaagctgagcgtgaccagacccttcggcagagccaagaccagatggagccaggtgttcagcctggagatccaggccaagttcaacaagatcaccgccgtggccaagggcttcctgaccagaagactgatgcagaccgacaagctgaagcagctgagacagaccgtgaaggacaccatggagttcatcagaagcttccagagcgaggcccccctgaagagaggcatcgtgagcgcccaggacgccagcctgcaggagagagtgctggcccagctgagagccgccctgtacggcatccacgacatcttcttcgtgatggacgccgccgagagaatgagcatcctgcaccacgacagagaggtgagaaaggagaagatgctgagacagatggacaagatgaagagccccagagtggccctgagcgccgccacccagaagagcctggacagaaagaagtacatgaaggccgccgagatgggcatgcccaacaagaagttcctggtgaagcagaaccccagcgagaccagagtgctgcagcccaaccagggccagaacgcccccgtgcacagactgctgagcagacagggcagcatctgcagaaagaaccccaagaaggccgccaagtgctgcgacaacctgagaagacagcacagcctgggctag

SEQ ID NO: 11455 - DNA, 2976 bp, Artificial Sequence; identical to SEQ ID NO: 11454
  Description of Artificial Sequence: Synthetic coding sequence

SEQ ID NO: 11456 - DNA, 999 bp, Artificial Sequence; identical to SEQ ID NO: 9575
  Description of Artificial Sequence: Synthetic coding sequence

SEQ ID NO: 11457 - DNA, 888 bp, Artificial Sequence; identical to SEQ ID NO: 9488
  Description of Artificial Sequence: Synthetic coding sequence

SEQ ID NO: 11458 - DNA, 1368 bp, Artificial Sequence
  Description of Artificial Sequence: Synthetic coding sequence
atggagggcgtgctgtacaagtggaccaactacctgagcggctggcagcccagatggttcctgctgtgcggcggcatcctgagctactacgacagccccgaggacgcctggaagggctgcaagggcagcatccagatggccgtgtgcgagatccaggtgcacagcgtggacaacaccagaatggacctgatcatccccggcgagcagtacttctacctgaaggccagaagcgtggccgagagacagagatggctggtggccctgggcagcgccaaggcctgcctgaccgacagcagaacccagaaggagaaggagttcgccgagaacaccgagaacctgaagaccaagatgagcgagctgagactgtactgcgacctgctggtgcagcaggtggacaagaccaaggaggtgaccaccaccggcgtgagcaacagcgaggagggcatcgacgtgggcaccctgctgaagagcacctgcaacaccttcctgaagaccctggaggagtgcatgcagatcgccaacgccgccttcaccagcgagctgctgtacagaaccccccccggcagcccccagctggccatgctgaagagcagcaagatgaagcaccccatcatccccatccacaacagcctggagagacagatggagctgagcacctgcgagaacggcagcctgaacatggagatcaacggcgaggaggagatcctgatgaagaacaagaacagcctgtacctgaagagcgccgagatcgactgcagcatcagcagcgaggagaacaccgacgacaacatcaccgtgcagggcgagatcagaaaggaggacggcatggagaacctgaagaaccacgacaacaacctgacccagagcggcagcgacagcagctgcagccccgagtgcctgtgggaggagggcaaggaggtgatccccaccttcttcagcaccatgaacaccagcttcagcgacatcgagctgctggaggacagcggcatccccaccgaggccttcctggccagctgctacgccgtggtgcccgtgctggacaagctgggccccaccgtgttcgcccccgtgaagatggacctggtgggcaacatcaagaaggtgaaccagaagtacatcaccaacaaggaggagttcaccaccctgcagaagatcgtgctgcacgaggtggaggccgacgtggcccaggtgagaaacagcgccaccgaggccctgctgtggctgaagagaggcctgaagttcctgaagggcttcctgaccgaggtgaagaacggcgagaaggacatccagaccgccctgaacaacgcctacggcaagaccctgagacagcaccacggctgggtggtgagaggcgtgttcgccgtgtag

SEQ ID NO: 11459 - DNA, 1320 bp, Artificial Sequence
  Description of Artificial Sequence: Synthetic coding sequence
atggagggcgtgctgtacaagtggaccaactacctgagcggctggcagcccagatggttcctgctgtgcggcggcatcctgagctactacgacagccccgaggacgcctggaagggctgcaagggcagcatccagatggccgtgtgcgagatccaggtgcacagcgtggacaacaccagaatggacctgatcatccccggcgagcagtacttctacctgaaggccagaagcgtggccgagagacagagatggctggtggccctgggcagcgccaaggcctgcctgaccgacagcagaacccagaaggagaaggagttcgccgagaacaccgagaacctgaagaccaagatgagcgagctgagactgtactgcgacctgctggtgcagcaggtggacaagaccaaggaggtgaccaccaccggcgtgagcaacagcgaggagggcatcgacgtgggcaccctgctgaagagcacctgcaacaccttcctgaagaccctggaggagtgcatgcagatcgccaacgccgccttcaccagcgagctgctgtacagaaccccccccggcagcccccagctggccatgctgaagagcagcaagatgaagcaccccatcatccccatccacaacagcctggagagacagatggagctgagcacctgcgagaacggcagcctgaacatggagatcaacggcgaggaggagatcctgatgaagaacaagaacagcctgtacctgaagagcgccgagatcgactgcagcatcagcagcgaggagaacaccgacgacaacatcaccgtgcagggcgagatcagaaaggaggacggcatggagaacctgaagaaccacgacaacaacctgacccagagcggcagcgacagcagctgcagccccgagtgcctgtgggaggagggcaaggaggtgatccccaccttcttcagcaccatgaacaccagcttcagcgacatcgagctgctggaggacagcggcatccccaccgaggccttcctggccagctgctacgccgtggtgcccgtgctggacaagctgggccccaccgtgttcgcccccgtgaagatggacctggtgggcaacatcaagaaggtgaaccagaagtacatcaccaacaaggaggagttcaccaccctgcagaagatcgtgctgcacgaggtggaggccgacgtggcccaggtgagaaacagcgccaccgaggccctgctgtggctgaagagaggcctgaagttcctgaagggcttcctgaccgaggtgaagaacggcgagaaggacatccagaccgccctgagcgtgggcatgtgggtgtag

SEQ ID NO: 11460 - DNA, 984 bp, Artificial Sequence; identical to SEQ ID NO: 9809
  Description of Artificial Sequence: Synthetic coding sequence

SEQ ID NO: 11461 - DNA, 5229 bp, Artificial Sequence
  Description of Artificial Sequence: Synthetic coding sequence
atgatggagggcaacggcaccgagaacagctgcagcagaaccagaggctggctgcagcaggacaacgacgccaagccctggctgtggaagttcagcaactgcttcagcagacccgagcagaccctgccccacagcccccagaccaaggagtacatggagaacaagaaggtggccgtggagctgaaggacgtgcccagccccctgcacgccggcagcaagctgttccccgccgtgcccctgcccgacatcagaagcctgcagcagcccaagatccagctgagcagcgtgcccaaggtgagctgctgcgcccactgccccaacgagcccagcaccagccccatgagattcggcggcggcggcggcggcagcggcggcaccagcagcctgatccaccccggcgccctgctggacagccagagcaccagaaccatcacctgccaggtgggcagcggcttcgccttccagagcgccagcagcctgcagaacgccagcgccagaaacaacctggccggcatcgccagcgacttccccagcatgtgcctggagagcaacctgagcagctgcaagcacctgccctgctgcggcaagctgcacttccagagctgccacggcaacgtgcacaagctgcaccagttccccagcctgcagggctgcaccagcgccggctacttcccctgcagcgacttcaccagcggcgcccccggccacctggaggagcacatcagccagagcgagctgaccccccacctgtgcaccaacagcctgcacctgaacgtggtgccccccgtgtgcctgaagggcagcctgtactgcgaggactgcctgaacaagcccgccagaaacagcatcatcgacgccgccaaggtgtggcccaacatccccccccccaacacccagcccgcccccctggccgtgcccctgtgcaacggctgcggcaccaagggcaccggcaaggagaccaccctgctgctggccaccagcctgggcaaggccgccagcaagttcggcagccccgaggtggccgtggccggccaggtgctggagaacctgccccccatcggcgtgttctgggacatcgagaactgcagcgtgcccagcggcagaagcgccaccgccgtggtgcagagaatcagagagaagttcttcaagggccacagagaggccgagttcatctgcgtgtgcgacatcagcaaggagaacaaggaggtgatccaggagctgaacaactgccaggtgaccgtggcccacatcaacgccaccgccaagaacgccgccgacgacaagctgagacagagcctgagaagattcgccaacacccacaccgcccccgccaccgtggtgctggtgagcaccgacgtgaacttcgccctggagctgagcgacctgagacacagacacggcttccacatcatcctggtgcacaagaaccaggccagcgaggccctgctgcaccacgccaacgagctgatcagattcgaggagttcatcagcgacctgccccccagactgcccctgaagatgccccagtgccacaccctgctgtacgtgtacaacctgcccgccaacaaggacggcaagagcgtgagcaacagactgagaagactgagcgacaactgcggcggcaaggtgctgagcatcaccggctgcagcgccatcctgagattcatcaaccaggacagcgccgagagagcccagaagagaatggagaacgaggacgtgttcggcaacagaatcatcgtgagcttcacccccaagaacagagagctgtgcgagaccaagagcagcaacgccatcgccgacaaggtgaagagccccaagaagctgaagaaccccaagctgtgcctgatcaaggacgccagcgagcagagcagcagcgccaaggccacccccggcaagggcagccaggccaacagcggcagcgccaccaagaacaccaacgtgaagagcctgcaggagctgtgcagaatggagagcaagaccggccacagaaacagcgagcaccagcagggccacctgagactggtggtgcccacccacggcaacagcagcgccgccgtgagcacccccaagaacagcggcgtggccgagcccgtgtacaagaccagccagaagaaggagaacctgagcgccagaagcgtgaccagcagccccgtggagaagaaggacaaggaggagaccgtgttccaggtgagctaccccagcgccttcagcaagctggtggccagcagacaggtgagccccctgctggccagccagagctggagcagcagaagcatgagccccaacctgctgaacagagccagccccctggccttcaacatcgccaacagcagcagcgaggccgactgccccgaccccttcgccaacggcgccgacgtgcaggtgagcaacatcgactacagactgagcagaaaggagctgcagcagctgctgcaggaggccttcgccagacacggcaaggtgaagagcgtggagctgagcccccacaccgactaccagctgaaggccgtggtgcagatggagaacctgcaggacgccatcggcgccgtgaacagcctgcacagatacaagatcggcagcaagaagatcctggtgagcctggccaccggcgccgccagcaagagcctgagcctgctgagcgccgagaccatgagcgtgctgcaggacgcccccgcctgctgcctgcccctgttcaagttcaccgacatctacgagaagaagttcggccacaagctgaacgtgagcgacctgtacaagctgaccgacaccgtggccatcagagagcagggcaacggcagactggtgtgcctgctgcccagcagccaggccagacagagccccctgggcagcagccagagccacgacggcagcagcaccaactgcagccccatcatcttcgaggagctggagtaccacgagcccgtgtgcagacagcactgcagcaacaaggacttcagcgagcacgagttcgaccccgacagctacaagatccccttcgtgatcctgagcctgaagaccttcgccccccaggtgcacagcctgctgcagacccacgagggcaccgtgcccctgctgagcttccccgactgctacatcgccgagttcggcgacctggaggtggtgcaggagaaccagggcggcgtgcccctggagcacttcatcacctgcgtgcccggcgtgaacatcgccaccgcccagaacggcatcaaggtggtgaagtggatccacaacaagccccccccccccaacaccgacccctggctgctgagaagcaagagccccgtgggcaacccccagctgatccagttcagcagagaggtgatcgacctgctgaagagccagcccagctgcgtgatccccatcagccacttcatccccagctaccaccaccacttcgccaagcagtgcagagtgagcgactacggctacagcaagctgatcgagctgctggaggccgtgccccacgtgctgcagatcctgggcatgggcagcaagagactgctgaccctgacccacagagcccaggtgaagagattcacccaggacctgctgaagctgctgaagagccaggccagcaagcaggtgatcgtgagagagttcagccaggcctaccactggtgcttcagcaaggactgggacgtgaccgagtacggcgtgtgcgagctgatcgacatcgtgagcgagatccccgacaccaccatctgcctgagccagcaggacaacgagatggtgatctgcatccccaagagagagagaacccaggacgagatcgagagaaccaagcagttcagcaaggacgtggtggacctgctgagacaccagccccacttcagaatgcccttcaacaagttcatccccagctaccaccaccacttcggcagacagtgcaagctggcctactacggcttcaccaagctgctggagctgttcgaggccatccccgacaccctgcaggtgctggagtgcggcgaggagaagatcctgaccctgaccgaggtggagagattcaaggccctggccgcccagttcgtgaagctgctgagaagccagaaggacaactgcctgatgatgaccgacctgctgaccgagtacgccaagaccttcggctacaccttcagactgcaggactacgacgtgagcagcatcagcgccctgacccagaagctgtgccacgtggtgaaggtggccgacatcgagagcggcagacagatccagctgatcaacagaaagagcctgagaagcctgaccgcccagctgctggtgctgctgatgagctgggagggcaccacccacctgagcgtggaggagctgaagagacactacgagagcacccacaacacccccctgaacccctgcgagtacggcttcatgaccctgaccgagctgctgaagagcctgccctacctggtggaggtgttcaccaacgacaagatggaggagtgcgtgaagctgaccagcctgtacctgttcgccaagaacgtgagaagcctgctgcacacctaccactaccagcagatcttcctgcacgagttcagcatggcctacaccaagtacgtgggcgagaccctgcagcccaagacctacggccacagcagcgtggaggagctgctgggcgccatcccccaggtggtgtggatcaagggccacggccacaagagaatcgtggtgctgaagaacgacatgaagagcagactgagcagcctgagcctgagccccgccaaccacgagaaccagcccagcgagggcgagagaatcctggaggtgcccgagagccacaccgccagcgagctgaagctgggcgccgacggcagcggccccagccacaccgagcaggagctgctgagactgaccgacgacagccccgtggacctgctgtgcgcccccgtgcccagctgcctgcccagcccccagctgagacccgaccccgtgatcctgcagagcgccgacctgatccagttcgaggagagaccccaggagcccagcgagatcatgatcctgaaccaggaggagaagatggagatccccatccccggcaagagcaagaccctgaccagcgacagcagcagcagctgcatcagcgccgccgtgcccgtgcccccctgccccagcagcgagaccagcgagagcctgctgagcaaggaccccgtggagagccccgccaagaagcagcccaagaacagagtgaagctggccgccaacttcagcctggcccccatcaccaagctgtag

SEQ ID NO: 11462 - DNA, 831 bp, Artificial Sequence
  Description of Artificial Sequence: Synthetic coding sequence
atgtgcagcaccagcggctgcgacctggaggagatccccctggacgacgacgacctgaacaccatcgagttcaagatcctggcctactacaccagacaccacgtgttcaagagcacccccgccctgttcagccccaagctgctgagaaccagaagcctgagccagagaggcctgggcaactgcagcgccaacgagagctggaccgaggtgagctggccctgcagaaacagccagagcagcgagaaggccatcaacctgggcaagaagaagagcagctggaaggccttcttcggcgtggtggagaaggaggacagccagagcacccccgccaaggtgagcgcccagggccagagaaccctggagtaccaggacagccacagccagcagtggagcagatgcctgagcaacgtggagcagtgcctggagcacgaggccgtggaccccaaggtgatcagcatcgccaacagagtggccgagatcgtgtacagctggccccccccccaggccacccaggccggcggcttcaagagcaaggagatcttcgtgaccgagggcctgagcttccagctgcagggccacgtgcccgtggccagcagcagcaagaaggacgaggaggagcagatcctggccaagatcgtggagctgctgaagtacagcggcgaccagctggagagaaaggagaaggagtgggaggagagcgccaagaccaagatcaagatggccctgctgtggagaagcagcggcggcggccccagagtgctgagcatccccgaggccttcatgaagaacagcttcaccctgaccccccccggcttcagcgagcacaactag

SEQ ID NO: 11463 - DNA, 552 bp, Artificial Sequence; identical to SEQ ID NO: 10180
  Description of Artificial Sequence: Synthetic coding sequence

SEQ ID NO: 11464 - DNA, 960 bp, Artificial Sequence
  Description of Artificial Sequence: Synthetic coding sequence
atgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagacccctggtgctgctgatccccctgagactgggcctgaccgacatcaacgaggcctacgtggagaccctgaagcactgcttcatgatgccccagagcctgggcgtgatcggcggcaagcccaacagcgcccactacttcatcggctacgtgggcgaggagctgatctacctggacccccacaccacccagcccgccgtggagcccaccgacggctgcttcatccccgacgagagcttccactgccagcaccccccctgcagaatgagcatcgccgagctggaccccagcatcgccgtgggcttcttctgcaagaccgaggacgacttcaacgactggtgccagcaggtgaagaagctgagcctgctgggcggcgccctgcccatgttcgagctggtggagctgcagcccagccacctggcctgccccgacgtgctgaacctgagcctggacagcagcgacgtggagagactggagagattcttcgacagcgaggacgaggacttcgagatcctgagcctgtag

SEQ ID NO: 11465 - DNA, 564 bp, Artificial Sequence
  Description of Artificial Sequence: Synthetic coding sequence
atgaacggcagagccgacttcagagagcccaacgccgaggtgcccagacccatcccccacatcggccccgactacatccccaccgaggaggagagaagagtgttcgccgagtgcaacgacgagagcttctggttcagaagcgtgcccctggccgccaccagcatgctgatcacccagggcctgatcagcaagggcatcctgagcagccaccccaagtacggcagcatccccaagctgatcctggcctgcatcatgggctacttcgccggcaagctgagctacgtgaagacctgccaggagaagttcaagaagctggagaacagccccctgggcgaggccctgagaagcggccaggccagaagaagcagcccccccggccactactaccagaagagcaagtacgacagcagcgtgagcggccagagcagcttcgtgaccagccccgccgccgacaacatcgagatgctgccccactacgagcccatccccttcagcagcagcatgaacgagagcgcccccaccggcatcaccgaccacatcgtgcagggcagaaacttcagctag

SEQ ID NO: 11466 - DNA, 270 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagagcctggacgaggaggagaagctggagctgcagagaagactggaggcccagaaccaggagagaagaaagagcaagagcggcgccggcaagggcaagctgaccagaagcctggccgtgtgcgaggagagcagcgccagacccggcggcgagagcctgcaggaccagaccctgtag

SEQ ID NO: 11467 - DNA, 270 bp, Artificial Sequence; identical to SEQ ID NO: 11466
  Description of Artificial Sequence: Synthetic coding sequence

SEQ ID NO: 11468 - DNA, 1473 bp, Artificial Sequence
  Description of Artificial Sequence: Synthetic coding sequence
atggaggacagcgccagcgccagcctgagcagcgccgccgccaccggcaccagcaccagcacccccgccgcccccaccgccagaaagcagctggacaaggagcaggtgagaaaggccgtggacgccctgctgacccactgcaagagcagaaagaacaactacggcctgctgctgaacgagaacgagagcctgttcctgatggtggtgctgtggaagatccccagcaaggagctgagagtgagactgaccctgccccacagcatcagaagcgacagcgaggacatctgcctgttcaccaaggacgagcccaacagcacccccgagaagaccgagcagttctacagaaagctgctgaacaagcacggcatcaagaccgtgagccagatcatcagcctgcagaccctgaagaaggagtacaagagctacgaggccaagctgagactgctgagcagcttcgacttcttcctgaccgacgccagaatcagaagactgctgcccagcctgatcggcagacacttctaccagagaaagaaggtgcccgtgagcgtgaacctgctgagcaagaacctgagcagagagatcaacgactgcatcggcggcaccgtgctgaacatcagcaagagcggcagctgcagcgccatcagaatcggccacgtgggcatgcagatcgagcacatcatcgagaacatcgtggccgtgaccaagggcctgagcgagaagctgcccgagaagtgggagagcgtgaagctgctgttcgtgaagaccgagaagagcgccgccctgcccatcttcagcagcttcgtgagcaactgggacgaggccaccaagagaagcctgctgaacaagaagaagaaggaggccagaagaaagagaagagagagaaacttcgagaagcagaaggagagaaagaagaagagacagcaggccagaaagaccgccagcgtgctgagcaaggacgacgtggcccccgagagcggcgacaccaccgtgaagaagcccgagagcaagaaggagcagacccccgagcacggcaagaagaagagaggcagaggcaaggcccaggtgaaggccaccaacgagagcgaggacgagatcccccagctggtgcccatcggcaagaagacccccgccaacgagaaggtggagatccagaagcacgccaccggcaagaagagccccgccaagagccccaaccccagcacccccagaggcaagaagagaaaggccctgcccgccagcgagacccccaaggccgccgagagcgagacccccggcaagagccccgagaagaagcccaagatcaaggaggaggccgtgaaggagaagagccccagcctgggcaagaaggacgccagacagacccccaagaagcccgaggccaagttcttcaccacccccagcaagagcgtgagaaaggccagccacacccccaagaagtggcccaagaagcccaaggtgccccagagcacctag

SEQ ID NO: 11469 - DNA, 495 bp, Artificial Sequence
  Description of Artificial Sequence: Synthetic coding sequence
atggccgagcccgccagcgtggccgccgagagcctggccggcagcagagccagagccgccagaaccgtgctgggccaggtggtgctgcccggcgaggagctgctgctgcccgagcaggaggacgccgagggccccggcggcgccgtggagagacccctgagcctgaacgccagagcctgcagcagagtgagagtggtgtgcggccccggcctgagaagatgcggcgacagactgctggtgaccaagtgcggcagactgagacacaaggagcccggcagcggcagcggcggcggcgtgtactgggtggacagccagcagaagagatacgtgcccgtgaagggcgaccacgtgatcggcatcgtgaccgccaagagcggcgacatcttcaaggtggacgtgggcggcagcgagcccgccagcctgagctacctgagcttcgagggcgccaccaagagaaacagacccaacgtgcaggccatcagcagcagactgtag

SEQ ID NO: 11470 - DNA, 2508 bp, Artificial Sequence
  Description of Artificial Sequence: Synthetic coding sequence
atgacctgcaacaagcacggctgcagacaggccttccacgtgacctgcgcccagttcgccggcctgctgtgcgaggaggagggcaacggcgccgacaacgtgcagtactgcggctactgcaagtaccacttcagcaagctgaagaagagcaagagaggcagcaacagaagctacgaccagagcctgagcgacagcagcagccacagccaggacaagcaccacgagaaggagaagaagaagtacaaggagaaggacaagcacaagcagaagcacaagaagcagcccgagcccagccccgccctggtgcccagcctgaccgtgaccaccgagaagacctacaccagcaccagcaacaacagcatcagcggcagcctgaagagactggaggacaccaccgccagattcaccaacgccaacttccaggaggtgagcgcccacaccagcagcggcaaggacgtgagcgagaccagaggcagcgagggcaagggcaagaagagcagcgcccacagcagcggccagagaggcagaaagcccggcggcggcagaaaccccggcaccaccgtgagcgccgccagccccttcccccagggcagcttcagcggcacccccggcagcgtgaagagcagcagcggcagcagcgtgcagagcccccaggacttcctgagcttcaccgacagcgacctgagaaacgacagctacagccacagccagcagagcagcgccaccaaggacgtgcacaagggcgagagcggcagccaggagggcggcgtgaacagcttcagcaccctgatcggcctgcccagcaccagcgccgtgaccagccagcccaagagcttcgagaacagccccggcgacctgggcaacagcagcctgcccaccgccggctacaagagagcccagaccagcggcatcgaggaggagaccgtgaaggagaagaagagaaagggcaacaagcagagcaagcacggccccggcagacccaagggcaacaagaaccaggagaacgtgagccacctgagcgtgagcagcgccagccccaccagcagcgtggccagcgccgccggcagcatcaccagcagcagcctgcagaagagccccaccctgctgagaaacggcagcctgcagagcctgagcgtgggcagcagccccgtgggcagcgagatcagcatgcagtacagacacgacggcgcctgccccaccaccagcatctacaacagcaacgacgtggccgtgagcttccccaacgtggtgagcggcagcggcagcagcacccccgtgagcagcagccacctgccccagcagagcagcggccacctgcagcaggtgggcgccctgagccccagcgccgtgagcagcgccgcccccgccgtggccaccacccaggccaacaccctgagcggcagcagcctgagccaggcccccagccacatgtacggcaacagaagcaacagcagcatggccgccctgatcgcccagagcgagaacaaccagaccgaccaggacctgggcgacaacagcagaaacctggtgggcagaggcagcagccccagaggcagcctgagccccagaagccccgtgagcagcctgcagatcagatacgaccagcccggcaacagcagcctggagaacctgccccccgtggccgccagcatcgagcagctgctggagagacagtggagcgagggccagcagttcctgctggagcagggcacccccagcgacatcctgggcatgctgaagagcctgcaccagctgcaggtggagaacagaagactggaggagcagatcaagaacctgaccgccaagaaggagagactgcagctgctgaacgcccagctgagcgtgcccttccccaccatcaccgccaaccccagccccagccaccagatccacaccttcagcgcccagaccgcccccaccaccgacagcctgaacagcagcaagagcccccacatcggcaacagcttcctgcccgacaacagcctgcccgtgctgaaccaggacctgaccagcagcggccagagcaccagcagcagcagcgccctgagcacccccccccccgccggccagagccccgcccagcagggcagcggcgtgagcggcgtgcagcaggtgaacggcgtgaccgtgggcgccctggccagcggcatgcagcccgtgaccagcaccatccccgccgtgagcgccgtgggcggcatcatcggcgccctgcccggcaaccagctggccatcaacggcatcgtgggcgccctgaacggcgtgatgcagacccccgtgaccatgagccagaaccccacccccctgacccacaccaccgtgccccccaacgccacccaccccatgcccgccaccctgaccaacagcgccagcggcctgggcctgctgagcgaccagcagagacagatcctgatccaccagcagcagttccagcagctgctgaacagccagcagctgacccccaacatggtgaaggagttcagcgcccagatcatcgcctggagaccctag

SEQ ID NO: 11471 - DNA, 1620 bp, Artificial Sequence; identical to SEQ ID NO: 10018
  Description of Artificial Sequence: Synthetic coding sequence

SEQ ID NO: 11472 - DNA, 444 bp, Artificial Sequence; identical to SEQ ID NO: 9837
  Description of Artificial Sequence: Synthetic coding sequence

SEQ ID NO: 11473 - DNA, 951 bp, Artificial Sequence; identical to SEQ ID NO: 10366
  Description of Artificial Sequence: Synthetic coding sequence

SEQ ID NO: 11474 - DNA, 951 bp, Artificial Sequence; identical to SEQ ID NO: 10366
  Description of Artificial Sequence: Synthetic coding sequence

SEQ ID NO: 11475 - DNA, 810 bp, Artificial Sequence; identical to SEQ ID NO: 9299
  Description of Artificial Sequence: Synthetic coding sequence

SEQ ID NO: 11476 - DNA, 1173 bp, Artificial Sequence; identical to SEQ ID NO: 9682
  Description of Artificial Sequence: Synthetic coding sequence

SEQ ID NO: 11477 - DNA, 381 bp, Artificial Sequence
  Description of Artificial Sequence: Synthetic coding sequence
atgcccttcttcggcaacaccttcagccccaagaagaccccccccagaaagagcgccagcctgagcaacctgcacagcctggacagaagcaccagagaggtggagctgggcctggagtacggcagccccaccatgaacctggccggccagagcctgaagttcgagaacggccagtggatcgccgagaccggcgtgagcggcggcgtggacagaagagaggtgcagagactgagaagaagaaaccagcagctggaggaggagaacaacctgctgagactgaaggtggacatcctgctggacatgctgagcgagagcaccgccgagagccacctgatggagaaggagctggacgagctgagaatcagcagaaagagaaagtag

SEQ ID NO: 11478 - DNA, 711 bp, Artificial Sequence
  Description of Artificial Sequence: Synthetic coding sequence
atgcaggtgcaggacgacggcgtgaacctgatccccttcgccaagtgcagcagagtggtgagcagaagccccccccccagactgcccagccagagcctgagacccatgccccagagatacggcgacgtgttctggaagaacctgaaccagagacccacccccacctggctggaggagcagcacatcccccccatgctgagagccaccggctgcagccagctgggcctgtacccccccgagcagctgcccccccccgagatgctgtggagaagaaagaagagaagaccctgcctggagggcatgcagcagcagggcctgggcggcgtgcccgccagagtgagagccgtgacctaccacctggaggacctgagaagaagacagagcatcatcaacgagctgaagaaggcccagtggggcagcagcggcgccgccagcgagcccgtggtgctgggcgaggagggctgcggcttccccagcaccaacgagtaccccgacctggaggaggagagagccacctacccccaggaggaggacagattcctgacccccggcagagcccagctgctgtggagcccctggagccccctggaccaggaggaggcctgcgccagcagacagctgcacagcctggccagcttcagcaccgtgaccgccagaagaaaccccctgcacaacccctggggcatggagctggccgccagcgaggagtag

SEQ ID NO: 11479 - DNA, 1680 bp, Artificial Sequence
  Description of Artificial Sequence: Synthetic coding sequence
atgaaccccctgttcggccccaacctgttcctgctgcagcaggagcagcagggcctggccggccccctgggcgacagcctgggcggcgaccacttcgccggcggcggcgacctgccccccgcccccctgagccccgccggccccgccgcctacagcccccccggccccggccccgccccccccgccgccatggccctgagaaacgacctgggcagcaacatcaacgtgctgaagaccctgaacctgagattcagatgcttcctggccaaggtgcacgagctggagagaagaaacagactgctggagaagcagctgcagcaggccctggaggagggcaagcagggcagaagaggcctgggcagaagagaccaggccgtgcagaccggcttcgtgagccccatcagacccctgggcctgcagctgggcgccagacccgccgccgtgtgcagccccagcgccagagtgctgggcagccccgccagaagccccgccggccccctggcccccagcgccgccagcctgagcagcagcagcaccagcaccagcaccacctacagcagcagcgccagattcatgcccggcaccatctggagcttcagccacgccagaagactgggccccggcctggagcccaccctggtgcagggccccggcctgagctgggtgcaccccgacggcgtgggcgtgcagatcgacaccatcacccccgagatcagagccctgtacaacgtgctggccaaggtgaagagagagagagacgagtacaagagaagatgggaggaggagtacaccgtgagaatccagctgcaggacagagtgaacgagctgcaggaggaggcccaggaggccgacgcctgccaggaggagctggccctgaaggtggagcagctgaaggccgagctggtggtgttcaagggcctgatgagcaacaacctgagcgagctggacaccaagatccaggagaaggccatgaaggtggacatggacatctgcagaagaatcgacatcaccgccaagctgtgcgacgtggcccagcagagaaactgcgaggacatgatccagatgttccaggtgcccagcatgggcggcagaaagagagagagaaaggccgccgtggaggaggacaccagcctgagcgagagcgagggccccagacagcccgacggcgacgaggaggagagcaccgccctgagcatcaacgaggagatgcagagaatgctgaaccagctgagagagtacgacttcgaggacgactgcgacagcctgacctgggaggagaccgaggagaccctgctgctgtgggaggacttcagcggctacgccatggccgccgccgaggcccagggcgagcaggaggacagcctggagaaggtgatcaaggacaccgagagcctgttcaagaccagagagaaggagtaccaggagaccatcgaccagatcgagctggagctggccaccgccaagaacgacatgaacagacacctgcacgagtacatggagatgtgcagcatgaagagaggcctggacgtgcagatggagacctgcagaagactgatcacccagagcggcgacagaaagagccccgccttcaccgccgtgcccctgagcgaccccccccccccccccagcgaggccgaggacagcgacagagacgtgagcagcgacagcagcatgagatag

SEQ ID NO: 11480 - DNA, 1182 bp, Artificial Sequence
  Description of Artificial Sequence: Synthetic coding sequence
atggccagcggcagagccagatgcaccagaaagctgagaaactgggtggtggagcaggtggagagcggccagttccccggcgtgtgctgggacgacaccgccaagaccatgttcagaatcccctggaagcacgccggcaagcaggacttcagagaggaccaggacgccgccttcttcaaggcctgggccatcttcaagggcaagtacaaggagggcgacaccggcggccccgccgtgtggaagaccagactgagatgcgccctgaacaagagcagcgagttcaaggaggtgcccgagagaggcagaatggacgtggccgagccctacaaggtgtaccagctgctgccccccggcatcgtgagcggccagcccggcacccagaaggtgcccagcaagagacagcacagcagcgtgagcagcgagagaaaggaggaggaggacgccatgcagaactgcaccctgagccccagcgtgctgcaggacagcctgaacaacgaggaggagggcgccagcggcggcgccgtgcacagcgacatcggcagcagcagcagcagcagcagccccgagccccaggaggtgaccgacaccaccgaggcccccttccagggcgaccagagaagcctggagttcctgctgccccccgagcccgactacagcctgctgctgaccttcatctacaacggcagagtggtgggcgaggcccaggtgcagagcctggactgcagactggtggccgagcccagcggcagcgagagcagcatggagcaggtgctgttccccaagcccggccccctggagcccacccagagactgctgagccagctggagagaggcatcctggtggccagcaaccccagaggcctgttcgtgcagagactgtgccccatccccatcagctggaacgccccccaggccccccccggccccggcccccacctgctgcccagcaacgagtgcgtggagctgttcagaaccgcctacttctgcagagacctggtgagatacttccagggcctgggccccccccccaagttccaggtgaccctgaacttctgggaggagagccacggcagcagccacaccccccagaacctgatcaccgtgaagatggagcaggccttcgccagatacctgctggagcagacccccgagcagcaggccgccatcctgagcctggtgtag

SEQ ID NO: 11481 - DNA, 2454 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacccagatcctggagagactgtgcagattcgactacctgaccgtggtgatcctgggcgaggacgtgatcctgaacgagcccgtggagaactggcccagctgccactgcctgatcagcttccacagcaagggcttccccctggacaaggccgtggcctacagcaagctgagaaaccccttcctgatcaacgacctggccatgcagtactacatccaggacagaagagaggtgtacagaatcctgcaggaggagggcatcgacctgcccagatacgccgtgctgaacagagaccccgccagacccgaggagtgcaacctgatcgagggcgaggaccaggtggaggtgaacggcgccgtgttccccaagcccttcgtggagaagcccgtgagcgccgaggaccacaacgtgtacatctactaccccagcagcgccggcggcggcagccagagactgttcagaaagatcggcagcagaagcagcgtgtacagccccgagagcagcgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggagatccagtaccccgtgatgctgaccgccatggagaagctggtggccagaaaggtgtgcgtggccttcaagcagaccgtgtgcggcttcgacctgctgagagccaacggccacagcttcgtgtgcgacgtgaacggcttcagcttcgtgaagaacagcatgaagtactacgacgactgcgccaagatcctgggcaacaccatcatgagagagctggccccccagttccagatcccctggagcatccccaccgaggccgaggacatccccatcgtgcccaccaccagcggcaccatgatggagctgagatgcgtgatcgccatcatcagacacggcgacagaacccccaagcagaagatgaagatggaggtgaagcaccccagattcttcgccctgttcgagaagcacggcggctacaagaccggcaagctgaagctgaagagacccgagcagctgcaggaggtgctggacatcaccagactgctgctggccgagctggagaaggagcccggcggcgagatcgaggagaagaccggcaagctggagcagctgaagagcgtgctggagatgtacggccacttcagcggcatcaacagaaaggtgcagctgacctactacccccacggcgtgaaggccagcaacgagggccaggacccccagagagagaccctggcccccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcaccttcagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacggcgacagcctgagcagctgccagcacagagtgaaggccagactgcaccacatcctgcagcaggacgcccccttcggccccgaggactacgaccagctggcccccaccagaagcaccagcctgctgaacagcatgaccatcatccagaaccccgtgaaggtgtgcgaccaggtgttcgccctgatcgagaacctgacccaccagatcagagagagaatgcaggaccccagaagcgtggacctgcagctgtaccacagcgagaccctggagctgatgctgcagagatggagcaagctggagagagacttcagacagaagagcggcagatacgacatcagcaagatccccgacatctacgactgcgtgaagtacgacgtgcagcacaacggcagcctgggcctgcagggcaccgccgagctgctgagactgagcaaggccctggccgacgtggtgatcccccaggagtacggcatcagcagagaggagaagctggagatcgccgtgggcttctgcctgcccctgctgagaaagatcctgctggacctgcagagaacccacgaggacgagagcgtgaacaagctgcaccccctgtag

SEQ ID NO: 11482 - DNA, 417 bp, Artificial Sequence; identical to SEQ ID NO: 9323
  Description of Artificial Sequence: Synthetic coding sequence

SEQ ID NO: 11483 - DNA, 4302 bp, Artificial Sequence; identical to SEQ ID NO: 9764
  Description of Artificial Sequence: Synthetic coding sequence

SEQ ID NO: 11484 - DNA, 435 bp, Artificial Sequence
  Description of Artificial Sequence: Synthetic coding sequence
atggccgaggtgcaggtgctggtgctggacggcagaggccacctgctgggcagactggccgccatcgtggccaagcaggtgctgctgggcagaaaggtggtggtggtgagatgcgagggcatcaacatcagcggcaacttctacagaaacaagctgaagtacctggccttcctgagaaagagaatgaacaccaaccccagcagaggcccctaccacttcagagcccccagcagaatcttctggagaaccgtgagaggcatgctgccccacaagaccaagagaggccaggccgccctggacagactgaaggtgttcgacggcatcccccccccctacggcaacagacccagaagaacctggagaagaaagctgaccaacacccagagaagcagcagacccaccgacagctggagcgagcccaacaaggactgctag

SEQ ID NO: 11485 - DNA, 408 bp, Artificial Sequence
  Description of Artificial Sequence: Synthetic coding sequence
atggccgccctgagacccctggtgaagcccaagatcgtgaagaagagaaccaagaagttcatcagacaccagagcgacagatacgtgaagatcaagagaaactggagaaagcccagaggcatcgacaacagagtgagaagaagattcaagggccagatcctgatgcccaacatcggctacggcagcaacaagaagaccaagcacatgctgcccagcggcttcagaaagttcctggtgcacaacgtgaaggagctggaggtgctgctgatgtgcaacaagagctactgcgccgagatcgcccacaacgtgagcagcaagaacagaaaggccatcgtggagagagccgcccagctggccatcagagtgaccaaccccaacgccagactgagaagcgaggagaacgagtag

SEQ ID NO: 11486 - DNA, 408 bp, Artificial Sequence; identical to SEQ ID NO: 11485
  Description of Artificial Sequence: Synthetic coding sequence

SEQ ID NO: 11487 - DNA, 684 bp, Artificial Sequence
  Description of Artificial Sequence: Synthetic coding sequence
atggagccccagggctaccccgccttcggctgggaccacagcctgcacaagagaaagagactgccccccgtgaagagaagcctggtgtactacctgaagaacagagaggtgagactgcagaacgagaccagctacagcagagtgctgcacggctacgccgcccagcagctgcccagcctgctgaaggagagagagttccacctgggcaccctgaacaaggtgttcgccagccagtggctgaaccacagacaggtggtgtgcggcaccaagtgcaacaccctgttcgtggtggacgtgcagaccagccagatcaccaagatccccatcctgaaggacagagagcccggcggcgtgacccagcagggctgcggcatccacgccatcgagctgaaccccagcagaaccctgctggccaccggcggcgacaaccccaacagcctggccatctacagactgcccaccctggaccccgtgtgcgtgggcgacgacggccacaaggactggatcttcagcatcgcctggatcagcgacaccatggccgtgagcggcagcagagacggcagcatgggcctgtgggaggtgaccgacgacgtgctgaccaagagcgacgccagacacaacgtgagcagagtgcccgtgtacgcccacatcacccacaaggccctgaaggacatccccaagtag

SEQ ID NO: 11488 - DNA, 1554 bp, Artificial Sequence
  Description of Artificial Sequence: Synthetic coding sequence
atgaccagactgggcaccgtgcccagaaaggccctggagatgagctgcgccatccagaaccagctggccagaatcctggccgagttcgagatgaccctggagagagacgtgctgcagcccctgagcagactgagcgaggaggagctgcccgccatcctgaagcacaagaagagcctgcagaagctggtgagcgactggaacaccctgaagagcagactgagccaggccaccaagaacagcggcagcagccagggcctgggcggcagccccggcagccacagccacaccaccatggccaacaaggtggagaccctgaaggaggaggaggaggagctgaagagaaaggtggagcagtgcagagacgagtacctggccgacctgtaccacttcgtgaccaaggaggacagctacgccaactacttcatcagactgctggagatccaggccgactaccacagaagaagcctgagcagcctggacaccgccctggccgagctgagagagaaccacggccaggccgaccacagccccagcatgaccgccacccacttccccagagtgtacggcgtgagcctggccacccacctgcaggagctgggcagagagatcgccctgcccatcgaggcctgcgtgatgatgctgctgagcgagggcatgaaggaggagggcctgttcagactggccgccggcgccagcgtgctgaagagactgaagcagaccatggccagcgacccccacagcctggaggagttctgcagcgacccccacgccgtggccggcgccctgaagagctacctgagagagctgcccgagcccctgatgaccttcgacctgtacgacgactggatgagagccgccagcctgaaggagcccggcgccagactgcaggccctgcaggaggtgtgcagcagactgccccccgagaacctgagcaacctgagatacctgatgaagttcctggccagactggccgaggagcaggaggtgaacaagatgacccccagcaacatcgccatcgtgctgggccccaacctgctgtggccccccgagaaggagggcgaccaggcccagctggacgccgccagcgtgagcagcatccaggtggtgggcgtggtggaggccctgatccagagcgccgacaccctgttccccggcgacatcaacttcaacgtgagcggcctgttcagcgccgtgaccctgcaggacaccgtgagcgacagactggccagcgaggagctgcccagcaccgccgtgcccacccccgccaccacccccgcccccgcccccgcccccgcccccgcccccgcccccgccctggccagcgccgccaccaaggagagaaccgagagcgaggtgccccccagacccgccagccccaaggtgaccagaagcccccccgagaccgccgcccccgtggaggacatggccagaagaagccccagaggcgccaccggcagaaaggagagattcgcctgcagctacggcaccgacagcagcctggccgacatgttcttcgtgagactggtgaacaagctgttctggaccaagctgtag

SEQ ID NO: 11489 - DNA, 918 bp, Artificial Sequence; identical to SEQ ID NO: 9729
  Description of Artificial Sequence: Synthetic coding sequence

SEQ ID NO: 11490 - DNA, 927 bp, Artificial Sequence
  Description of Artificial Sequence: Synthetic coding sequence
atgatccacgacgcccagatggactactacggcaccagactggccacctgcagcagcgacagaagcgtgaagatcttcgacgtgagaaacggcggccagatcctgatcgccgacctgagaggccacgagggccccgtgtggcaggtggcctgggcccaccccatgtacggcaacatcctggccagctgcagctacgacagaaaggtgatcatctggagagaggagaacggcacctgggagaagagccacgagcacgccggccacgacagcagcgtgaacagcgtgtgctgggccccccacgactacggcctgatcctggcctgcggcagcagcgacggcgccatcagcctgctgacctacaccggcgagggccagtgggaggtgaagaagatcaacaacgcccacaccatcggctgcaacgccgtgagctgggcccccgccgtggtgcccggcagcctgatcgaccaccccagcggccagaagcccaactacatcaagagattcgccagcggcggctgcgacaacctgatcaagctgtggaaggaggaggaggacggccagtggaaggaggagcagaagctggaggcccacagcgactgggtgagagacgtggcctgggcccccagcatcggcctgcccaccagcaccatcgccagctgcagccaggacggcagagtgttcatctggacctgcgacgacgccagcagcaacacctggagccccaagctgctgcacaagttcaacgacgtggtgtggcacgtgagctggagcatcaccgccaacatcctggccgtgagcggcggcgacaacaaggtgaccctgtggaaggagagcgtggacggccagtgggtgtgcatcagcgacgtgaacaagggccagggcagcgtgagcgccagcgtgaccgagggccagcagaacgagcagtag

SEQ ID NO: 11491 - DNA, 1542 bp, Artificial Sequence
  Description of Artificial Sequence: Synthetic coding sequence
atgagcatcgagatcgagagcagcgacgtgatcagactgatcatgcagtacctgaaggagaacagcctgcacagagccctggccaccctgcaggaggagaccaccgtgagcctgaacaccgtggacagcatcgagagcttcgtggccgacatcaacagcggccactgggacaccgtgctgcaggccatccagagcctgaagctgcccgacaagaccctgatcgacctgtacgagcaggtggtgctggagctgatcgagctgagagagctgggcgccgccagaagcctgctgagacagaccgaccccatgatcatgctgaagcagacccagcccgagagatacatccacctggagaacctgctggccagaagctacttcgaccccagagaggcctaccccgacggcagcagcaaggagaagagaagagccgccatcgcccaggccctggccggcgaggtgagcgtggtgccccccagcagactgatggccctgctgggccaggccctgaagtggcagcagcaccagggcctgctgccccccggcatgaccatcgacctgttcagaggcaaggccgccgtgaaggacgtggaggaggagaagttccccacccagctgagcagacacatcaagttcggccagaagagccacgtggagtgcgccagattcagccccgacggccagtacctggtgaccggcagcgtggacggcttcatcgaggtgtggaacttcaccaccggcaagatcagaaaggacctgaagtaccaggcccaggacaacttcatgatgatggacgacgccgtgctgtgcatgtgcttcagcagagacaccgagatgctggccaccggcgcccaggacggcaagatcaaggtgtggaagatccagagcggccagtgcctgagaagattcgagagagcccacagcaagggcgtgacctgcctgagcttcagcaaggacagcagccagatcctgagcgccagcttcgaccagaccatcagaatccacggcctgaagagcggcaagaccctgaaggagttcagaggccacagcagcttcgtgaacgaggccaccttcacccaggacggccactacatcatcagcgccagcagcgacggcaccgtgaagatctggaacatgaagaccaccgagtgcagcaacaccttcaagagcctgggcagcaccgccggcaccgacatcaccgtgaacagcgtgatcctgctgcccaagaaccccgagcacttcgtggtgtgcaacagaagcaacaccgtggtgatcatgaacatgcagggccagatcgtgagaagcttcagcagcggcaagagagagggcggcgacttcgtgtgctgcgccctgagccccagaggcgagtggatctactgcgtgggcgaggacttcgtgctgtactgcttcagcaccgtgaccggcaagctggagagaaccctgaccgtgcacgagaaggacgtgatcggcatcgcccaccacccccaccagaacctgatcgccacctacagcgaggacggcctgctgaagctgtggaagccctag

SEQ ID NO: 11492 - DNA, 2136 bp, Artificial Sequence
  Description of Artificial Sequence: Synthetic coding sequence
atgagcagcgtgcagagccagcaggagcagctgagccagagcgaccccagccccagccccaacagctgcagcagcttcgagctgatcgacatggacgccggcagcctgtacgagcccgtgagcccccactggttctactgcaagatcatcgacagcaaggagacctggatccccttcaacagcgaggacagccagcagctggaggaggcctacagcagcggcaagggctgcaacggcagagtggtgcccaccgacggcggcagatacgacgtgcacctgggcgagagaatgagatacgccgtgtactgggacgagctggccagcgaggtgagaagatgcacctggttctacaagggcgacaaggacaacaagtacgtgccctacagcgagagcttcagccaggtgctggaggagacctacatgctggccgtgaccctggacgagtggaagaagaagctggagagccccaacagagagatcatcatcctgcacaaccccaagctgatggtgcactaccagcccgtggccggcagcgacgactggggcagcacccccaccgagcagggcagacccagaaccgtgaagagaggcgtggagaacatcagcgtggacatccactgcggcgagcccctgcagatcgaccacctggtgttcgtggtgcacggcatcggccccgcctgcgacctgagattcagaagcatcgtgcagtgcgtgaacgacttcagaagcgtgagcctgaacctgctgcagacccacttcaagaaggcccaggagaaccagcagatcggcagagtggagttcctgcccgtgaactggcacagccccctgcacagcaccggcgtggacgtggacctgcagagaatcaccctgcccagcatcaacagactgagacacttcaccaacgacaccatcctggacgtgttcttctacaacagccccacctactgccagaccatcgtggacaccgtggccagcgagatgaacagaatctacaccctgttcctgcagagaaaccccgacttcaagggcggcgtgagcatcgccggccacagcctgggcagcctgatcctgttcgacatcctgaccaaccagaaggacagcctgggcgacatcgacagcgagaaggacagcctgaacatcgtgatggaccagggcgacacccccaccctggaggaggacctgaagaagctgcagctgagcgagttcttcgacatcttcgagaaggagaaggtggacaaggaggccctggccctgtgcaccgacagagacctgcaggagatcggcatccccctgggccccagaaagaagatcctgaactacttcagcaccagaaagaacagcatgggcatcaagagacccgccccccagcccgccagcggcgccaacatccccaaggagagcgagttctgcagcagcagcaacaccagaaacggcgactacctggacgtgggcatcggccaggtgagcgtgaagtaccccagactgatctacaagcccgagatcttcttcgccttcggcagccccatcggcatgttcctgaccgtgagaggcctgaagagaatcgaccccaactacagattccccacctgcaagggcttcttcaacatctaccaccccttcgaccccgtggcctacagaatcgagcccatggtggtgcccggcgtggagttcgagcccatgctgatcccccaccacaagggcagaaagagaatgcacctggagctgagagagggcctgaccagaatgagcatggacctgaagaacaacctgctgggcagcctgagaatggcctggaagagcttcaccagagccccctaccccgccctgcaggccagcgagacccccgaggagaccgaggccgagcccgagagcaccagcgagaagcccagcgacgtgaacaccgaggagaccagcgtggccgtgaaggaggaggtgctgcccatcaacgtgggcatgctgaacggcggccagagaatcgactacgtgctgcaggagaagcccatcgagagcttcaacgagtacctgttcgccctgcagagccacctgtgctactgggagagcgaggacaccgtgctgctggtgctgaaggagatctaccagacccagggcatcttcctggaccagcccctgcagtag

SEQ ID NO: 11493 - DNA, 3351 bp, Artificial Sequence; identical to SEQ ID NO: 10541
  Description of Artificial Sequence: Synthetic coding sequence

SEQ ID NO: 11494 - DNA, 1233 bp, Artificial Sequence
  Description of Artificial Sequence: Synthetic coding sequence
atgcagaacatccacggcaaggagatcgacctgctgagaaccaccgtgaaggtgcccggcaagagactgcccagagccacccccgccaccgcccccggcaccagccccagagccaacggcctgagcgtggagagaagcaacacccagctgggcggcggcaccgccagcggccccgccgaggtgctgagcagcagccccaagctggaccccccccccagcccccacagcaacagaaagaagcacagaagaaagaagagcaccggcacccccagacccgacggccccagcagcgccaccgaggaggccgaggagagcttcgagttcgtggtggtgagcctgaccggccagacctggcacttcgaggccagcaccgccgaggagagagagctgtgggtgcagagcgtgcaggcccagatcctggccagcctgcagggctgcagaagcgccaaggacaagaccagactgggcaaccagaacgccgccctggccgtgcaggccgtgagaaccgtgagaggcaacagcttctgcatcgactgcgacgcccccaaccccgactgggccagcctgaacctgggcgccctgatgtgcatcgagtgcagcggcatccacagacacctgggcgcccacctgagcagagtgagaagcctggacctggacgactggccccccgagctgctggccgtgatgaccgccatgggcaacgccctggccaacagcgtgtgggagggcgccctgggcggctacagcaagcccggccccgacgcctgcagagaggagaaggagagatggatcagagccaagtacgagcagaagctgttcctggcccccctgcccagcagcgacgtgcccctgggccagcagctgctgagagccgtggtggaggacgacctgagactgctggtgatgctgctggcccacggcagcaaggaggaggtgaacgagacctacggcgacggcgacggcagaaccgccctgcacctgagcagcgccatggccaacgtggtgttcacccagctgctgatctggtacggcgtggacgtgagaagcagagacgccagaggcctgacccccctggcctacgccagaagagccggcagccaggagtgcgccgacatcctgatccagcacggctgccccggcgagggctgcggcctggcccccacccccaacagagagcccgccaacggcaccaaccccagcgccgagctgcacagaagccccagcctgctgtag

SEQ ID NO: 11495 - DNA, 492 bp, Artificial Sequence
  Description of Artificial Sequence: Synthetic coding sequence
atgagcgacagccccgccggcagcaaccccagaacccccgagagcagcggcagcggcagcggcggcggcggcaagagacccgccgtgcccgccgccgtgagcctgctgccccccgccgaccccctgagacaggccaacagactgcccatcagagtgctgaagatgctgagcgcccacaccggccacctgctgcaccccgagtacctgcagcccctgagcagcacccccgtgagccccatcgagctggacgccaagaagagccccctggccctgctggcccagacctgcagccagatcggcagccccggcagcctgagcctgagaaacccccacaccctgggcctgagcagataccacccctacggcaagagccacctgagcaccgccggcggcctggccgtgcccagcctgcccaccgccggcccctactacagcccctacgccctgtacggccagagactggccagcgccagcgccctgggctaccagtag

SEQ ID NO: 11496 - DNA, 2736 bp, Artificial Sequence
  Description of Artificial Sequence: Synthetic coding sequence
atgaacttccaggccggcggcggccagagcccccagcagcagcagagcctggccgcccccggcggcggcggcgccgccgcccagcagctggtgtgcggcggccagttcggcggcgccggccccggcgccggcggcggcggcggccccagccagcagctggccggcggccccccccagcagttcgccctgagcaacagcgccgccatcagagccgagatccagagattcgagagcgtgcaccccaacatctacgccatctacgacctgatcgagagaatcgaggacctggccctgcagaaccagatcagagagcacgtgatcagcatcgaggacagcttcgtgaacagccaggagtggaccctgagcagaagcgtgcccgagctgaaggtgggcatcgtgggcaacctgagcagcggcaagagcgccctggtgcacagatacctgaccggcacctacgtgcaggaggagagccccgagggcggcagattcaagaaggagatcgtggtggacggccagagctacctgctgctgatcagagacgagggcggcccccccgagctgcagttcgccgcctgggtggacgccgtggtgttcgtgttcagcctggaggacgagatcagcttccagaccgtgtacaactacttcctgagactgtgcagcttcagaaacgccagcgaggtgcccatggtgctggtgggcacccaggacgccatcagcgccgccaaccccagagtgatcgacgacagcagagccagaaagctgagcaccgacctgaagagatgcacctactacgagacctgcgccacctacggcctgaacgtggagagagtgttccaggacgtggcccagaaggtggtggccctgagaaagaagcagcagctggccatcggcccctgcaagagcctgcccaacagccccagccacagcgccgtgagcgccgccagcatccccgccgtgcacatcaaccaggccaccaacggcggcggcagcgccttcagcgactacagcagcagcgtgcccagcacccccagcatcagccagagagagctgagaatcgagaccatcgccgccagcagcacccccacccccatcagaaagcagagcaagagaagaagcaacatcttcaccagcagaaagggcgccgacctggacagagagaagaaggccgccgagtgcaaggtggacagcatcggcagcggcagagccatccccatcaagcagggcatcctgctgaagagaagcggcaagagcctgaacaaggagtggaagaagaagtacgtgaccctgtgcgacaacggcctgctgacctaccaccccagcctgcacgactacatgcagaacatccacggcaaggagatcgacctgctgagaaccaccgtgaaggtgcccggcaagagactgcccagagccacccccgccaccgcccccggcaccagccccagagccaacggcctgagcgtggagagaagcaacacccagctgggcggcggcaccggcgccccccacagcgccagcagcgccagcctgcacagcgagagacccctgagcagcagcgcctgggccggccccagacccgagggcctgcaccagagaagctgcagcgtgagcagcgccgaccagtggagcgaggccaccaccagcctgccccccggcatgcagcaccccgccagcggccccgccgaggtgctgagcagcagccccaagctggaccccccccccagcccccacagcaacagaaagaagcacagaagaaagaagagcaccggcacccccagacccgacggccccagcagcgccaccgaggaggccgaggagagcttcgagttcgtggtggtgagcctgaccggccagacctggcacttcgaggccagcaccgccgaggagagagagctgtgggtgcagagcgtgcaggcccagatcctggccagcctgcagggctgcagaagcgccaaggacaagaccagactgggcaaccagaacgccgccctggccgtgcaggccgtgagaaccgtgagaggcaacagcttctgcatcgactgcgacgcccccaaccccgactgggccagcctgaacctgggcgccctgatgtgcatcgagtgcagcggcatccacagacacctgggcgcccacctgagcagagtgagaagcctggacctggacgactggccccccgagctgctggccgtgatgaccgccatgggcaacgccctggccaacagcgtgtgggagggcgccctgggcggctacagcaagcccggccccgacgcctgcagagaggagaaggagagatggatcagagccaagtacgagcagaagctgttcctggcccccctgcccagcagcgacgtgcccctgggccagcagctgctgagagccgtggtggaggacgacctgagactgctggtgatgctgctggcccacggcagcaaggaggaggtgaacgagacctacggcgacggcgacggcagaaccgccctgcacctgagcagcgccatggccaacgtggtgttcacccagctgctgatctggtacggcgtggacgtgagaagcagagacgccagaggcctgacccccctggcctacgccagaagagccggcagccaggagtgcgccgacatcctgatccagcacggctgccccggcgagggctgcggcctggcccccacccccaacagagagcccgccaacggcaccaaccccagcgccgagctgcacagaagccccagcctgctgtag

SEQ ID NO: 11497 - DNA, 1059 bp, Artificial Sequence; identical to SEQ ID NO: 11224
  Description of Artificial Sequence: Synthetic coding sequence

SEQ ID NO: 11498 - DNA, 507 bp, Artificial Sequence
  Description of Artificial Sequence: Synthetic coding sequence
atgaccgccaccctgagaccctacctgagcgccgtgagagccaccctgcaggccgccctgtgcctggagaacttcagcagccaggtggtggagagacacaacaagcccgaggtggaggtgagaagcagcaaggagctgctgctgcagcccgtgaccatcagcagaaacgagaaggagaaggtgctgatcgagggcagcatcaacagcgtgagagtgagcatcgccgtgaagcaggccgacgagatcgagaagatcctgtgccacaagttcatgagattcatgatgatgagagccgagaacttcttcatcctgagaagaaagcccgtggagggctacgacatcagcttcctgatcaccaacttccacaccgagcagatgtacaagcacaagctggtggacttcgtgatccacttcatggaggagatcgacaaggagatcagcgagatgaagctgagcgtgaacgccagagccagaatcgtggccgaggagttcctgaagaacttctag

SEQ ID NO: 11499 - DNA, 993 bp, Artificial Sequence
  Description of Artificial Sequence: Synthetic coding sequence
atggagagattcatggagcaggtggtgttcaagtacctgagagccgagcccgaggaccactacttcctgatgaccgagccccccctgaacacccccgagaacagagagtacctggccgagatcatgttcgagagcttcaacgtgcccggcctgtacatcgccgtgcaggccgtgctggccctggccgccagctggaccagcagacaggtgggcgagagaaccctgaccggcatcgtgatcgacagcggcgacggcgtgacccacgtgatccccgtggccgagggctacgtgatcggcagctgcatcaagcacatccccatcgccggcagagacatcacctacttcatccagcagctgctgagagagagagaggtgggcatcccccccgagcagagcctggagaccgccaaggccatcaaggagaagtactgctacatctgccccgacatcgtgaaggagttcgccaagtacgacgtggaccccagaaagtggatcaagcagtacaccggcatcaacgccatcaaccagaagaagttcgtgatcgacgtgggctacgagagattcctgggccccgagatcttcttccaccccgagttcgccaaccccgacttcatggagagcatcagcgacgtggtggacgaggtgatccagaactgccccatcgacgtgagaagacccctgtacaagaacgtggtgctgagcggcggcagcaccatgttcagagacttcggcagaagactgcagagagacctgaagagagtggtggacgccagactgagactgagcgaggagctgagcggcggcagaatcaagcccaagcccgtggaggtgcaggtggtgacccaccacatgcagagatacgccgtgtggttcggcggcagcatgctggccagcacccccgagttcttccaggtgtgccacaccaagaaggactacgaggagtacggccccagcatctgcagacacaaccccgtgttcggcgtgatgagctag

SEQ ID NO: 11500 - DNA, 894 bp, Artificial Sequence
  Description of Artificial Sequence: Synthetic coding sequence
atgaagaccctgagccccgacagaatccagccccacatcatgaccgacgtgcccgccaccttcacccaggccgagtgcaacggcgacaagccccccgagaacggccagcagaccatcaccaagatcagcgaggagctgaccgacgtggacagccccctgccccactacagagtggagcccagcctggagggcgccctgaccaagggcagccaggaggagagaagaaagctgcagggcaacatgctgctgaacagcagcatggaggacaagatgctgaaggagaaccccgaggagaagctgttcatcgtgcacaaggccatcaccgacctgagcctgcaggagaccagcgccgacgagatgaccttcagagagggccaccagtgggagaagatccccctgagcggcagcaaccaggagatcagaagacagaaggagagaatcaccgagcagcccctgaaggaggaggaggacgaggacagaaagaacaagggccaccaggccgccgagatcgagtggctgggcttcagaaagcccagccaggccgacatgctgcacagcaagcacgacgaggagcagaaggtgtgggacgaggagatcgacgacgacgacgacgacaactgcaacaacgacgaggacgaggtgagagtgatcgagttcaagaagaagcacgaggaggtgagccagttcaaggaggagggcgacgccagcgaggacagccccctgagcagcgccagcagccaggccgtgacccccgacgagcagcccaccctgggcaagaagagcgacatcagcagaaacgcctacagcagatacaacaccatcagctacagaaagatcagaaagggcaacaccaagcagagaatcgacgagttcgagagcatgatgcacctgtag

SEQ ID NO: 11501 - DNA, 1074 bp, Artificial Sequence
  Description of Artificial Sequence: Synthetic coding sequence
atggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgacccagaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcatccccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacggcggctacgccgcctacagatacgcccagcccgccaccgccaccgccgccaccgccgccgccgccgccgccgccgcctacagcgacggctacggcagagtgtacaccgccgacccctaccacgccctggcccccgccgccagctacggcgtgggcgccgtggccagcctgtacagaggcggctacagcagattcgccccctactag

SEQ ID NO: 11502 - DNA, 387 bp, Artificial Sequence
  Description of Artificial Sequence: Synthetic coding sequence
atggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggcttcggcaagatcctggacgtggagatcatcttcaacgagagaggcagctag

SEQ ID NO: 11503 - DNA, 1071 bp, Artificial Sequence
  Description of Artificial Sequence: Synthetic coding sequence
atgcagggcatcctgctgctggtgttcgccaagtaccagcacctgccctacatccagatcctgagcaccaagagcacccccaccggcctgttcggctactggggcaacaagggcggcgtgaacatctgcctgaagctgtacggctactacgtgagcatcatcaactgccacctgcccccccacatcagcaacaactaccagagactggagcacttcgacagaatcctggagatgcagaactgcgagggcagagacatccccaacatcctggaccacgacctgatcatctggttcggcgacatgaacttcagaatcgaggacttcggcctgcacttcgtgagagagagcatcaagaacagatgctacggcggcctgtgggagaaggaccagctgagcatcgccaagaagcacgaccccctgctgagagagttccaggagggcagactgctgttcccccccacctacaagttcgacagaaacagcaacgactacgacaccagcgagaagaagagaaagcccgcctggaccgacagaatcctgtggagactgaagagacagccctgcgccggccccgacacccccatcccccccgccagccacttcagcctgagcctgagaggctacagcagccacatgacctacggcatcagcgaccacaagcccgtgagcggcaccttcgacctggagctgaagcccctggtgagcgcccccctgatcgtgctgatgcccgaggacctgtggaccgtggagaacgacatgatggtgagctacagcagcaccagcgacttccccagcagcccctgggactggatcggcctgtacaaggtgggcctgagagacgtgaacgactacgtgagctacgcctgggtgggcgacagcaaggtgagctgcagcgacaacctgaaccaggtgtacatcgacatcagcaacatccccaccaccgaggacgagttcctgctgtgctactacagcaacagcctgagaagcgtggtgggcatcagcagacccttccagatcccccccggcagcctgagagaggaccccctgggcgaggcccagccccagatctag

SEQ ID NO: 11504 - DNA, 1752 bp, Artificial Sequence; identical to SEQ ID NO: 10452
  Description of Artificial Sequence: Synthetic coding sequence

SEQ ID NO: 11505 - DNA, 1329 bp, Artificial Sequence
  Description of Artificial Sequence: Synthetic coding sequence
atggccaacagcttcgccgccagaatcttcaccaccctgagcgacctgcagaccaacatggccaacctgaaggtgatcggcatcgtgatcggcaagaccgacgtgaagggcttccccgacagaaagaacatcggcagcgagagatacaccttcagcttcaccatcagagacagccccgcccacttcgtgaacgccgccagctggggcaacgaggactacatcaagagcctgagcgacagcttcagagtgggcgactgcgtgatcatcgagaaccccctgatccagagaaaggagatcgagagagaggagaagttcagccccgccacccccagcaactgcaagctgctgctgagcgagaaccacagcaccgtgaaggtgtgcagcagctacgaggtggacaccaagctgctgagcctgatccacctgcccgtgaaggagagccacgactactacagcctgggcgacatcgtggccaacggccacagcctgaacggcagaatcatcaacgtgctggccgccgtgaagagcgtgggcgagcccaagtacttcaccaccagcgacagaagaaagggccagagatgcgaggtgagactgtacgacgagaccgagagcagcttcgccatgacctgctgggacaacgagagcatcctgctggcccagagctggatgcccagagagaccgtgatcttcgccagcgacgtgagaatcaacttcgacaagttcagaaactgcatgaccgccaccgtgatcagcaagaccatcatcaccaccaaccccgacatccccgaggccaacatcctgctgaacttcatcagagagaacaaggagaccaacgtgctggacgacgagatcgacagctacttcaaggagagcatcaacctgagcaccatcgtggacgtgtacaccgtggagcagctgaagggcaaggccctgaagaacgagggcaaggccgaccccagctacggcatcctgtacgcctacatcagcaccctgaacatcgacgacgagaccaccaaggtggtgagaaacagatgcagcagctgcggctacatcgtgaacgaggccagcaacatgtgcaccacctgcaacaagaacagcctggacttcaagagcgtgttcctgagcttccacgtgctgatcgacctgaccgaccacaccggcaccctgcacagctgcagcctgaccggcagcgtggccgaggagaccctgggctgcaccttcgtgctgagccacagagccagaagcggcctgaagatcagcgtgctgagctgcaagctggccgaccccaccgaggccagcagaaacctgagcggccagaagcacgtgtag

SEQ ID NO: 11506 - DNA, 627 bp, Artificial Sequence
  Description of Artificial Sequence: Synthetic coding sequence
atggccggcaccgccagacacgacagagagatggccatccaggccaagaagaagctgaccaccgccaccgaccccatcgagagactgagactgcagtgcctggccagaggcagcgccggcatcaagggcctgggcagagtgttcagaatcatggacgacgacaacaacagaaccctggacttcaaggagttcatgaagggcctgaacgactacgccgtggtgatggagaaggaggaggtggaggagctgttcagaagattcgacaaggacggcaacggcaccatcgacttcaacgagttcctgctgaccctgagaccccccatgagcagagccagaaaggaggtgatcatgcaggccttcagaaagctggacaagaccggcgacggcgtgatcaccatcgaggacctgagagaggtgtacaacgccaagcaccaccccaagtaccagaacggcgagtggagcgaggagcaggtgttcagaaagttcctggacaacttcgacagcccctacgacaaggacggcctggtgacccccgaggagttcatgaactactacgccggcgtgagcgccagcatcgacaccgacgtgtacttcatcatcatgatgagaaccgcctggaagctgtag

SEQ ID NO: 11507 - DNA, 627 bp, Artificial Sequence; identical to SEQ ID NO: 11506
  Description of Artificial Sequence: Synthetic coding sequence

SEQ ID NO: 11508 - DNA, 789 bp, Artificial Sequence
  Description of Artificial Sequence: Synthetic coding sequence
cacagctacagcgagggcctgggccaccccagagtgagccaggccctggtgaccttccaccagcagaagcccatcgagcccagaagagagctgctgacccagccctgcagacagaaggaccccgccaacgtggactacgaggacctgttcctgtacagcaacgccgtggccgaggaggccgcctgccccgtgagcgcccccgaggaggccagccccaagcccgtgctgtgccaccagagcaaggagagaaagcccagcgccgagatgaacagaatcaccaccaaggaggccaccagcagctgcccccccaagagccccctgggcgagaccagacagaagctgtggagaagcctgaagatgctgcccgagagaggccagagagtgagacagcagaagagccacctggccaccgtgaacctgagcagcctgctggacgtgagaagaagcaccgtgatcagcggccccggcaccggcaagggcagccaggaccacagcggcgaccccaccagcggcgacagaggctacaccgacccctgcgtggccaccagcctgaagagccccagccagccccaggcccccaaggacagaaaggtgcccaccagaaaggccgagagaagcgtgagctgcatcgaggtgacccccggcgacagaagctggcaccagatggtggtgagagccctgagcagccaggagagcaagcccgagcaccagggcctggccgagcccgagaacgaccagctgcccgaggagtaccagcagcccccccccttcgcccccggctactgctag

SEQ ID NO: 11509 - DNA, 1941 bp, Artificial Sequence
  Description of Artificial Sequence: Synthetic coding sequence
atgagctacaccggcttcgtgcagggcagcgagaccaccctgcagagcacctacagcgacaccagcgcccagcccacctgcgactacggctacggcacctggaacagcggcaccaacagaggctacgagggctacggctacggctacggctacggccaggacaacaccaccaactacggctacggcatggccaccagccacagctgggagatgcccagcagcgacaccaacgccaacaccagcgccagcggcagcgccagcgccgacagcgtgctgagcagaatcaaccagagactggacatggtgccccacctggagaccgacatgatgcagggcggcgtgtacggcagcggcggcgagagatacgacagctacgagagctgcgacagcagagccgtgctgagcgagagagacctgtacagaagcggctacgactacagcgagctggaccccgagatggagatggcctacgagggccagtacgacgcctacagagaccagttcagaatgagaggcaacgacaccttcggccccagagcccagggctgggccagagacgccagaagcggcagacccatggccagcggctacggcagaatgtgggaggaccccatgggcgccagaggccagtgcatgagcggcgccagcagactgcccagcctgttcagccagaacatcatccccgagtacggcatgttccagggcatgagaggcggcggcgccttccccggcggcagcagattcggcttcggcttcggcaacggcatgaagcagatgagaagaacctggaagacctggaccaccgccgacttcagaaccaagaagaagaagagaaagcagggcggcagccccgacgagcccgacagcaaggccaccagaaccgactgcagcgacaacagcgacagcgacaacgacgagggcaccgagggcgaggccaccgagggcctggagggcaccgaggccgtggagaagggcagcagagtggacggcgaggacgaggagggcaaggaggacggcagagaggagggcaaggaggaccccgagaagggcgccctgaccacccaggacgagaacggccagaccaagagaaagctgcaggccggcaagaagagccaggacaagcagaagaagagacagagagacagaatggtggagagaatccagttcgtgtgcagcctgtgcaagtacagaaccttctacgaggacgagatggccagccacctggacagcaagttccacaaggagcacttcaagtacgtgggcaccaagctgcccaagcagaccgccgacttcctgcaggagtacgtgaccaacaagaccaagaagaccgaggagctgagaaagaccgtggaggacctggacggcctgatccaccagatctacagagaccaggacctgacccaggagatcgccatggagcacttcgtgaagaaggtggaggccgcccactgcgccgcctgcgacctgttcatccccatgcagttcggcatcatccagaagcacctgaagaccatggaccacaacagaaacagaagactgatgatggagcagagcaagaagagcagcctgatggtggccagaagcatcctgaacaacaagctgatcagcaagaagctggagagatacctgaagggcgagaaccccttcaccgacagccccgaggaggagaaggagcaggaggaggccgagggcggcgccctggacgagggcgcccagggcgaggccgccggcatcagcgagggcgccgagggcgtgcccgcccagccccccgtgccccccgagcccgcccccggcgccgtgagccccccccccccccccccccccgaggaggaggaggagggcgccgtgcccctgctgggcggcgccctgcagagacagatcagaggcatccccggcctggacgtggaggacgacgaggagggcggcggcggcgccccctag

SEQ ID NO: 11510 - DNA, 1401 bp, Artificial Sequence
  Description of Artificial Sequence: Synthetic coding sequence
atgagaggccccaacagcggcaccgagaagggcagactggtgatccccgagaagcagggcttcgacttcctgtgcatgcccgtgttccaccccagattcaagagagagttcatccaggagcccgccaagaacagacccggcccccagaccagaagcgacctgctgctgagcggcagagactggaacaccctgatcgtgggcaagctgagcccctggatcagacccgacagcaaggtggagaagatcagaagaaacagcgaggccctggaggtgcagttcatcatcaccggcaccaaccaccacagcgagaaggagttctgcagctacctgcagtacctggagtacctgagccagaacagacccccccccaacgcctacgagctgttcgccaagggctacgaggactacctgcagagccccctgcagcccctgatggacaacctggagagccagacctacgaggtgttcgagaaggaccccatcaagtacagccagtaccagcaggccatctacaagtgcctgctggacagagtgcccgaggaggagaaggacaccaacgtgcaggtgctgatggtgctgggcgccggcagaggccccctggtgaacgccagcctgagagccgccaagcaggccgacagaagaatcaagctgtacgccgtggagaagaaccccaacgccgtggtgaccctggagaactggcagttcgaggagtggggcagccaggtgaccgtggtgagcagcgacatgagagagtgggtggcccccgagaaggccgacatcatcgtgagcgagctgctgggcagcttcgccgacaacgagctgagccccgagtgcctggacggcgcccagcacttcctgaaggacgacggcgtgagcatccccggcgagtacaccagcttcctggcccccatcagcagcagcaagctgtacaacgaggtgagagcctgcagagagaaggacagagaccccgaggcccagttcgagatgccctacgtggtgagactgcacaacttccaccagctgagcgccccccagccctgcttcaccttcagccaccccaacagagaccccatgatcgacaacaacagatactgcaccctggagttccccgtggaggtgaacaccgtgctgcacggcttcgccggctacttcgagaccgtgctgtaccaggacatcaccctgagcatcagacccgagacccacagccccggcatgttcagctggttccccatcctgttccccatcaagcagcccatcaccgtgagagagggccagaccatctgcgtgagattctggagatgcagcaacagcaagaaggtgtggtacgagtgggccgtgaccgcccccgtgtgcagcgccatccacaaccccaccggcagaagctacaccatcggcctgtag

SEQ ID NO: 11511 - DNA, 1863 bp, Artificial Sequence
  Description of Artificial Sequence: Synthetic coding sequence
atgagaggccccaacagcggcaccgagaagggcagactggtgatccccgagaagcagggcttcgacttcctgtgcatgcccgtgttccaccccagattcaagagagagttcatccaggagcccgccaagaacagacccggcccccagaccagaagcgacctgctgctgagcggcagagactggaacaccctgatcgtgggcaagctgagcccctggatcagacccgacagcaaggtggagaagatcagaagaaacagcgaggccgccatgctgcaggagctgaacttcggcgcctacctgggcctgcccgccttcctgctgcccctgaaccaggaggacaacaccaacctggccagagtgctgaccaaccacatccacaccggccaccacagcagcatgttctggatgagagtgcccctggtggcccccgaggacctgagagacgacatcatcgagaacgcccccaccacccacaccgaggagtacagcggcgaggagaagacctggatgtggtggcacaacttcagaaccctgtgcgactacagcaagagaatcgccgtggccctggagatcggcgccgacctgcccagcaaccacgtgatcgacagatggctgggcgagcccatcaaggccgccatcctgcccaccagcatcttcctgaccaacaagaagggcttccccgtgctgagcaagatgcaccagagactgatcttcagactgctgaagctggaggtgcagttcatcatcaccggcaccaaccaccacagcgagaaggagttctgcagctacctgcagtacctggagtacctgagccagaacagacccccccccaacgcctacgagctgttcgccaagggctacgaggactacctgcagagccccctgcagcccctgatggacaacctggagagccagacctacgaggtgttcgagaaggaccccatcaagtacagccagtaccagcaggccatctacaagtgcctgctggacagagtgcccgaggaggagaaggacaccaacgtgcaggtgctgatggtgctgggcgccggcagaggccccctggtgaacgccagcctgagagccgccaagcaggccgacagaagaatcaagctgtacgccgtggagaagaaccccaacgccgtggtgaccctggagaactggcagttcgaggagtggggcagccaggtgaccgtggtgagcagcgacatgagagagtgggtggcccccgagaaggccgacatcatcgtgagcgagctgctgggcagcttcgccgacaacgagctgagccccgagtgcctggacggcgcccagcacttcctgaaggacgacggcgtgagcatccccggcgagtacaccagcttcctggcccccatcagcagcagcaagctgtacaacgaggtgagagcctgcagagagaaggacagagaccccgaggcccagttcgagatgccctacgtggtgagactgcacaacttccaccagctgagcgccccccagccctgcttcaccttcagccaccccaacagagaccccatgatcgacaacaacagatactgcaccctggagttccccgtggaggtgaacaccgtgctgcacggcttcgccggctacttcgagaccgtgctgtaccaggacatcaccctgagcatcagacccgagacccacagccccggcatgttcagctggttccccatcctgttccccatcaagcagcccatcaccgtgagagagggccagaccatctgcgtgagattctggagatgcagcaacagcaagaaggtgtggtacgagtgggccgtgaccgcccccgtgtgcagcgccatccacaaccccaccggcagaagctacaccatcggcctgtag

SEQ ID NO: 11512 - DNA, 2271 bp, Artificial Sequence
  Description of Artificial Sequence: Synthetic coding sequence
atgcccagcgtgagcaaggccgccgccgccgccctgagcggcagccccccccagaccgagaagcccacccactacagatacctgaaggagttcagaaccgagcagtgccccctgttcagccagcacaagtgcgcccagcacagacccttcacctgcttccactggcacttcctgaaccagagaagaagaagacccctgagaagaagagacggcaccttcaactacagccccgacgtgtactgcagcaagtacaacgaggccaccggcgtgtgccccgacggcgacgagagcctgctgggcgtgctgtaccccctgtgggcccccccccccgtgcccgcccccgtgggcgcccccaccgtgcaccccttcctggccagatggttcagccacgtgccctgggagcccgccggcagcgccgaccccagagccagcagcacccccgccggcggcaccacctgggccaccggcctgctgggcgacttcgacgcctgcggcagccagagcagagagtgcgtgaagggcgtgtggtggaccctgctgggcttcagatgcccctacctgcacagaaccaccggcgacaccgagagaaagtaccacctgagatactacaagaccggcacctgcatccacgagaccgacgccagaggccactgcgtgaagaacggcctgcactgcgccttcgcccacggccccctggacctgagaccccccgtgtgcgacgtgagagagctgcaggcccaggaggccctgcagaacggccagctgggcggcggcgagggcgtgcccgacctgcagcccggcgtgctggccagccaggccatgatcgagaagatcctgagcgaggaccccagatggcaggccctgctgcccgtggccctgctgagacacagagtggcccacttcagcgacgccaacttcgtgctgggcagctacaagaccgagcagtgccccaagccccccagactgtgcagacagggctacgcctgcccccactaccacaacagcagagacagaagaagaaaccccagaagattccagtacagaagcaccccctgccccagcgtgaagcacggcgacgagtggggcgagcccagcagatgcgacggcggcgacggctgccagtactgccacagcagaaccgagcagcagttccaccccgagggccccgtgggcagccccgtgagcggcgccttcagcgtgttcagccacgccggcctggtggccgaccccagcctgtggtaccccgccgagtggagctggcaccacgtgggccacagcagaaccatcaaccccgagggcgacaagcccagcagactgggccccgcccccgagaacatcaagagaggcaacgacttcgcctgcgacggcagagccgacgccgccggcatggccccccacgtgtgcgtgttccccatctacaagagcaccaagtgcaacgacatgagacagaccggctactgccccagaggccccttctgcgccttcgcccacgtggagaagagcctgggcatggtgaacgagtggggctgccacgacctgcacctgaccagccccagcagcaccggcagcggccagcccggcaacgccaagagaagagacagccccgccgagggcggccccagaggcagcgagcaggacagcaagcagggcgtgagagcccacggcgtgtacgtgttcgagcagaaccacctggccgtgttcgccgccgtgcacccccccgcccccagcgtgagcagcagcgtggccagcagcctggccagcagcgccggcagcggcagcagcagccccaccgccctgcccgccccccccgccagagccctgcccctgggccccgccagcagcaccgtggaggccgtgctggccctggagcccacccccagcagccccaccagcagcgccgtgcagggcgtggccggcgagctgggcatgggcagcggcggccagggctgctggagccacgtggtgggcgccctggccgccgtgcccgcctggacccacagcggcgacctggagtgggaccccagcaccatcagaaccagagtgaacgtgggcggcggccccgccgccagacccgccatgaccctggccagagagccccagctgctggtggtgggcggctgccccaccagaaactgcagcggccccgccgccagcccccagcagctgctggacgacgccggccagggcggcagaggcgagagagacagcagccagagacccctgagaccccagaccacccacagacaggacaccagacccgtgcccagctag

SEQ ID NO: 11513 - DNA, 549 bp, Artificial Sequence
  Description of Artificial Sequence: Synthetic coding sequence
atgacccccccccagcagcccccccccctgagaagcgagcccggcaccctgggcagcgccgccagcagctacagccccctgggcctgaacggcgtgcccggcagcatctgggacttcgtgagcggcagcttcagccccagccccagccccatcctgagcgccggcccccccagcagcagcagcgccagccccaacggcgccgagctggccagagtgagaagacagctggacgaggccaagagaaagatcagacagtgggaggagagctggcagcaggtgaagcaggtgtgcgacgcctggcagagagaggcccaggaggccaaggagagagccagagtggccgacagcgacagacagctggccctgcagaagaaggaggaggtggaggcccaggtgatcttccagctgagagccaagcagtgcgtggcctgcagagagagagcccacggcgccgtgctgagaccctgccagcaccacatcctgtgcgagccctgcgccgccaccgcccccgagtgcccctactgcaagggccagcccctgcagtggtag

SEQ ID NO: 11514 - DNA, 444 bp, Artificial Sequence
  Description of Artificial Sequence: Synthetic coding sequence
atggagggcgagcccccccccgtggaggagagaagaagactgcaggaggagctgaacgagttcgtggagagcggctgcagaaccctggaggaggtgaccgccagcctgggctgggacctggacagcctggaccccggcgaggaggaggccgccgaggacgaggtggtgatctgcccctacgacagcaaccaccacatgcccaagagcagcctggccaagcacatggccagctgcagactgagaaagatgggctacaccaaggaggaggaggacgagatgtacaaccccgagttcttctacgagaacgtgaagatccccagcatcaccctgaacaaggacagccagttccagatcatcaagcaggccagaaccgccgtgggcaaggacagcgactgctacaaccagatcatcggcgtgagcatcaagagaaactacaagatctag

SEQ ID NO: 11515 - DNA, 522 bp, Artificial Sequence
  Description of Artificial Sequence: Synthetic coding sequence
atgggcaccttcgacctgtggaccgactacctgggcctggcccacctggtgagagccctgagcggcaaggagggccccgagaccagactgagcccccagcccgagcccgagcccatgctggagcccgaccagaagagaagcctggagagcagccccgcccccgagagactgtgcagcttctgcaagcacaacggcgagagcagagccatctaccagagccacgtgctgaaggacgaggccggcagagtgctgtgccccatcctgagagactacgtgtgcccccagtgcggcgccaccagagagagagcccacaccagaagattctgccccctgaccggccagggctacaccagcgtgtacagccacaccaccagaaacagcgccggcaagaagctggtgagacccgacaaggccaagacccaggacaccggccacagaagaggcggcggcggcggcgccggcttcagaggcgccggcaagagcgagcccagccccagctgcagccccagcatgagcacctag

SEQ ID NO: 11516 - DNA, 1722 bp, Artificial Sequence
  Description of Artificial Sequence: Synthetic coding sequence
atgagcgccttctgcctgggcctggtgggcagagccagcgcccccgccgagcccgacagcgcctgctgcatggagctgcccgccgccgccggcgacgccgtgagaagccccgccgccgccgccgccctgatcttccccggcggcagcggcgagctggagctggccctggaggaggagctggccctgctggccgccggcgagagacccagcgaccccggcgagcacccccaggccgagcccggcagcctggccgagggcgccggcccccagcccccccccagccaggaccccgagctgctgagcgtgatcagacagaaggagaaggacctggtgctggccgccagactgggcaaggccctgctggagagaaaccaggacatgagcagacagtacgagcagatgcacaaggagctgaccgacaagctggagcacctggagcaggagaagcacgagctgagaagaagattcgagaacagagagggcgagtgggagggcagagtgagcgagctggagagcgacgtgaagcagctgcaggacgagctggagagacagcagatccacctgagagaggccgacagagagaagagcagagccgtgcaggagctgagcgagcagaaccagagactgctggaccagctgagcagagccagcgaggtggagagacagctgagcatgcaggtgcacgccctgagagaggacttcagagagaagaacagcagcaccaaccagcacatcatcagactggagagcctgcaggccgagatcaagatgctgagcgacagaaagagagagctggagcacagactgagcgccaccctggaggagaacgacctgctgcagggcaccgtggaggagctgcaggacagagtgctgatcctggagagacagggccacgacaaggacctgcagctgcaccagagccagctggagctgcaggaggtgagactgagctgcagacagctgcaggtgaaggtggaggagctgaccgaggagagaagcctgcagagcagcgccgccaccagcaccagcctgctgagcgagatcgagcagagcatggaggccgaggagctggagcaggagagagagcagctgagactgcagctgtgggaggcctactgccaggtgagatacctgtgcagccacctgagaggcaacgacagcgccgacagcgccgtgagcaccgacagcagcatggacgagagcagcgagaccagcagcgccaaggacgtgcccgccggcagcctgagaaccgccctgaacgagctgaagagactgatccagagcatcgtggacggcatggagcccaccgtgaccctgctgagcgtggagatgaccgccctgaaggaggagagagacagactgagagtgaccagcgaggacaaggagcccaaggagcagctgcagaaggccatcagagacagagacgaggccatcgccaagaagaacgccgtggagctggagctggccaagtgcagaatggacatgatgagcctgaacagccagctgctggacgccatccagcagaagctgaacctgagccagcagctggaggcctggcaggacgacatgcacagagtgatcgacagacagctgatggacacccacctgaaggagagaagccagcccgccgccgccctgtgcagaggccacagcgccggcagaggcgacgagcccagcatcgccgagggcaagagactgttcagcttcttcagaaagatctag

SEQ ID NO: 11517 - DNA, 1086 bp, Artificial Sequence; identical to SEQ ID NO: 10271
  Description of Artificial Sequence: Synthetic coding sequence

SEQ ID NO: 11518 - DNA, 3099 bp, Artificial Sequence
  Description of Artificial Sequence: Synthetic coding sequence
atggccttcaccaactacagcagcctgaacagagcccagctgaccttcgagtacctgcacaccaacagcaccacccacgagttcctgttcggcgccctggccgagctggtggacaacgccagagacgccgacgccaccagaatcgacatctacgccgagagaagagaggacctgagaggcggcttcatgctgtgcttcctggacgacggcgccggcatggaccccagcgacgccgccagcgtgatccagttcggcaagagcgccaagagaacccccgagagcacccagatcggccagtacggcaacggcctgaagagcggcagcatgagaatcggcaaggacttcatcctgttcaccaagaaggaggacaccatgacctgcctgttcctgagcagaaccttccacgaggaggagggcatcgacgaggtgatcgtgcccctgcccacctggaacgccagaaccagagagcccgtgaccgacaacgtggagaagttcgccatcgagaccgagctgatctacaagtacagccccttcagaaccgaggaggaggtgatgacccagttcatgaagatccccggcgacagcggcaccctggtgatcatcttcaacctgaagctgatggacaacggcgagcccgagctggacatcatcagcaaccccagagacatccagatggccgagaccagccccgagggcaccaagcccgagagaagaagcttcagagcctacgccgccgtgctgtacatcgaccccagaatgagaatcttcatccacggccacaaggtgcagaccaagagactgagctgctgcctgtacaagcccagaatgtacaagtacaccagcagcagattcaagaccagagccgagcaggaggtgaagaaggccgagcacgtggccagaatcgccgaggagaaggccagagaggccgagagcaaggccagaaccctggaggtgagactgggcggcgacctgaccagagacagcagagtgatgctgagacaggtgcagaacagagccatcaccctgagaagagaggccgacgtgaagaagagaatcaaggaggccaagcagagagccctgaaggagcccaaggagctgaacttcgtgttcggcgtgaacatcgagcacagagacctggacggcatgttcatctacaactgcagcagactgatcaagatgtacgagaaggtgggcccccagctggagggcggcatggcctgcggcggcgtggtgggcgtggtggacgtgccctacctggtgctggagcccacccacaacaagcaggacttcgccgacgccaaggagtacagacacctgctgagagccatgggcgagcacctggcccagtactggaaggacatcgccatcgcccagagaggcatcatcaagttctgggacgagttcggctacctgagcgccaactggaaccagccccccagcagcgagctgagatacaagagaagaagagccatggagatccccaccaccatccagtgcgacctgtgcctgaagtggagaaccctgcccttccagctgagcagcgtggagaaggactaccccgacacctgggtgtgcagcatgaaccccgaccccgagcaggacagatgcgaggccagcgagcagaagcagaaggtgcccctgggcaccttcagaaaggacatgaagacccaggaggagaagcagaagcagctgaccgagaagatcagacagcagcaggagaagctggaggccctgcagaagaccacccccatcagaagccaggccgacctgaagaagctgcccctggaggtgaccaccagacccagcaccgaggagcccgtgagaagaccccagagacccagaagcccccccctgcccgccgtgatcagaaacgcccccagcagaccccccagcctgcccacccccagacccgccagccagcccagaaaggcccccgtgatcagcagcacccccaagctgcccgccctggccgccagagaggaggccagcaccagcagactgctgcagccccccgaggcccccagaaagcccgccaacaccctggtgaagaccgccagcagacccgcccccctggtgcagcagctgagccccagcctgctgcccaacagcaagagccccagagaggtgcccagccccaaggtgatcaagacccccgtggtgaagaagaccgagagccccatcaagctgagccccgccacccccagcagaaagagaagcgtggccgtgagcgacgaggaggaggtggaggaggaggccgagagaagaaaggagagatgcaagagaggcagattcgtggtgaaggaggagaagaaggacagcaacgagctgagcgacagcgccggcgaggaggacagcgccgacctgaagagagcccagaaggacaagggcctgcacgtggaggtgagagtgaacagagagtggtacaccggcagagtgaccgccgtggaggtgggcaagcacgtggtgagatggaaggtgaagttcgactacgtgcccaccgacaccacccccagagacagatgggtggagaagggcagcgaggacgtgagactgatgaagccccccagccccgagcaccagagcctggacacccagcaggagggcggcgaggaggaggtgggccccgtggcccagcaggccatcgccgtggccgagcccagcaccagcgagtgcctgagaatcgagcccgacaccaccgccctgagcaccaaccacgagaccatcgacctgctggtgcagatcctgagaaactgcctgagatacttcctgccccccagcttccccatcagcaagaagcagctgagcgccatgaacagcgacgagctgatcagcttccccctgaaggagtacttcaagcagtacgaggtgggcctgcagaacctgtgcaacagctaccagagcagagccgacagcagagccaaggccagcgaggagagcctgagaaccagcgagagaaagctgagagagaccgaggagaagctgcagaagctgagaaccaacatcgtggccctgctgcagaaggtgcaggaggacatcgacatcaacaccgacgacgagctggacgcctacatcgaggacctgatcaccaagggcgactag

SEQ ID NO: 11519 - DNA, 5943 bp, Artificial Sequence; identical to SEQ ID NO: 9642
  Description of Artificial Sequence: Synthetic coding sequence

SEQ ID NO: 11520 - DNA, 513 bp, Artificial Sequence; identical to SEQ ID NO: 10286
  Description of Artificial Sequence: Synthetic coding sequence

SEQ ID NO: 11521 - DNA, 291 bp, Artificial Sequence
  Description of Artificial Sequence: Synthetic coding sequence
atgtgccacaccagctgcagccccgcctgccagcccacctgctgcatccacagcccctgccaggccagctgctacgtgcccgtgagctgccagagcagcgtgtgcatgcccgtgagctgcaccagaatcgtgtgcgtggcccccagctgccagcccagcgtgtgcgtgcccgtgagctgcagacccatcatctacgtgacccccagctgccagagcagcggctgctgccagcccccctgcaccaccgccctgtgcagacccatcagctgcagcacccccagctgctgctag

SEQ ID NO: 11522 - DNA, 879 bp, Artificial Sequence
  Description of Artificial Sequence: Synthetic coding sequence
atggccgccagcaccatgagcatcagaagcagcgcctacagcgacagctggcaggtggacgactgccccgagagctgctgcgagcccccctgctgcgccaccagctgctgcgcccccgccccctgcctgaccctggtgtgcacccccgtgagcagagtgagcagcccctgctgccaggtgacctgcgagcccagcccctgccagagcggctgcaccagcagctgcacccccagctgctgccagcagagcagctgccagcccgcctactgcaccagcagcccctgccagcaggcctgctgcgtgcccgtgtgctgcaagcccgtgtgctgcgtgcccgtgtgctgcggcgccagcagctgctgccagcagagcagctaccagcccgcctgctgcgccagcagcagctgccagcccgcctgctgcgtgcccgtgtgctgcaagcccgtgtgctgcgcccccacctgcagcgaggacagctacagctgctgccagcagagcagctgccagcccgcctgctgcaccagcagcccctgccagcagagctactgcgtgcccgtgtgctgcaagcccgtgtgctgcaagcccatctgctgcgtgcccgtgtgcagcggcgccagcagcctgtgctgccagcagagcggctgccagcccgcctgctgcaccaccagctgctgcagacccagcagcagcgtgagcctgctgtgcagacccgtgtgcagacccgcctgctgcgtgcccgtgagcagctgctgcgcccccaccagcagcagacagcccagctactgcagacaggccagctgcgtgagcctgctgtgcagacccgtgtgcagcagacccgcctgctacagcttcagcagcggccagaagagcagctgctag

SEQ ID NO: 11523 - DNA, 1608 bp, Artificial Sequence
  Description of Artificial Sequence: Synthetic coding sequence
atgaagaagatcagcctgaagaccctgagaaagagcttcaacctgaacaagagcaaggaggagaccgacttcatggtggtgcagcagcccagcctggccagcgacttcggcaaggacgacagcctgttcggcagctgctacggcaaggacatggccagctgcgacatcaacggcgaggacgagaagggcggcaagaacagaagcaagagcgagagcctgatgggcaccctgaagagaagactgagcgccaagcagaagagcaagggcaaggccggcacccccagcggcagcagcgccgacgaggacaccttcagcagcagcagcgcccccatcgtgttcaaggacgtgagagcccagagacccatcagaagcaccagcctgagaagccaccactacagccccgccccctggcccctgagacccaccaacagcgaggagacctgcatcaagatggaggtgagagtgaaggccctggtgcacagcagcagccccagccccgccctgaacggcgtgagaaaggacttccacgacctgcagagcgagaccacctgccaggagcaggccaacagcctgaagagcagcgccagccacaacggcgacctgcacctgcacctggacgagcacgtgcccgtggtgatcggcctgatgccccaggactacatccagtacaccgtgcccctggacgagggcatgtaccccctggagggcagcagaagctactgcctggacagcagcagccccatggaggtgagcgccgtgcccccccaggtgggcggcagagccttccccgaggacgagagccaggtggaccaggacctggtggtggcccccgagatcttcgtggaccagagcgtgaacggcctgctgatcggcaccaccggcgtgatgctgcagagccccagagccggccacgacgacgtgccccccctgagccccctgctgccccccatgcagaacaaccagatccagagaaacttcagcggcctgaccggcaccgaggcccacgtggccgagagcatgagatgccacctgaacttcgaccccaacagcgcccccggcgtggccagagtgtacgacagcgtgcagagcagcggccccatggtggtgaccagcctgaccgaggagctgaagaagctggccaagcagggctggtactggggccccatcaccagatgggaggccgagggcaagctggccaacgtgcccgacggcagcttcctggtgagagacagcagcgacgacagatacctgctgagcctgagcttcagaagccacggcaagaccctgcacaccagaatcgagcacagcaacggcagattcagcttctacgagcagcccgacgtggagggccacaccagcatcgtggacctgatcgagcacagcatcagagacagcgagaacggcgccttctgctacagcagaagcagactgcccggcagcgccacctaccccgtgagactgaccaaccccgtgagcagattcatgcaggtgagaagcctgcagtacctgtgcagattcgtgatcagacagtacaccagaatcgacctgatccagaagctgcccctgcccaacaagatgaaggactacctgcaggagaagcactactag

SEQ ID NO: 11524 - DNA, 1260 bp, Artificial Sequence
  Description of Artificial Sequence: Synthetic coding sequence
atggccgccagcagcctggagcagaagctgagcagactggaggccaagctgaagcaggagaacagagaggccagaagaagaatcgacctgaacctggacatcagcccccagagacccagacccaccctgcagctgcccctggccaacgacggcggcagcagaagccccagcagcgagagcagcccccagcaccccaccccccccgccagacccagacacatgctgggcctgcccagcaccctgttcacccccagaagcatggagagcatcgagatcgaccagaagctgcaggagatcatgaagcagaccggctacctgaccatcggcggccagagataccaggccgagatcaacgacctggagaacctgggcgagatgggcagcggcacctgcggccaggtgtggaagatgagattcagaaagaccggccacgtgatcgccgtgaagcagatgagaagaagcggcaacaaggaggagaacaagagaatcctgatggacctggacgtggtgctgaagagccacgactgcccctacatcgtgcagtgcttcggcaccttcatcaccaacaccgacgtgttcatcgccatggagctgatgggcacctgcgccgagaagctgaagaagagaatgcagggccccatccccgagagaatcctgggcaagatgaccgtggccatcgtgaaggccctgtactacctgaaggagaagcacggcgtgatccacagagacgtgaagcccagcaacatcctgctggacgagagaggccagatcaagctgtgcgacttcggcatcagcggcagactggtggacagcaaggccaagaccagaagcgccggctgcgccgcctacatggcccccgagagaatcgacccccccgaccccaccaagcccgactacgacatcagagccgacgtgtggagcctgggcatcagcctggtggagctggccaccggccagttcccctacaagaactgcaagaccgacttcgaggtgctgaccaaggtgctgcaggaggagccccccctgctgcccggccacatgggcttcagcggcgacttccagagcttcgtgaaggactgcctgaccaaggaccacagaaagagacccaagtacaacaagctgctggagcacagcttcatcaagagatacgagaccctggaggtggacgtggccagctggttcaaggacgtgatggccaagaccgagagccccagaaccagcggcgtgctgagccagccccacctgcccttcttcagatag

SEQ ID NO: 11525 - DNA, 963 bp, Artificial Sequence; identical to SEQ ID NO: 10260
  Description of Artificial Sequence: Synthetic coding sequence

SEQ ID NO: 11526 - DNA, 1737 bp, Artificial Sequence
  Description of Artificial Sequence: Synthetic coding sequence
atggagctggagaacatcgtggccaacagcctgctgctgaaggccagacagggcggctacggcaagaagagcggcagaagcaagaagtggaaggagatcctgaccctgccccccgtgagccagtgcagcgagctgagacacagcatcgagaaggactacagcagcctgtgcgacaagcagcccatcggcagaagactgttcagacagttctgcgacaccaagcccaccctgaagagacacatcgagttcctggacgccgtggccgagtacgaggtggccgacgacgaggacagaagcgactgcggcctgagcatcctggacagattcttcaacgacaagctggccgcccccctgcccgagatcccccccgacgtggtgaccgagtgcagactgggcctgaaggaggagaaccccagcaagaaggccttcgaggagtgcaccagagtggcccacaactacctgagaggcgagcccttcgaggagtaccaggagagcagctacttcagccagttcctgcagtggaagtggctggagagacagcccgtgaccaagaacaccttcagacactacagagtgctgggcaagggcggcttcggcgaggtgtgcgcctgccaggtgagagccaccggcaagatgtacgcctgcaagaagctgcagaagaagagaatcaagaagagaaagggcgaggccatggccctgaacgagaagagaatcctggagaaggtgcagagcagattcgtggtgagcctggcctacgcctacgagaccaaggacgccctgtgcctggtgctgaccatcatgaacggcggcgacctgaagttccacatctacaacctgggcaaccccggcttcgacgagcagagagccgtgttctacgccgccgagctgtgctgcggcctggaggacctgcagagagagagaatcgtgtacagagacctgaagcccgagaacatcctgctggacgacagaggccacatcagaatcagcgacctgggcctggccaccgagatccccgagggccagagagtgagaggcagagtgggcaccgtgggctacatggcccccgaggtggtgaacaacgagaagtacaccttcagccccgactggtggggcctgggctgcctgatctacgagatgatccagggccacagccccttcaagaagtacaaggagaaggtgaagtgggaggaggtggaccagagaatcaagaacgacaccgaggagtacagcgagaagttcagcgaggacgccaagagcatctgcagaatgctgctgaccaagaaccccagcaagagactgggctgcagaggcgagggcgccgccggcgtgaagcagcaccccgtgttcaaggacatcaacttcagaagactggaggccaacatgctggagccccccttctgccccgacccccacgccgtgtactgcaaggacgtgctggacatcgagcagttcagcgtggtgaagggcatctacctggacaccgccgacgaggacttctacgccagattcgccaccggctgcgtgagcatcccctggcagaacgagatgatcgagagcggctgcttcaaggacatcaacaagagcgagagcgaggaggccctgcccctggacctggacaagaacatccacacccccgtgagcagacccaacagaggcttcttctacagactgttcagaagaggcggctgcctgaccatggtgcccagcgagaaggaggtggagcccaagcagtgctag

SEQ ID NO: 11527 - DNA, 2625 bp, Artificial Sequence
  Description of Artificial Sequence: Synthetic coding sequence
atgaaccagagaagccacctgggcaccacctacctggacaccgccaagggcgccgtggagaccttcatgaagctgagagccagagaccccgccagcagaggcgacagatacatgctggtgaccttcgaggagcccccctacgccatcaaggccggctggaaggagaaccacgccaccttcatgaacgagctgaagaacctgcaggccgagggcctgaccaccctgggccagagcctgagaaccgccttcgacctgctgaacctgaacagactggtgaccggcatcgacaactacggccagggcagaaaccccttcttcctggagcccgccatcatcatcaccatcaccgacggcagcaagctgaccaccaccagcggcgtgcaggacgagctgcacctgcccctgaacagccccctgcccggcagcgagctgaccaaggagcccttcagatgggaccagagactgttcgccctggtgctgagactgcccggcaccatgagcgtggagagcgagcagctgaccggcgtgcccctggacgacagcgccatcacccccatgtgcgaggtgaccggcggcagaagctacagcgtgtgcagccccagaatgctgaaccagtgcctggagagcctggtgcagaaggtgcagagcggcgtggtgatcaacttcgagaaggccggccccgaccccagccccgtggaggacggccagcccgacatcagcagacccttcggcagccagccctggcacagctgccacaagctgatctacgtgagacccaaccccaagaccggcgtgcccatcggccactggcccgtgcccgagagcttctggcccgaccagaacagccccaccctgccccccagaaccagccaccccgtggtgaagttcagctgcaccgactgcgagcccatggtgatcgacaagctgcccttcgacaagtacgagctggagcccagccccctgacccagttcatcctggagagaaagagcccccagacctgctggcaggtgtacgtgagcaacagcgccaagtacagcgagctgggccaccccttcggctacctgaaggccagcaccgccctgaactgcgtgaacctgttcgtgatgccctacaactaccccgtgctgctgcccctgctggacgacctgttcaaggtgcacaaggccaagcccaccctgaagtggagacagagcttcgagagctacctgaagaccatgcccccctactacctgggccccctgaagaaggccgtgagaatgatgggcgcccccaacctgatcgccgacagcatggagtacggcctgagctacagcgtgatcagctacctgaagaagctgagccagcaggccaagatcgagagcgacagagtgatcggcagcgtgggcaagaaggtggtgcaggagaccggcatcaaggtgagaagcagaagccacggcctgagcatggcctacagaaaggacttccagcagctgctgcagggcatcagcgaggacgtgccccacagactgctggacctgaacatgaaggagtacaccggcttccaggtggccctgctgaacaaggacctgaagccccagaccttcagaaacgcctacgacatccccagaagaaacctgctggaccacctgaccagaatgagaagcaacctgctgaagagcaccagaagattcctgaagggccaggacgaggaccaggtgcacagcgtgcccatcgcccagatgggcaactaccaggagtacctgaagcaggtgcccagccccctgagagagctggaccccgaccagcccagaagactgcacaccttcggcaaccccttcaagctggacaagaagggcatgatgatcgacgaggccgacgagttcgtggccggcccccagaacaagcacaagagacccggcgagcccaacatgcagggcatccccaagagaagaagatgcatgagccccctgctgagaggcagacagcagaaccccgtggtgaacaaccacatcggcggcaagggcccccccgcccccaccacccaggcccagcccgacctgatcaagcccctgcccctgcacaagatcagcgagaccaccaacgacagcatcatccacgacgtggtggagaaccacgtggccgaccagctgagcagcgacatcacccccaacgccatggacaccgagttcagcgccagcagccccgccagcctgctggagagacccaccaaccacatggaggccctgggccacgaccacctgggcaccaacgacctgaccgtgggcggcttcctggagaaccacgaggagcccagagacaaggagcagtgcgccgaggagaacatccccgccagcagcctgaacaagggcaagaagctgatgcactgcagaagccacgaggaggtgaacaccgagctgaaggcccagatcatgaaggagatcagaaagcccggcagaaagtacgagagaatcttcaccctgctgaagcacgtgcagggcagcctgcagaccagactgatcttcctgcagaacgtgatcaaggaggccagcagattcaagaagagaatgctgatcgagcagctggagaacttcctggacgagatccacagaagagccaaccagatcaaccacatcaacagcaactag

SEQ ID NO: 11528 - DNA, 2340 bp, Artificial Sequence
  Description of Artificial Sequence: Synthetic coding sequence
atggccgactacagcaacaagctgtactaccagctggagcaggagaccggcatccagaccggctacaccagaaccggcagcatcttcctggcccagacccaggacagactgatcagcctgaagagaatcaacgccggcctgaacgtgatcggcatccccagcgagatcatcagccccaagaaggtggccgagctgcaccacctgctgaacgtgcacgacctggtgggcgccatgcacgtgcccgaggacgccgtggtgagcagcgccgacgtggccctggccctggccagcgccgccagccagaacggcgtgcagatctacgacagaaccagcgtgctgcacgtgatggtgaagaagggccaggtgaccggcgtggagaccgacaagggccagatcgagtgccagtacttcgtgaactgcgccggccagtgggcctacgagctgggcctgagcaacgaggagcccgtgagcatccccctgcacgcctgcgagcacttctacctgctgaccagacccctggagacccccctgcagagcagcacccccaccatcgtggacgccgacggcagaatctacatcagaaactggcagggcggcatcctgagcggcggcttcgagaagaaccccaagcccatcttcaccgagggcaagaaccagctggagatccagaacctgcaggaggactgggaccacttcgagcccctgctgagcagcctgctgagaagaatgcccgagctggagaccctggagatcatgaagctggtgaactgccccgagaccttcacccccgacatgagatgcatcatgggcgagagccccgccgtgcagggctacttcgtgctggccggcatgaacagcgccggcctgagcttcggcggcggcgccggcaagtacctggccgagtggatggtgcacggctaccccagcgagaacgtgtgggagctggacctgaagagattcggcgccctgcagagcagcagaaccttcctgagacacagagtgatggaggtgatgcccctgatgtacgacctgaaggtgcccagatgggacttccagaccggcagacagctgagaaccagccccctgtacgacagactggacgcccagggcgccagatggatggagaagcacggcttcgagagacccaagtacttcgtgccccccgacaaggacctgctggccctggagcagagcaagaccttctacaagcccgactggttcgacatcgtggagagcgaggtgaagtgctgcaaggaggccgtgtgcgtgatcgacatgagcagcttcaccaagttcgagatcaccagcaccggcgaccaggccctggaggtgctgcagtacctgttcagcaacgacctggacgtgcccgtgggccacatcgtgcacaccggcatgctgaacgagggcggcggctacgagaacgactgcagcatcgccagactgaacaagagaagcttcttcatgatcagccccaccgaccagcaggtgcactgctgggcctggctgaagaagcacatgcccaaggacagcaacctgctgctggaggacgtgacctggaagtacaccgccctgaacctgatcggccccagagccgtggacgtgctgagcgagctgagctacgcccccatgacccccgaccacttccccagcctgttctgcaaggagatgagcgtgggctacgccaacggcatcagagtgatgagcatgacccacaccggcgagcccggcttcatgctgtacatccccatcgagtacgccctgcacgtgtacaacgaggtgatgagcgtgggccagaagtacggcatcagaaacgccggctactacgccctgagaagcctgagaatcgagaagttcttcgccttctggggccaggacatcaacaacctgaccacccccctggagtgcggcagagagagcagagtgaagctggagaagggcatggacttcatcggcagagacgccctgctgcagcagaagcagaacggcgtgtacaagagactgaccatgttcatcctggacgaccacgacagcgacctggacctgtggccctggtggggcgagcccatctacagaaacggccagtacgtgggcaagaccaccagcagcgcctacagctacagcctggagagacacgtgtgcctgggcttcgtgcacaacttcagcgaggacaccggcgaggagcaggtggtgaccgccgacttcatcaacagaggcgagtacgagatcgacatcgccggctacagattccaggccaaggccaagctgtaccccgtggccagcctgttcacccagaagagaagaaaggacgacatggagctgagcgacctgcacggcaagtag

SEQ ID NO: 11529 - DNA, 1191 bp, Artificial Sequence
  Description of Artificial Sequence: Synthetic coding sequence
atggccaccagagtggaggaggccgccagaggcagaggcggcggcgccgaggaggccaccgaggccggcagaggcggcagaagaagaagccccagacagaagctggaggagagcagaagcgtgcagaagcagatgaagatcctgcagaagaagcaggcccagatcgtgaaggagaaggtgcacctgcagagcgagcacagcaaggccatcctggccagaagcaagctggagagcctgtgcagagagctgcagagacacaacaagaccctgaaggaggagaacatgcagcaggccagagaggaggaggagagaagaaaggaggccaccgcccacttccagatcaccctgaacgagatccaggcccagctggagcagcacgacatccacaacgccaagctgagacaggagaacatcgagctgggcgagaagctgaagaagctgatcgagcagtacgccctgagagaggagcacatcgacaaggtgttcaagcacaaggagctgcagcagcagctggtggacgccaagctgcagcagaccacccagctgatcaaggaggccgacgagaagcaccagagagagagagagttcctgctgaaggaggccaccgagagcagacacaagtacgagcagatgaagcagcaggaggtgcagctgaagcagcagctgagcctgtacatggacaagttcgaggagttccagaccaccatggccaagagcaacgagctgttcaccaccttcagacaggagatggagaagatgaccaagaagatcaagaagctggagaaggagaccatcatctggagaaccaagtgggagaacaacaacaaggccctgctgcagatggccgaggagaagaccgtgagagacaaggagtacaaggccctgcagatcaagctggagagactggagaagctgtgcagagccctgcagaccgagagaaacgagctgaacgagaaggtggaggtgctgaaggagcaggtgagcatcaaggccgccatcaaggccgccaacagagacctggccacccccgtgatgcagccctgcaccgccctggacagccacaaggagctgaacaccagcagcaagagagccctgggcgcccacctggaggccgagcccaagagccagagaagcgccgtgcagaagccccccagcaccggcagcgcccccgccatcgagagcgtggactag

SEQ ID NO: 11530 - DNA, 1443 bp, Artificial Sequence; identical to SEQ ID NO: 10873
  Description of Artificial Sequence: Synthetic coding sequence

SEQ ID NO: 11531 - DNA, 3774 bp, Artificial Sequence
  Description of Artificial Sequence: Synthetic coding sequence
atggcccacttcagcagcgaggaccaggccatgctgcaggccatgctgagaagactgttccagagcgtgaaggagaagatcaccggcgcccccagcctggagtgcgccgaggagatcctgctgcacctggaggagaccgacgagaacttccacaactacgagttcgtgaagtacctgagacagcacatcggcaacaccctgggcagcatgatcgaggaggagatggagaagtgcaccagcgacagaaaccagggcgaggagtgcggctacgacaccgtggtgcagcaggtgaccaagagaacccaggagagcaaggagtacaaggagatgatgcactacctgaagaacatcatgatcgccgtggtggagagcatgatcaacaagttcgaggaggacgagaccagaaaccaggagagacagaagaagatccagaaggagaagagccacagctacagaaccgacaactgcagcgacagcgacagcagcctgaaccagagctacaagttctgccagggcaagctgcagctgatcctggaccagctggaccccggccagcccaaggaggtgagatacgaggccctgcagaccctgtgcagcgccccccccagcgacgtgctgaactgcgagaactggaccaccctgtgcgagaagctgaccgtgagcctgagcgaccccgaccccgtgttcagcgacagaatcctgaagttctgcgcccagaccttcctgctgagccccctgcacatgaccaaggagatctacaccagcctggccaagtacctggagagctacttcctgagcagagagaaccacatccccaccctgagcgccggcgtggacatcaccaaccccaacatgaccagactgctgaagaaggtgagactgctgaacgagtaccagaaggaggcccccagcttctggatcagacaccccgagaagtacatggaggagatcgtggagagcaccctgagcctgctgaccgtgaagcacaaccagagccacgtggtgagccagaagatcctggaccccatctacttcttcgccctggtggacaccaaggccgtgtggttcaagaagtggatgcacgcccactacagcagaaccaccgtgctgagactgctggagaccaagtacaagagcctggtgaccaccgccatccagcagtgcgtgcagtacttcgagatgtgcaagaccagaaaggccgacgagaccctgggccacagcaagcactgcagaaacaagcagaagaccttctactacctgggccaggagctgcagtacatctacttcatccacagcctgtgcctgctgggcagactgctgatctacaagcagggcagaaagctgttccccatcaagctgaagaacaagaagggcctggtgagcctgatcgacctgctggtgctgttcacccagctgatctactacagccccagctgccccaagatgaccagcgccgcccacagcgagaactacagccccgccagcatggtgaccgaggtgctgtggatcctgagcgaccagaaggagtgcgccgtggagtgcctgtacaacaacatcgtgatcgagaccctgctgcagcccatccacaacctgatgaagggcaacgaggccagccccaactgcagcgagaccgccctgatccacatcgccggcatcctggccagaatcgccagcgtggaggagggcctgatcctgctgctgtacggcgccaacatgaacagcagcgaggagagccccaccggcgcccacatcatcgcccagttcagcaagaagctgctggacgaggacatcagcatcttcagcggcagcgagatgctgcccgtggtgaagggcgccttcatcagcgtgtgcagacacatctacagcacctgcgagggcctgcaggtgctgatcacctacaacctgcacgagagcatcgccaaggcctggaagaagaccagcctgctgagcgagagaatccccacccccgtggagggcagcgacagcgtgagcagcgtgagccaggagagccagaacatcatggcctgggaggacaacctgctggacgacctgctgcacttcgccgccacccccaagggcctgctgctgctgcagagaaccggcgccatcaacgagtgcgtgaccttcatcttcaacagatacgccaagaagctgcaggtgagcagacacaagaagttcggctacggcgtgctggtgaccagagtggccagcaccgccgccggcggcatcgccctgaagaagagcggcttcatcaacgagctgatcaccgagctgtggagcaacctggagtacggcagagacgacgtgagagtgacccaccccagaaccacccccgtggaccccatcgacagaagctgccagaagagcttcctggccctggtgaacctgctgagctaccccgccatctacgagctggtgagaaaccaggacctgcccaacaagaccgagtacagcctgagagaggtgcccacctgcgtgatcgacatcatcgacagactgatcatcctgaacagcgaggccaagatcagaagcctgttcaactacgagcagagccacatcttcggcctgagagacttcatcatcgacggcctgagcgtggagagaaaccacgtgctggtgagaatcaacctggtgggcggccccctggagagaatcctgccccccagactgctggagaagagcgacaacccctacccctggcccatgttcagcagctaccccctgcccaactgctacctgagcgacatcaccagaaacgccggcatcaagcaggacaacgacctggacaagctgctgctgtgcctgaagatcagcgacaagcagaccgagtggatcgagaactgccagagacagttctgcaagatgatgaaggccaagcccgacatcatcagcggcgaggccctgatcgagctgctggagaagttcgtgctgcacctgaccgagagccccagcgagtgctacttccccagcgtggagtacaccgccaccgacgccaacgtgaagaacgagagcctgagcagcgtgcagcagctgggcatcaagatgaccgtgagatacggcaagttcctgagcctgctgaaggacggcgccgagaacgacctgacctgggtgctgaagcactgcgagagattcctgaagcagcagcagaccagcatcaagagcagcctgctgtgcctgcagggcaactacgccggccacgactggttcgtgagcagcctgttcatgatcatgctgggcgacaaggagaagaccttccagttcctgcaccagttcagcagactgctgaccagcgccttcctgtggctgcccagactgcacatcagcagctacctgcccaacgacaccgtggagagcggcatccaccccgtgtacttctgcagcacccactacatcgagatgctgctgaaggccgagctgcccctggtgttcagcgccttccacatgagcggcttcgcccccagccagatctgcctgcagtggatcacccagtgcttctggaactacctggactggatcgagatctgccactacatcgccacctgcgtgttcctgggccccgactaccaggtgtacatctgcatcgccgtgttcaagcacctgcagcaggacatcctgcagcacacccagacccaggacctgcaggtgttcctgaaggaggaggccctgcacggcttcagagtgagcgactacttcgagtacatggagatcctggagcagaactacagaaccgtgctgctgagagacatgagaaacatcagactgcagagcacctag

SEQ ID NO: 11532 - DNA, 612 bp, Artificial Sequence
  Description of Artificial Sequence: Synthetic coding sequence
atggccaccccctacgtgaccgacgagaccggcggcaagtacatcgccagcacccagagacccgacggcacctggagaaagcagagaagagtgaaggagggctacgtgccccaggaggaggtgcccgtgtacgagaacaagtacgtgaagttcttcaagagcaagcccgagctgccccccggcctgagccccgaggccaccgcccccgtgacccccagcagacccgagggcggcgagcccggcctgagcaagaccgccaagagaaacctgaagagaaaggagaagagaagacagcagcaggagaagggcgaggccgaggccctgagcagaaccctggacaaggtgagcctggaggagaccgcccagctgcccagcgccccccagggcagcagagccgcccccaccgccgccagcgaccagcccgacagcgccgccaccaccgagaaggccaagaagatcaagaacctgaagaagaagctgagacaggtggaggagctgcagcagagaatccaggccggcgaggtgagccagcccagcaaggagcagctggagaagctggccagaagaagagccctggaggaggagctggaggacctggagctgggcctgtag

SEQ ID NO: 11533 - DNA, 729 bp, Artificial Sequence; identical to SEQ ID NO: 11148
  Description of Artificial Sequence: Synthetic coding sequence

SEQ ID NO: 11534 - DNA, 738 bp, Artificial Sequence; identical to SEQ ID NO: 9708
  Description of Artificial Sequence: Synthetic coding sequence

SEQ ID NO: 11535 - DNA, 1020 bp, Artificial Sequence
  Description of Artificial Sequence: Synthetic coding sequence
atgatggacagccagctggtggccggcgtggccttcaagaagaccttcagctacgccggcttcgagatgcagcccaagaagtaccacaaccccaagatcgccctgctgaacgtggagctggagctgaaggccgagaaggacaacgccgagatcagagtgcacaccgtggaggactaccaggccatcgtggacgccgagtggaacatcctgtacgacaagctggagaagatccaccacagcggcgccaaggtggtgctgagcaagctgcccatcggcgacgtggccacccagtacttcgccgacagagacatgttctgcgccggcagagtgcccgaggaggacctgaagagaaccatgatggcctgcggcggcagcatccagaccagcgtgaacgccctgagcgccgacgtgctgggcagatgccaggtgttcgaggagacccagatcggcggcgagagatacaacttcttcaccggctgccccaaggccaagacctgcaccttcatcctgagaggcggcgccgagcagttcatggaggagaccgagagaagcctgcacgacgccatcatgatcgtgagaagagccatcaagaacgacagcgtggtggccggcggcggcgccatcgagatggagctgagcaagtacctgagagactacagcagaaccatccccggcaagcagcagctgctgatcggcgcctacgccaaggccctggagatcatccccagacagctgtgcgacaacgccggcttcgacgccaccaacatcctgaacaagctgagagccagacacgcccagggcggcacctggtacggcgtggacatcaacaacgaggacatcgccgacaacttcgaggccttcgtgtgggagcccgccatggtgagaatcaacgccctgaccgccgccagcgaggccgcctgcctgatcgtgagcgtggacgagaccatcaagaaccccagaagcaccgtggacgcccccaccgccgccggcagaggcagaggcagaggcagaccccactag

SEQ ID NO: 11536 - DNA, 768 bp, Artificial Sequence; identical to SEQ ID NO: 9605
  Description of Artificial Sequence: Synthetic coding sequence

SEQ ID NO: 11537 - DNA, 441 bp, Artificial Sequence
  Description of Artificial Sequence: Synthetic coding sequence
atggtgaacagctgctgcggcagcgtgtgcagcgaccagggctgcgaccagggcctgtgccaggagacctgctgcagacccagctgctgccagaccacctgctgctgccccagctgcgtggtgagcagctgctgcagacccagctgcagccagaccacctgctgccagaccacctgctgcagacccagctgctgccaccccgtgtgctgccagaccacctgcagacccagctgcggcgtgagcagctgctgcagacccctgtgctgccagaccacctgccaccccagctgcggcatgagcagctgctgcagacccctgtgctgccagaccacctgcagacccagctgcggcgtgagcagctgctgcagacccctgtgctgccagaccacctgctgcagagccacctgctgcagacccagctgctgcggcagcagctgctag

SEQ ID NO: 11538 - DNA, 1296 bp, Artificial Sequence; identical to SEQ ID NO: 11044
  Description of Artificial Sequence: Synthetic coding sequence

SEQ ID NO: 11539 - DNA, 471 bp, Artificial Sequence
  Description of Artificial Sequence: Synthetic coding sequence
atgggctgctgcggctgcagcggcggctgcggcagcggctgcggcggctgcggcagcggcagcggcggctgcggcagcggctgcggcggctgcggcagcagctgctgcgtgcccatctgctgctgcaagcccgtgtgctgctgcgtgcccgcctgcagctgcagcagctgcggcagctgcggcggcagcaagggcggctgcggcagctgcggcagcagcaagggcggctgcggcagctgcggctgcagccagagcaactgctgcaagccctgctgcagcagcagcggctgcggcagcttctgctgccagagcagctgcagcaagccctgctgctgccagagcagctgctgccagagcagctgctgcaagccctgctgctgccagagcagctgctgccagagcagctgcttcaagccctgctgctgccagagcagctgctgcgtgcccgtgtgctgccagtgcaagatctag

SEQ ID NO: 11540 - DNA, 609 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctacggcagcggctgcggcggctgcggcagcagctgctgcgtgcccgtgtgctgctgcaagcccgtgtgctgctgcgtgcccgcctgcagctgcagcagctgcggcagctgcggcggcagcaagggcgactgcggcagctgcggcggcagcaagggcggctgcggcagctgcggcggcagcaagggcggctgcggcagctgcggcggcagcaagggcggctgcggcagctgcggcggcagcaagggcggctgcggcagctgcggcggcagcaagggcggctgcggcagctgcggcggcagcaagggcggctgcggcagctgcggctgcagccagtgcaactgctgcaagccctgctgctgcagcagcggctgcggcagctgctgccagagcagctgctgcaacccctgctgctgccagagcagctgctgcgtgcccgtgtgctgccagagcagctgctgcaagccctgctgctgccagagcagctgctgcgtgcccgtgtgctgccagtgcaagatctag

SEQ ID NO: 11541 - DNA, 498 bp, Artificial Sequence
  Description of Artificial Sequence: Synthetic coding sequence
atgggctgctgcggctgcagcgagggctgcggcagcggctgcggcggctgcggcagcggctgcggcggctgcggcagcggctgcggcggctgcggcagcagctgctgcgtgcccgtgtgctgctgcaagcccgtgtgctgctgcgtgcccgcctgcagctgcagcagctgcggcagctgcggcggcagcaagggcggctgcggcagctgcggcggcagcaagggcggctgcggcagctgcggcggcagcaagggcggctgcggcagctgcggctgcagccagtgcagctgctacaagccctgctgctgcagcagcggctgcggcagcagctgctgccagagcagctgctgcaagccctgctgctgccagagcagctgctgcaagccctgctgctgcagcagcggctgcggcagcagctgctgccagagcagctgctgcaacccctgctgcagccagagcagctgctgcgtgcccgtgtgctgccagtgcaagatctag

SEQ ID NO: 11542 - DNA, 3105 bp, Artificial Sequence
  Description of Artificial Sequence: Synthetic coding sequence
atggccagcgtgttcatgtgcggcgtggaggacctgctgttcagcggcagcagattcgtgtggaacctgaccgtgagcaccctgagaagatggtacaccgagagactgagagcctgccaccaggtgctgagaacctggtgcggcctgcaggacgtgtaccagatgaccgagggcagacactgccaggtgcacctgctggacgacagaagactggagctgctggtgcagcccaagctgctggccagagagctgctggacctggtggccagccacttcaacctgaaggagaaggagtacttcggcatcaccttcatcgacgacaccggccagcagaactggctgcagctggaccacagagtgctggaccacgacctgcccaagaagcccggccccaccatcctgcacttcgccgtgagattctacatcgagagcatcagcttcctgaaggacaagaccaccgtggagctgttcttcctgaacgccaaggcctgcgtgcacaagggccagatcgaggtggagagcgagaccatcttcaagctggccgccttcatcctgcaggaggccaagggcgactacaccagcgacgagaacgccagaaaggacctgaagaccctgcccgccttccccaccaagaccctgcaggagcaccccagcctggcctactgcgaggacagagtgatcgagcactacctgaagatcaagggcctgaccagaggccaggccgtggtgcagtacatgaagatcgtggaggccctgcccacctacggcgtgcactactacgccgtgaaggacaagcagggcctgccctggtggctgggcatcagctacaagggcatcggccagtacgacatccaggacaaggtgaagcccagaaagctgttccagtggaagcagctggagaacctgtacttcagagagaagaagttcgccgtggaggtgcacgaccccagaagaatcagcgtgagcagaagaaccttcggccagagcggcctgttcgtgcagacctggtacgccaacagcagcctgatcaagagcatctgggtgatggccatcagccagcaccagttctacctggacagaaagcagagcaaggccaagatccccagcgccagaagcctggacgagatcgccatggacctgaccgagaccggcacccagagagccagcaagctggtgaccctggagaccaagagccagttcatcatggccagcaacggcagcctgatcagcagcggcagccaggacagcgaggtgagcgaggagcagaagagagagaagatcctggagctgaagaagaaggagaagctgctgcaggagaagctgctgaagaaggtggaggagctgaagaagatctgcctgagagaggccgagctgaccggcaagatgcccaaggagtaccccctgaacatcggcgagaagcccccccaggtgagaagaagagtgggcaccgccttcaagctggacgacaacctgctgcccagcgaggaggaccccgccctgcaggagctggagagcaacttcctgatccagcagaagctggtggaggccgccaagaagctggccaacgagcccgacctgtgcaagaccgtgaagaagaagagaaagcaggactacaccgacgccatgaagaagctgcaggagatcgagaacgccatcaacgagtacagaatcagatgcggcaagaagcccagccagaaggccaccgtgctgcccgaggacatcatccccagcgagagcagcagcctgagcgacaccaccacctacgacgaccccagcgacgccttcaccttccccggccagagaagcagcagcgtgccccacagccccagaatcctgccccccaagagcctgggcatcgagagaatccacttcagaaagagcagcatcaacgagcagttcgtggacaccagacagagcagagagatgctgagcacccacagcagcccctacaagaccctggagagaagaccccagggcggcagaagcatgcccaccacccccgtgctgaccagaaacgcctacagcagcagccacctggagcccgagagcagcagccagcactgcagacagagaagcggcagcctggagagccagagccacctgctgagcgagatggacagcgacaagcccttcttcagcctgagcaagagccagagaagcagcagcaccgagatcctggacgacggcagcagctacaccagccagagcagcaccgagtactactgcgtgacccccgtgaccggcccctactacaccacccagaccctggacaccagaaccagaggcagaagaagaagcaagaagcagaacgtgagcaccagcaacagcggcagcatgcccaacctggcccagaaggacagcctgagaaacggcgtgtacagcaagagccaggagccccccagcagcagctactacatcgccggctacaccccctacgccgagtgcgacttctactacagcggcggctacgtgtacgagaacgacaccgagggccagtacagcgtgaaccccagctacagaagcagcgcccactacggctacgagagacagagagactacagcagaagcttccacgaggacgaggtggacagagtgccccacaacccctacgccaccctgagactgcccagaaaggccgccgccaagagcgagcacatcaccaagaacatccacaaggccctggtggccgagcacctgagaggctggtaccagagagccagcggccagaaggaccagggccacagcccccagaccagcttcgacagcgacagaggcagccagagatgcctgggcttcgccggcctgcaggtgccctgcagccccagcagcagagccagcagctacagcagcgtgagcagcaccaacgccagcggcaactggagaacccagctgaccatcggcctgagcgactacgagacccccgcccacagcagctacaccagctgctacggcaacgtgtacaaccccctgcccagccccagcagacagtacaccgagatcagccagctggacggcaccgacggcaaccagctggaggacaacctggagagcagcgagcagagactgttctggcacgaggacagcaagcccggcaccctggtgtag

SEQ ID NO: 11543 - DNA, 501 bp, Artificial Sequence
  Description of Artificial Sequence: Synthetic coding sequence
atgctgagccagagctgcaacctggaccccctgaccgagacctacggcatccccttctacctgcagtacctggcccactggcccgagtacttcatcgtggccgaggcccccggcggcgagctgatgggctacatcatgggcaaggccgagggcagcgtggccagagaggagtggcacggccacgtgaccgccctgagcgtggcccccgagttcagaagactgggcctggccgccaagctgatggagctgctggaggagatcagcgagagaaagggcggcttcttcgtggacctgttcgtgagagtgagcaaccaggtggccgtgaacatgtacaagcagctgggctacagcgtgtacagaaccgtgatcgagtactacagcgccagcaacggcgagcccgacgaggacgcctacgacatgagaaaggccctgagcagagacaccgagaagaagagcatcatccccctgccccaccccgtgagacccgaggacatcgagtag

SEQ ID NO: 11544 - DNA, 399 bp, Artificial Sequence; identical to SEQ ID NO: 11136
  Description of Artificial Sequence: Synthetic coding sequence

SEQ ID NO: 11545 - DNA, 375 bp, Artificial Sequence; identical to SEQ ID NO: 10236
  Description of Artificial Sequence: Synthetic coding sequence

SEQ ID NO: 11546 - DNA, 336 bp, Artificial Sequence
  Description of Artificial Sequence: Synthetic coding sequence
ctgatggacctggacagcggcgacgtgaagagaagagtgcacctgttcgagacccagagaagaaccaaggaggaggaccccatcatccccttcagcgacggccccatcatcagcaagtggggcgccatcagcagaagcagcagaaccggctaccacaccaccgaccccgtgcaggccaccgccagccagggcagcgccaccaagcccatcagcgtgagcggcggcgtgcacatggccaccagaccccaccaccagcacaccatgctgaagggcaccgacagcctgctgctgatctacctggtgatcgagagcatccccgtgctgggcaccttctag

SEQ ID NO: 11547 - DNA, 399 bp, Artificial Sequence; identical to SEQ ID NO: 11136
  Description of Artificial Sequence: Synthetic coding sequence

SEQ ID NO: 11548 - DNA, 375 bp, Artificial Sequence; identical to SEQ ID NO: 10236
  Description of Artificial Sequence: Synthetic coding sequence

SEQ ID NO: 11549 - DNA, 1038 bp, Artificial Sequence
  Description of Artificial Sequence: Synthetic coding sequence
atgctgcccaacaccggcagactggccggctgcaccgtgttcatcaccggcgccagcagaggcatcggcaaggccatcgccctgaaggccgccaaggacggcgccaacatcgtgatcgccgccaagaccgcccagccccaccccaagctgctgggcaccatctacaccgccgccgaggagatcgaggccgtgggcggcaaggccctgccctgcatcgtggacgtgagagacgagcagcagatcagcgccgccgtggagaaggccatcaagaagttcggcgcctacaccatcgccaagtacggcatgagcatgtacgtgctgggcatggccgaggagttcaagggcgagatcgccgtgaacgccctgtggcccaagaccgccatccacaccgccgccatggacatgctgggcggccccggcatcgagagccagtgcagaaaggtggacatcatcgccgacgccgcctacagcatcttccagaagcccaagagcttcaccggcaacttcgtgatcgacgagaacatcctgaaggaggagggcatcgagaacttcgacgtgtacgccatcaagcccggccaccccctgcagcccgacttcttcctggacgagtaccccgaggccgtgagcaagaaggtggagagcaccggcgccgtgcccgagttcaaggaggagaagctgcagctgcagcccaagcccagaagcggcgccgtggaggagaccttcagaatcgtgaaggacagcctgagcgacgacgtggtgaaggccacccaggccatctacctgttcgagctgagcggcgaggacggcggcacctggttcctggacctgaagagcaagggcggcaacgtgggctacggcgagcccagcgaccaggccgacgtggtgatgagcatgaccaccgacgacttcgtgaagatgttcagcggcaagctgaagcccaccatggccttcatgagcggcaagctgaagatcaagggcaacatggccctggccatcaagctggagaagctgatgaaccagatgaacgccagactgtag

SEQ ID NO: 11550 - DNA, 1257 bp, Artificial Sequence
  Description of Artificial Sequence: Synthetic coding sequence
atgctgcccaacaccggcagactggccggctgcaccgtgttcatcaccggcgccagcagaggcatcggcaaggccatcgccctgaaggccgccaaggacggcgccaacatcgtgatcgccgccaagaccgcccagccccaccccaagctgctgggcaccatctacaccgccgccgaggagatcgaggccgtgggcggcaaggccctgccctgcatcgtggacgtgagagacgagcagcagatcagcgccgccgtggagaaggccatcaagaagttcggcggcatcgacatcctggtgaacaacgccagcgccatcagcctgaccaacaccctggacacccccaccaagagactggacctgatgatgaacgtgaacaccagaggcacctacctggccagcaaggcctgcatcccctacctgaagaagagcaaggtggcccacatcctgaacatcagcccccccctgaacctgaaccccgtgtggttcaagcagcactgcgcctacaccatcgccaagtacggcatgagcatgtacgtgctgggcatggccgaggagttcaagggcgagatcgccgtgaacgccctgtggcccaagaccgccatccacaccgccgccatggacatgctgggcggccccggcatcgagagccagtgcagaaaggtggacatcatcgccgacgccgcctacagcatcttccagaagcccaagagcttcaccggcaacttcgtgatcgacgagaacatcctgaaggaggagggcatcgagaacttcgacgtgtacgccatcaagcccggccaccccctgcagcccgacttcttcctggacgagtaccccgaggccgtgagcaagaaggtggagagcaccggcgccgtgcccgagttcaaggaggagaagctgcagctgcagcccaagcccagaagcggcgccgtggaggagaccttcagaatcgtgaaggacagcctgagcgacgacgtggtgaaggccacccaggccatctacctgttcgagctgagcggcgaggacggcggcacctggttcctggacctgaagagcaagggcggcaacgtgggctacggcgagcccagcgaccaggccgacgtggtgatgagcatgaccaccgacgacttcgtgaagatgttcagcggcaagctgaagcccaccatggccttcatgagcggcaagctgaagatcaagggcaacatggccctggccatcaagctggagaagctgatgaaccagatgaacgccagactgtag

SEQ ID NO: 11551 - DNA, 1077 bp, Artificial Sequence
  Description of Artificial Sequence: Synthetic coding sequence
atgcccggctgcgagctgcccgtgggcacctgccccgacatgtgccccgccgccgagagagcccagagagagagagagcacagactgcacagactggaggtggtgcccggctgcagacaggacccccccagagccgacccccagagagccgtgaaggagtacagcagacccgccgccggcaagcccagacccccccccagccagctgagaccccccagcgtgctgctggccaccgtgagatacctggccggcgaggtggccgagagcgccgacatcgccagagccgaggtggccagcttcgtggccgacagactgagagccgtgctgctggacctggccctgcagggcgccggcgacgccgaggccgccgtggtgctggaggccgccctggccaccctgctgaccgtggtggccagactgggccccgacgccgccagaggccccgccgaccccgtgctgctgcaggcccaggtgcaggagggcttcggcagcctgagaagatgctacgccagaggcgccggcccccaccccagacagcccgccttccagggcctgttcctgctgtacaacctgggcagcgtggaggccctgcacgaggtgctgcagctgcccgccgccctgagagcctgcccccccctgagaaaggccctggccgtggacgccgccttcagagagggcaacgccgccagactgttcagactgctgcagaccctgccctacctgcccagctgcgccgtgcagtgccacgtgggccacgccagaagagaggccctggccagattcgccagagccttcagcacccccaagggccagaccctgcccctgggcttcatggtgaacctgctggccctggacggcctgagagaggccagagacctgtgccaggcccacggcctgcccctggacggcgaggagagagtggtgttcctgagaggcagatacgtggaggagggcctgccccccgccagcacctgcaaggtgctggtggagagcaagctgagaggcagaaccctggaggaggtggtgatggccgaggaggaggacgagggcaccgacagacccggcagccccgcctag

SEQ ID NO: 11552 - DNA, 150 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatgtag

SEQ ID NO: 11553 - DNA, 2598 bp, Artificial Sequence
  Description of Artificial Sequence: Synthetic coding sequence
atgcccgccgtgagcctgccccccaaggagaacgccctgttcaagagaatcctgagatgctacgagcacaagcagtacagaaacggcctgaagttctgcaagcagatcctgagcaaccccaagttcgccgagcacggcgagaccctggccatgaagggcctgaccctgaactgcctgggcaagaaggaggaggcctacgagctggtgagaagaggcctgagaaacgacctgaagagccacgtgtgctggcacgtgtacggcctgctgcagagaagcgacaagaagtacgacgaggccatcaagtgctacagaaacgccctgaagtgggacaaggacaacctgcagatcctgagagacctgagcctgctgcagatccagatgagagacctggagggctacagagagaccagataccagctgctgcagctgagacccgcccagagagccagctggatcggctacgccatcgcctaccacctgctggaggactacgagatggccgccaagatcctggaggagttcagaaagacccagcagaccagccccgacaaggtggactacgagtacagcgagctgctgctgtaccagaaccaggtgctgagagaggccggcctgtacagagaggccctggagcacctgtgcacctacgagaagcagatctgcgacaagctggccgtggaggagaccaagggcgagctgctgctgcagctgtgcagactggaggacgccgccgacgtgtacagaggcctgcaggagagaaaccccgagaactgggcctactacaagggcctggagaaggccctgaagcccgccaacatgctggagagactgaagatctacgaggaggcctggaccaagtaccccagaggcctggtgcccagaagactgcccctgaacttcctgagcggcgagaagttcaaggagtgcctggacaagttcctgagaatgaacttcagcaagggctgcccccccgtgttcaacaccctgagaagcctgtacaaggacaaggagaaggtggccatcatcgaggagctggtggtgggctacgagaccagcctgaagagctgcagactgttcaaccccaacgacgacggcaaggaggagccccccaccaccctgctgtgggtgcagtactacctggcccagcactacgacaagatcggccagcccagcatcgccctggagtacatcaacaccgccatcgagagcacccccaccctgatcgagctgttcctggtgaaggccaagatctacaagcacgccggcaacatcaaggaggccgccagatggatggacgaggcccaggccctggacaccgccgacagattcatcaacagcaagtgcgccaagtacatgctgaaggccaacctgatcaaggaggccgaggagatgtgcagcaagttcaccagagagggcaccagcgccgtggagaacctgaacgagatgcagtgcatgtggttccagaccgagtgcgcccaggcctacaaggccatgaacaagttcggcgaggccctgaagaagtgccacgagatcgagagacacttcatcgagatcaccgacgaccagttcgacttccacacctactgcatgagaaagatcaccctgagaagctacgtggacctgctgaagctggaggacgtgctgagacagcaccccttctacttcaaggccgccagaatcgccatcgagatctacctgaagctgcacgacaaccccctgaccgacgagaacaaggagcacgaggccgacaccgccaacatgagcgacaaggagctgaagaagctgagaaacaagcagagaagagcccagaagaaggcccagatcgaggaggagaagaagaacgccgagaaggagaagcagcagagaaaccagaagaagaagaaggacgacgacgacgaggagatcggcggccccaaggaggagctgatccccgagaagctggccaaggtggagacccccctggaggaggccatcaagttcctgacccccctgaagaacctggtgaagaacaagatcgagacccacctgttcgccttcgagatctacttcagaaaggagaagttcctgctgatgctgcagagcgtgaagagagccttcgccatcgacagcagccacccctggctgcacgagtgcatgatcagactgttcaacaccgtgtgcgagagcaaggacctgagcgacaccgtgagaaccgtgctgaagcaggagatgaacagactgttcggcgccaccaaccccaagaacttcaacgagaccttcctgaagagaaacagcgacagcctgccccacagactgagcgccgccaagatggtgtactacctggaccccagcagccagaagagagccatcgagctggccaccaccctggacgagagcctgaccaacagaaacctgcagacctgcatggaggtgctggaggccctgtacgacggcagcctgggcgactgcaaggaggccgccgagatctacagagccaactgccacaagctgttcccctacgccctggccttcatgccccccggctacgaggaggacatgaagatcaccgtgaacggcgacagcagcgccgaggccgaggagctggccaacgagatctag

SEQ ID NO: 11554 - DNA, 1797 bp, Artificial Sequence; identical to SEQ ID NO: 10093
  Description of Artificial Sequence: Synthetic coding sequence

SEQ ID NO: 11555 - DNA, 1818 bp, Artificial Sequence
  Description of Artificial Sequence: Synthetic coding sequence
atgggcggctgcttcagcaagcccaagcccgtggagctgaagatcgaggtggtgctgcccgagaaggagagaggcaaggaggagctgagcgccagcggcaagggcagccccagagcctaccagggcaacggcaccgccagacacttccacaccgaggagagactgagcaccccccacccctaccccagcccccaggactgcgtggaggccgccgtgtgccacgtgaaggacctggagaacggccagatgagagaggtggagctgggctggggcaaggtgctgctggtgaaggacaacggcgagttccacgccctgggccacaagtgcccccactacggcgcccccctggtgaagggcgtgctgagcagaggcagagtgagatgcccctggcacggcgcctgcttcaacatcagcaccggcgacctggaggacttccccggcctggacagcctgcacaagttccaggtgaagatcgagaaggagaaggtgtacgtgagagccagcaagcaggccctgcagctgcagagaagaaccaaggtgatggccaagtgcatcagccccagcgccggctacagcagcagcaccaacgtgctgatcgtgggcgccggcgccgccggcctggtgtgcgccgagaccctgagacaggagggcttcagcgacagaatcgtgctgtgcaccctggacagacacctgccctacgacagacccaagctgagcaagagcctggacacccagcccgagcagctggccctgagacccaaggagttcttcagagcctacggcatcgaggtgctgaccgaggcccaggtggtgaccgtggacgtgagaaccaagaaggtggtgttcaaggacggcttcaagctggagtacagcaagctgctgctggcccccggcagcagccccaagaccctgagctgcaagggcaaggaggtggagaacgtgttcaccatcagaacccccgaggacgccaacagagtggtgagactggccagaggcagaaacgtggtggtggtgggcgccggcttcctgggcatggaggtggccgcctacctgaccgagaaggcccacagcgtgagcgtggtggagctggaggagacccccttcagaagattcctgggcgagagagtgggcagagccctgatgaagatgttcgagaacaacagagtgaagttctacatgcagaccgaggtgagcgagctgagaggccaggagggcaagctgaaggaggtggtgctgaagagcagcaaggtggtgagagccgacgtgtgcgtggtgggcatcggcgccgtgcccgccaccggcttcctgagacagagcggcatcggcctggacagcagaggcttcatccccgtgaacaagatgatgcagaccaacgtgcccggcgtgttcgccgccggcgacgccgtgaccttccccctggcctggagaaacaacagaaaggtgaacatcccccactggcagatggcccacgcccagggcagagtggccgcccagaacatgctggcccaggaggccgagatgagcaccgtgccctacctgtggaccgccatgttcggcaagagcctgagatacgccggctacggcgagggcttcgacgacgtgatcatccagggcgacctggaggagctgaagttcgtggccttctacaccaagggcgacgaggtgatcgccgtggccagcatgaactacgaccccatcgtgagcaaggtggccgaggtgctggccagcggcagagccatcagaaagagagaggtggagctgttcgtgctgcacagcaagaccggcgacatgagctggctgaccggcaagggcagctag

SEQ ID NO: 11556 - DNA, 1374 bp, Artificial Sequence
  Description of Artificial Sequence: Synthetic coding sequence
atgaaccagccctgcaacagcatggagcccagagtgatggacgacgacatgctgaagctggccgtgggcgaccagggcccccaggaggaggccggccagctggccaagcaggagggcatcctgttcaaggacgtgctgagcctgcagctggacttcagaaacatcctgagaatcgacaacctgtggcagttcgagaacctgagaaagctgcagctggacaacaacatcatcgagaagatcgagggcctggagaacctggcccacctggtgtggctggacctgagcttcaacaacatcgagaccatcgagggcctggacaccctggtgaacctggaggacctgagcctgttcaacaacagaatcagcaagatcgacagcctggacgccctggtgaagctgcaggtgctgagcctgggcaacaacagaatcgacaacatgatgaacatcatctacctgagaagattcaagtgcctgagaaccctgagcctgagcagaaaccccatcagcgaggccgaggactacaagatgttcatctgcgcctacctgcccgacctgatgtacctggactacagaagaatcgacgaccacaccaagaagctggccgaggccaagcaccagtacagcatcgacgagctgaagcaccaggagaacctgatgcaggcccagctggaggacgagcaggcccagagagaggagctggagaagcacaagaccgccttcgtggagcacctgaacggcagcttcctgttcgacagcatgtacgccgaggacagcgagggcaacaacctgagctacctgcccggcgtgggcgagctgctggagacctacaaggacaagttcgtgatcatctgcgtgaacatcttcgagtacggcctgaagcagcaggagaagagaaagaccgagctggacaccttcagcgagtgcgtgagagaggccatccaggagaaccaggagcagggcaagagaaagatcgccaagttcgaggagaagcacctgagcagcctgagcgccatcagagaggagctggagctgcccaacatcgagaagatgatcctggagtgcagcgccgacatcagcgagctgttcgacgccctgatgaccctggagatgcagctggtggagcagctggaggagaccatcaacatgttcgagagaaacatcgtggacatggtgggcctgttcatcgagaacgtgcagagcctgatggcccagtgcagagacctggagaaccaccaccacgagaagctgctggagatcagcatcagcaccctggagaagatcgtggagggcgacctggacgaggacctgcccaacgacctgagagccggcagattccagaagttcaactacgtggaggccagcggcaccttctag

SEQ ID NO: 11557 - DNA, 1374 bp, Artificial Sequence; identical to SEQ ID NO: 11556
  Description of Artificial Sequence: Synthetic coding sequence

SEQ ID NO: 11558 - DNA, 1572 bp, Artificial Sequence; identical to SEQ ID NO: 9871
  Description of Artificial Sequence: Synthetic coding sequence

SEQ ID NO: 11559 - DNA, 1572 bp, Artificial Sequence; identical to SEQ ID NO: 9871
  Description of Artificial Sequence: Synthetic coding sequence

SEQ ID NO: 11560 - DNA, 1842 bp, Artificial Sequence; identical to SEQ ID NO: 9548
  Description of Artificial Sequence: Synthetic coding sequence

SEQ ID NO: 11561 - DNA, 390 bp, Artificial Sequence; identical to SEQ ID NO: 10956
  Description of Artificial Sequence: Synthetic coding sequence

SEQ ID NO: 11562 - DNA, 390 bp, Artificial Sequence; identical to SEQ ID NO: 10956
  Description of Artificial Sequence: Synthetic coding sequence

SEQ ID NO: 11563 - DNA, 4128 bp, Artificial Sequence
  Description of Artificial Sequence: Synthetic coding sequence
atggtgcccggcgaggagaaccagctggtgcccaaggaggacgtgttctggagatgcagacagaacatcttcgacgagatgaagaagaagttcctgcagatcgagaacgccgccgaggagcccagagtgctgtgcatcatccaggacaccaccaacagcaagaccgtgaacgagagaatcaccctgaacctgcccgccagcacccccgtgagaaagctgttcgaggacgtggccaacaaggtgggctacatcaacggcaccttcgacctggtgtggggcaacggcatcaacaccgccgacatggcccccctggaccacaccagcgacaagagcctgctggacgccaacttcgagcccggcaagaagaacttcctgcacctgaccgacaaggacggcgagcagccccagatcctgctggaggacagcagcgccggcgaggacagcgtgcacgacagattcatcggccccctgcccagagagggcagcggcggcagcaccagcgactacgtgagccagagctacagctacagcagcatcctgaacaagagcgagaccggctacgtgggcctggtgaaccaggccatgacctgctacctgaacagcctgctgcagaccctgttcatgacccccgagttcagaaacgccctgtacaagtgggagttcgaggagagcgaggaggaccccgtgaccagcatcccctaccagctgcagagactgttcgtgctgctgcagaccagcaagaagagagccatcgagaccaccgacgtgaccagaagcttcggctgggacagcagcgaggcctggcagcagcacgacgtgcaggagctgtgcagagtgatgttcgacgccctggagcagaagtggaagcagaccgagcaggccgacctgatcaacgagctgtaccagggcaagctgaaggactacgtgagatgcctggagtgcggctacgagggctggagaatcgacacctacctggacatccccctggtgatcagaccctacggcagcagccaggccttcgccagcgtggaggaggccctgcacgccttcatccagcccgagatcctggacggccccaaccagtacttctgcgagagatgcaagaagaagtgcgacgccagaaagggcctgagattcctgcacttcccctacctgctgaccctgcagctgaagagattcgacttcgactacaccaccatgcacagaatcaagctgaacgacagaatgaccttccccgaggagctggacatgagcaccttcatcgacgtggaggacgagaagagcccccagaccgagagctgcaccgacagcggcgccgagaacgagggcagctgccacagcgaccagatgagcaacgacttcagcaacgacgacggcgtggacgagggcatctgcctggagaccaacagcggcaccgagaagatcagcaagagcggcctggagaagaacagcctgatctacgagctgttcagcgtgatggtgcacagcggcagcgccgccggcggccactactacgcctgcatcaagagcttcagcgacgagcagtggtacagcttcaacgaccagcacgtgagcagaatcacccaggaggacatcaagaagacccacggcggcagcagcggcagcagaggctactacagcagcgccttcgccagcagcaccaacgcctacatgctgatctacagactgaaggaccccgccagaaacgccaagttcctggaggtggacgagtaccccgagcacatcaagaacctggtgcagaaggagagagagctggaggagcaggagaagagacagagagagatcgagagaaacacctgcaagatcaagctgttctgcctgcaccccaccaagcaggtgatgatggagaacaagctggaggtgcacaaggacaagaccctgaaggaggccgtggagatggcctacaagatgatggacctggaggaggtgatccccctggactgctgcagactggtgaagtacgacgagttccacgactacctggagagaagctacgagggcgaggaggacacccccatgggcctgctgctgggcggcgtgaagagcacctacatgttcgacctgctgctggagaccagaaagcccgaccaggtgttccagagctacaagcccggcgaggtgatggtgaaggtgcacgtggtggacctgaaggccgagagcgtggccgcccccatcaccgtgagagcctacctgaaccagaccgtgaccgagttcaagcagctgatcagcaaggccatccacctgcccgccgagaccatgagaatcgtgctggagagatgctacaacgacctgagactgctgagcgtgagcagcaagaccctgaaggccgagggcttcttcagaagcaacaaggtgttcgtggagagcagcgagaccctggactaccagatggccttcgccgacagccacctgtggaagctgctggacagacacgccaacaccatcagactgttcgtgctgctgcccgagcagagccccgtgagctacagcaagagaaccgcctaccagaaggccggcggcgacagcggcaacgtggacgacgactgcgagagagtgaagggccccgtgggcagcctgaagagcgtggaggccatcctggaggagagcaccgagaagctgaagagcctgagcctgcagcagcagcaggacggcgacaacggcgacagcagcaagagcaccgagaccagcgacttcgagaacatcgagagccccctgaacgagagagacagcagcgccagcgtggacaacagagagctggagcagcacatccagaccagcgaccccgagaacttccagagcgaggagagaagcgacagcgacgtgaacaacgacagaagcaccagcagcgtggacagcgacatcctgagcagcagccacagcagcgacaccctgtgcaacgccgacaacgcccagatccccctggccaacggcctggacagccacagcatcaccagcagcagaagaaccaaggccaacgagggcaagaaggagacctgggacaccgccgaggaggacagcggcaccgacagcgagtacgacgagagcggcaagagcagaggcgagatgcagtacatgtacttcaaggccgagccctacgccgccgacgagggcagcggcgagggccacaagtggctgatggtgcacgtggacaagagaatcaccctggccgccttcaagcagcacctggagcccttcgtgggcgtgctgagcagccacttcaaggtgttcagagtgtacgccagcaaccaggagttcgagagcgtgagactgaacgagaccctgagcagcttcagcgacgacaacaagatcaccatcagactgggcagagccctgaagaagggcgagtacagagtgaaggtgtaccagctgctggtgaacgagcaggagccctgcaagttcctgctggacgccgtgttcgccaagggcatgaccgtgagacagagcaaggaggagctgatcccccagctgagagagcagtgcggcctggagctgagcatcgacagattcagactgagaaagaagacctggaagaaccccggcaccgtgttcctggactaccacatctacgaggaggacatcaacatcagcagcaactgggaggtgttcctggaggtgctggacggcgtggagaagatgaagagcatgagccagctggccgtgctgagcagaagatggaagcccagcgagatgaagctggaccccttccaggaggtggtgctggagagcagcagcgtggacgagctgagagagaagctgagcgagatcagcggcatccccctggacgacatcgagttcgccaagggcagaggcaccttcccctgcgacatcagcgtgctggacatccaccaggacctggactggaaccccaaggtgagcaccctgaacgtgtggcccctgtacatctgcgacgacggcgccgtgatcttctacagagacaagaccgaggagctgatggagctgaccgacgagcagagaaacgagctgatgaagaaggagagcagcagactgcagaagaccggccacagagtgacctacagccccagaaaggagaaggccctgaagatctacctggacggcgcccccaacaaggacctgacccaggactag

SEQ ID NO: 11564 - DNA, 600 bp, Artificial Sequence
  Description of Artificial Sequence: Synthetic coding sequence
atgagaaccgccgacagagaggccagacccggcctgcccagcctgctgctgctgctgctggccggcgccggcctgagcgccgccagcccccccgccgcccccagattcaacgtgagcctggacagcgtgcccgagctgagatggctgcccgtgctgagacactacgacctggacctggtgagagccgccatggcccaggtgatcggcgacagagtgcccaagtgggtgcacgtgctgatcggcaaggtggtgctggagctggagagattcctgccccagcccttcaccggcgagatcagaggcatgtgcgacttcatgaacctgagcctggccgactgcctgctggtgaacctggcctacgagagcagcgtgttctgcaccagcatcgtggcccaggacagcagaggccacatctaccacggcagaaacctggactaccccttcggcaacgtgctgagaaagctgaccgtggacgtgcagttcctgaagaacggccagatcgccttcaccggcaccaccttcatcggctacgtgggcctgtggaccggccagagcccccacaagttcaccgtgagcggcgacgagagagacccccactag

SEQ ID NO: 11565 - DNA, 972 bp, Artificial Sequence
  Description of Artificial Sequence: Synthetic coding sequence
atgagaaccgccgacagagaggccagacccggcctgcccagcctgctgctgctgctgctggccggcgccggcctgagcgccgccagcccccccgccgcccccagattcaacgtgagcctggacagcgtgcccgagctgagatggctgcccgtgctgagacactacgacctggacctggtgagagccgccatggcccaggtgatcggcgacagagtgcccaagtgggtgcacgtgctgatcggcaaggtggtgctggagctggagagattcctgccccagcccttcaccggcgagatcagaggcatgtgcgacttcatgaacctgagcctggccgactgcctgctggtgaacctggcctacgagagcagcgtgttctgcaccagcatcgtggcccaggacagcagaggccacatctaccacggcagaaacctggactaccccttcggcaacgtgctgagaaagctgaccgtggacgtgcagttcctgaagaacggccagatcgccttcaccggcaccaccttcatcggctacgtgggcctgtggaccggccagagcccccacaagttcaccgtgagcggcgacgagagagacaagggctggtggtgggagaacgccatcgccgccctgttcagaagacacatccccgtgagctggctgatcagagccaccctgagcgagagcgagaacttcgaggccgccgtgggcaagctggccaagacccccctgatcgccgacgtgtactacatcgtgggcggcaccagccccagagagggcgtggtgatcaccagaaacagagacggccccgccgacatctggcccctggaccccctgaacggcgcctggttcagagtggagaccaactacgaccactggaagcccgcccccaaggaggacgacagaagaaccagcgccatcaaggccctgaacgccaccggccaggccaacctgagcctggaggccctgttccagtag

SEQ ID NO: 11566 - DNA, 4539 bp, Artificial Sequence
  Description of Artificial Sequence: Synthetic coding sequence
atggccgccgccgccggcaacagagccagcagcagcggcttccccggcgccagagccaccagccccgaggccggcggcggcggcggcgccctgaaggccagcagcgcccccgccgccgccgccggcctgctgagagaggccggcagcggcggcagagagagagccgactggagaagaagacagctgagaaaggtgagaagcgtggagctggaccagctgcccgagcagcccctgttcctggccgccagcccccccgccagcagcaccagccccagccccgagcccgccgacgccgccggcagcggcaccggcttccagcccgtggccgtgccccccccccacggcgccgccagcagaggcggcgcccacctgaccgagagcgtggccgcccccgacagcggcgccagcagccccgccgccgccgagcccggcgagaagagagcccccgccgccgagcccagccccgccgccgcccccgccggcagagagatggagaacaaggagaccctgaagggcctgcacaagatggacgacagacccgaggagagaatgatcagagagaagctgaaggccacctgcatgcccgcctggaagcacgagtggctggagagaagaaacagaagaggccccgtggtggtgaagcccatccccgtgaagggcgacggcagcgagatgaaccacctggccgccgagagccccggcgaggtgcaggccagcgccgccagccccgccagcaagggcagaagaagccccagccccggcaacagccccagcggcagaaccgtgaagagcgagagccccggcgtgagaagaaagagagtgagccccgtgcccttccagagcggcagaatcaccccccccagaagagcccccagccccgacggcttcagcccctacagccccgaggagaccaacagaagagtgaacaaggtgatgagagccagactgtacctgctgcagcagatcggccccaacagcttcctgatcggcggcgacagccccgacaacaagtacagagtgttcatcggcccccagaactgcagctgcgccagaggcaccttctgcatccacctgctgttcgtgatgctgagagtgttccagctggagcccagcgaccccatgctgtggagaaagaccctgaagaacttcgaggtggagagcctgttccagaagtaccacagcagaagaagcagcagaatcaaggcccccagcagaaacaccatccagaagttcgtgagcagaatgagcaacagccacaccctgagcagcagcagcaccagcaccagcagcagcgagaacagcatcaaggacgaggaggagcagatgtgccccatctgcctgctgggcatgctggacgaggagagcctgaccgtgtgcgaggacggctgcagaaacaagctgcaccaccactgcatgagcatctgggccgaggagtgcagaagaaacagagagcccctgatctgccccctgtgcagaagcaagtggagaagccacgacttctacagccacgagctgagcagccccgtggacagccccagcagcctgagagccgcccagcagcagaccgtgcagcagcagcccctggccggcagcagaagaaaccaggagagcaacttcaacctgacccactacggcacccagcagatcccccccgcctacaaggacctggccgagccctggatccaggtgttcggcatggagctggtgggctgcctgttcagcagaaactggaacgtgagagagatggccctgagaagactgagccacgacgtgagcggcgccctgctgctggccaacggcgagagcaccggcaacagcggcggcagcagcggcagcagccccagcggcggcgccaccagcggcagcagccagaccagcatcagcggcgacgtggtggaggcctgctgcagcgtgctgagcatggtgtgcgccgaccccgtgtacaaggtgtacgtggccgccctgaagaccctgagagccatgctggtgtacaccccctgccacagcctggccgagagaatcaagctgcagagactgctgcagcccgtggtggacaccatcctggtgaagtgcgccgacgccaacagcagaaccagccagctgagcatcagcaccctgctggagctgtgcaagggccaggccggcgagctggccgtgggcagagagatcctgaaggccggcagcatcggcatcggcggcgtggactacgtgctgaactgcatcctgggcaaccagaccgagagcaacaactggcaggagctgctgggcagactgtgcctgatcgacagactgctgctggagttccccgccgagttctacccccacatcgtgagcaccgacgtgagccaggccgagcccgtggagatcagatacaagaagctgctgagcctgctgaccttcgccctgcagagcatcgacaacagccacagcatggtgggcaagctgagcagaagaatctacctgagcagcgccagaatggtgaccaccgtgccccacgtgttcagcaagctgctggagatgctgagcgtgagcagcagcacccacttcaccagaatgagaagaagactgatggccatcgccgacgaggtggagatcgccgaggccatccagctgggcgtggaggacaccctggacggccagcaggacagcttcctgcaggccagcgtgcccaacaactacctggagaccaccgagaacagcagccccgagtgcaccgtgcacctggagaagaccggcaagggcctgtgcgccaccaagctgagcgccagcagcgaggacatcagcgagagactggccagcatcagcgtgggccccagcagcagcaccaccaccaccaccaccaccaccgagcagcccaagcccatggtgcagaccaagggcagaccccacagccagtgcctgaacagcagccccctgagccaccacagccagctgatgttccccgccctgagcacccccagcagcagcacccccagcgtgcccgccggcaccgccaccgacgtgagcaagcacagactgcagggcttcatcccctgcagaatccccagcgccagcccccagacccagagaaagttcagcctgcagttccacagaaactgccccgagaacaaggacagcgacaagctgagccccgtgttcacccagagcagacccctgcccagcagcaacatccacagacccaagcccagcagacccacccccggcaacaccagcaagcagggcgaccccagcaagaacagcatgaccctggacctgaacagcagcagcaagtgcgacgacagcttcggctgcagcagcaacagcagcaacgccgtgatccccagcgacgagaccgtgttcacccccgtggaggagaagtgcagactggacgtgaacaccgagctgaacagcagcatcgaggacctgctggaggccagcatgcccagcagcgacaccaccgtgaccttcaagagcgaggtggccgtgctgagccccgagaaggccgagaacgacgacacctacaaggacgacgtgaaccacaaccagaagtgcaaggagaagatggaggccgaggaggaggaggccctggccatcgccatggccatgagcgccagccaggacgccctgcccatcgtgccccagctgcaggtggagaacggcgaggacatcatcatcatccagcaggacacccccgagaccctgcccggccacaccaaggccaagcagccctacagagaggacaccgagtggctgaagggccagcagatcggcctgggcgccttcagcagctgctaccaggcccaggacgtgggcaccggcaccctgatggccgtgaagcaggtgacctacgtgagaaacaccagcagcgagcaggaggaggtggtggaggccctgagagaggagatcagaatgatgagccacctgaaccaccccaacatcatcagaatgctgggcgccacctgcgagaagagcaactacaacctgttcatcgagtggatggccggcggcagcgtggcccacctgctgagcaagtacggcgccttcaaggagagcgtggtgatcaactacaccgagcagctgctgagaggcctgagctacctgcacgagaaccagatcatccacagagacgtgaagggcgccaacctgctgatcgacagcaccggccagagactgagaatcgccgacttcggcgccgccgccagactggccagcaagggcaccggcgccggcgagttccagggccagctgctgggcaccatcgccttcatggcccccgaggtgctgagaggccagcagtacggcagaagctgcgacgtgtggagcgtgggctgcgccatcatcgagatggcctgcgccaagcccccctggaacgccgagaagcacagcaaccacctggccctgatcttcaagatcgccagcgccaccaccgcccccagcatccccagccacctgagccccggcctgagagacgtggccctgagatgcctggagctgcagccccaggacagaccccccagcagagagctgctgaagcaccccgtgttcagaaccacctggtag

SEQ ID NO: 11567 - DNA, 2274 bp, Artificial Sequence
  Description of Artificial Sequence: Synthetic coding sequence
gccgacggcggcgacagccaggccttcagatgcaccagctgcggccacgccggcaccacccccgcccccagagaggccctgagccccgccgacgcccacgtgggcagaggcttcgccgagagagagcccatccccgcccagggcctgctggtgctggccgtgctgagcgacggcgccggcgaccacatcagacagagactgctgccccccctgctgcagatcgtgtgcaagggcctggaggaccccagccaggtggtgagaaacgccgccctgttcgccctgggccagttcagcgagaacctgcagccccacatcagcagctacagcagagaggtgatgcccctgctgctggcctacctgaagagcgtgcccctgggccacacccaccacctggccaaggcctgctacgccctggagaacttcgtggagaacctgggccccaaggtgcagccctacctgcccgagctgatggagtgcatgctgcagctgctgagaaaccccagcagccccagagccaaggagctggccgtgagcgccctgggcgccatcgccaccgccgcccaggccagcctgctgccctacttccccgccatcatggagcacctgagagagttcctgctgaccggcagagaggacctgcagcccgtgcagatccagagcctggagaccctgggcgtgctggccagagccgtgggcgagcccatgagacccctggccgaggagtgctgccagctgggcctgggcctgtgcgaccaggtggacgaccccgacctgagaagatgcacctacagcctgttcgccgccctgagcggcctgatgggcgagggcctggccccccacctggagcagatcaccaccctgatgctgctgagcctgagaagcaccgagggcatcgtgccccagtacgacggcagcagcagcttcctgctgttcgacgacgagagcgacggcgaggaggaggaggagctgatggacgaggacgtggaggaggaggacgacagcgagatcagcggctacagcgtggagaacgccttcttcgacgagaaggaggacacctgcgccgccgtgggcgagatcagcgtgaacaccagcgtggccttcctgccctacatggagagcgtgttcgaggaggtgttcaagctgctggagtgcccccacctgaacgtgagaaaggccgcccacgaggccctgggccagttctgctgcgccctgcacaaggcctgccagagctgccccagcgagcccaacaccgccgccctgcaggccgccctggccagagtggtgcccagctacatgcaggccgtgaacagagagagagagagacaggtggtgatggccgtgctggaggccctgaccggcgtgctgagaagctgcggcaccctgaccctgaagccccccggcagactggccgagctgtgcggcgtgctgaaggccgtgctgcagagaaagaccgcctgccaggacaccgacgaggaggaggaggaggaggacgacgaccaggccgagtacgacgccatgctgctggagcacgccggcgaggccatccccgccctggccgccgccgccggcggcgacagcttcgcccccttcttcgccggcttcctgcccctgctggtgtgcaagaccaagcagggctgcaccgtggccgagaagagcttcgccgtgggcaccctggccgagaccatccagggcctgggcgccgccagcgcccagttcgtgagcagactgctgcccgtgctgctgagcaccgcccaggaggccgaccccgaggtgagaagcaacgccatcttcggcatgggcgtgctggccgagcacggcggccaccccgcccaggagcacttccccaagctgctgggcctgctgttccccctgctggccagagagagacacgacagagtgagagacaacatctgcggcgccctggccagactgctgatggccagccccaccagaaagcccgagccccaggtgctggccgccctgctgcacgccctgcccctgaaggaggacctggaggagtgggtgaccatcggcagactgttcagcttcctgtaccagagcagccccgaccaggtgatcgacgtggcccccgagctgctgagaatctgcagcctgatcctggccgacaacaagatcccccccgacaccaaggccgccctgctgctgctgctgaccttcctggccaagcagcacaccgacagcttccaggccgccctgggcagcctgcccgtggacaaggcccaggagctgcaggccgtgctgggcctgagctag

SEQ ID NO: 11568 - DNA, 1812 bp, Artificial Sequence
  Description of Artificial Sequence: Synthetic coding sequence
atgggcgtgatccccgagggccccctgtgggtgagcggcagcgacgacaacctgagcggcaccagcggcatggaggtggacgacagagtgagcgccctggagcagagactgcagctgcaggaggacgagctggccgtgctgaaggccgccctggccgacgccctgagaagactgagagcctgcgaggagcagggcgccgccctgagagccagaggcacccccaagggcagagccccccccagactgggcaccaccgccagcgtgtgccagctgctgaagggcctgcccaccagaacccccctgaacggcagcggcccccccagaagagtgggcggctacgccaccagccccagcagccccaagaaggaggccaccagcggcagaagcagcgtgagaagatacctgagccccgagagactggccagcgtgagaagagaggaccccagaagcagaaccaccagcagcagcagcaactgcagcgccaagaaggagggcaagaccaaggaggtgatcttcagcgtggaggacggcagcgtgaagatgttcctgagaggcagacccgtgcccatgatgatccccgacgagctggcccccacctacagcctggacaccagaagcgagctgcccagctgcagactgaagctggagtgggtgtacggctacagaggcagagactgcagagccaacctgtacctgctgcccaccggcgagatcgtgtacttcgtggccagcgtggccgtgctgtacagcgtggaggagcagagacagagacactacctgggccacaacgacgacatcaagtgcctggccatccaccccgacatggtgaccatcgccaccggccaggtggccggcaccaccaaggagggcaagcccctgcccccccacgtgagaatctgggacagcgtgagcctgagcaccctgcacgtgctgggcctgggcgtgttcgacagagccgtgtgctgcgtgggcttcagcaagagcaacggcggcaacctgctgtgcgccgtggacgagagcaacgaccacatgctgagcgtgtgggactgggccaaggagaccaaggtggtggacgtgaagtgcagcaacgaggccgtgctggtggccaccttccaccccaccgaccccaccgtgctgatcacctgcggcaagagccacatctacttctggaccctggagggcggcagcctgagcaagagacagggcctgttcgagaagcacgagaagcccaagtacgtgctgtgcgtgaccttcctggagggcggcgacgtggtgaccggcgacagcggcggcaacctgtacgtgtggggcaagggcggcaacagaatcacccaggccgtgctgggcgcccacgacggcggcgtgttcggcctgtgcgccctgagagacggcaccctggtgagcggcggcggcagagacagaagagtggtgctgtggggcagcgactacagcaagctgcaggaggtggaggtgcccgaggacttcggccccgtgagaaccgtggccgagggccacggcgacaccctgtacgtgggcaccaccagaaacagcatcctgcagggcagcgtgcacaccggcttcagcctgctggtgcagggccacgtggaggagctgtggggcctggccacccaccccagcagagcccagttcgtgacctgcggccaggacaagctggtgcacctgtggagcagcgacagccaccagcccctgtggagcagaatcatcgaggtggagagcagaagcgtgacccaggccggcggccagtggcacgacctgggcagcctgcagccccccccccccggcttcaagtag

SEQ ID NO: 11569 - DNA, 996 bp, Artificial Sequence
  Description of Artificial Sequence: Synthetic coding sequence
atggccgagggcggcggccccgagcccggcgagcaggagagaagaagcagcggccccagaccccccagcgccagagacctgcagctggccctggccgagctgtacgaggacgaggtgaagtgcaagagcagcaagagcaacagacccaaggccaccgtgttcaagagccccagaacccccccccagagattctacagcagcgagcacgagtacagcggcctgaacatcgtgagacccagcaccggcaagatcgtgaacgagctgttcaaggaggccagagagcacggcgccgtgcccctgaacgaggccaccagagccagcggcgacgacaagagcaagagcttcaccggcggcggctacagactgggcagcagcttctgcaagagaagcgagtacatctacggcgagaaccagctgcaggacgtgcagatcctgctgaagctgtggagcaacggcttcagcctggacgacggcgagctgagaccctacaacgagcccaccaacgcccagttcctggagagcgtgaagagaggcgagatccccctggagctgcagagactggtgcacggcggccaggtgaacctggacatggaggaccaccaggaccaggagtacatcaagcccagactgagattcaaggccttcagcggcgagggccagaagctgggcagcctgacccccgagatcgtgagcacccccagcagccccgaggaggaggacaagagcatcctgaacgccgtggtgctgatcgacgacagcgtgcccaccaccaagatccagatcagactggccgacggcagcagactgatccagagattcaacagcacccacagaatcctggacgtgagaaacttcatcgtgcagagcagacccgagttcgccgccctggacttcatcctggtgaccagcttccccaacaaggagctgaccgacgagagcctgaccctgctggaggccgacatcctgaacaccgtgctgctgcagcagctgaagtag

SEQ ID NO: 11570 - DNA, 2064 bp, Artificial Sequence
  Description of Artificial Sequence: Synthetic coding sequence
atggacggcggcgccctgaccgacaccagcctgaccgacagctacttcagcaccagcttcatcggcgtgaacggcttcggcagccccgtggagaccaagtaccccctgatgcagagaatgaccaacagcagcagcagccccagcctgctgaacgacagcgccaagccctacagcgcccacgaccccctgaccagccccgccagcagcctgttcaacgacttcggcgccctgaacatcagccagagaagaaagacccccaaccccaccgccagcgagttcatccccaagggcggcagcaccagcagactgagcaacgtgagccagagcaacatgagcgccttcagccaggtgttcagccaccccagcatgggcagccccgccaccgccggcctggcccccggcatgagcctgagcgccggcagcagccccctgcacagccccaagatcaccccccacaccagccccgcccccagaagaagaagccacacccccaaccccgccagctacatggtgcccagcagcgccagcaccagcgtgaacaaccccgtgagccagacccccagcagcggccaggtgatccagaaggagaccgtgggcggcaccacctacttctacaccgacaccacccccgcccccctgaccggcatggtgttccccaactaccacatctacccccccaccgccccccacgtggcctacatgcagcccaaggccaacgcccccagcttcttcatggccgacgagctgagacaggagctgatcaacagacacctgatcaccatggcccagatcgaccaggccgacatgcccgccgtgcccaccgaggtggacagctaccacagcctgttccccctggagcccctgcccccccccaacagaatccagaagagcagcaacttcggctacatcaccagctgctacaaggccgtgaacagcaaggacgacctgccctactgcctgagaagaatccacggcttcagactggtgaacaccaagtgcatggtgctggtggacatgtggaagaagatccagcacagcaacatcgtgaccctgagagaggtgttcaccaccaaggccttcgccgagcccagcctggtgttcgcctacgacttccacgccggcggcgagaccatgatgagcagacacttcaacgaccccaacgccgacgcctacttcaccaagagaaagtggggccagcacgagggccccctgcccagacagcacgccggcctgctgcccgagagcctgatctgggcctacatcgtgcagctgagcagcgccctgagaaccatccacaccgccggcctggcctgcagagtgatggaccccaccaagatcctgatcaccggcaagaccagactgagagtgaactgcgtgggcgtgttcgacgtgctgaccttcgacaacagccagaacaacaaccccctggccctgatggcccagtaccagcaggccgacctgatcagcctgggcaaggtggtgctggccctggcctgcaacagcctggccggcatccagagagagaacctgcagaaggccatggagctggtgaccatcaactacagcagcgacctgaagaacctgatcctgtacctgctgaccgaccagaacagaatgagaagcgtgaacgacatcatgcccatgatcggcgccagattctacacccagctggacgccgcccagatgagaaacgacgtgatcgaggaggacctggccaaggaggtgcagaacggcagactgttcagactgctggccaagctgggcaccatcaacgagagacccgagttccagaaggaccccacctggagcgagaccggcgacagatacctgctgaagctgttcagagaccacctgttccaccaggtgaccgaggccggcgccccctggatcgacctgagccacatcatcagctgcctgaacaagctggacgccggcgtgcccgagaagatcagcctgatcagcagagacgagaagagcgtgctggtggtgacctacagcgacctgaagagatgcttcgagaacaccttccaggagctgatcgccgccgccaacggccagctgtag

SEQ ID NO: 11571 - DNA, 6951 bp, Artificial Sequence
  Description of Artificial Sequence: Synthetic coding sequence
atggacggcgtgagcagcgaggccaacgaggagaacgacaacatcgagagacccgtgagaagaagacacagcagcatcctgaagccccccagaagccccctgcaggacctgagaggcggcaacgagagagtgcaggagagcaacgccctgagaaacaagaagaacagcagaagagtgagcttcgccgacaccatcaaggtgttccagaccgagagccacatgaagatcgtgagaaagagcgagatggaggagaccgagaccggcgagaacctgctgctgatccagaacaagaagctggaggacaactactgcgagatcaccggcatgaacaccctgctgagcgcccccatccacacccagatgcagcagaaggagttcagcatcatcgagcacaccagagagagaaagcacgccaacgaccagaccgtgatcttcagcgacgagaaccagatggacctgaccagcagccacaccgtgatgatcaccaagggcctgctggacaaccccatcagcgagaagagcaccaagatcgacaccaccagcttcctggccaacctgaagctgcacaccgaggacagcagaatgaagaaggaggtgaacttcagcgtggaccagaacaccagcagcgagaacaagatcgacttcaacgacttcatcaagagactgaagaccggcaagtgcagcgccttccccgacgtgcccgacaaggagaacttcgagatccccatctacagcaaggagcccaacagcgccagcagcacccaccagatgcacgtgagcctgaaggaggacgagaacaacagcaacatcaccagactgttcagagagaaggacgacggcatgaacttcacccagtgccacaccgccaacatccagaccctgatccccaccagcagcgagaccaacagcagagagagcaagggcaacgacatcaccatctacggcaacgacttcatggacctgaccttcaaccacaccctgcagatcctgcccgccaccggcaacttcagcgagatcgagaaccagacccagaacgccatggacgtgaccaccggctacggcaccaaggccagcggcaacaagaccgtgttcaagagcaagcagaacaccgccttccaggacctgagcatcaacagcgccgacaagatccacatcaccagaagccacatcatgggcgccgagacccacatcgtgagccagacctgcaaccaggacgccagaatcctggccatgacccccgagagcatctacagcaaccccagcatccagggctgcaagaccgtgttctacagcagctgcaacgacgccatggagatgaccaagtgcctgagcaacatgagagaggagaagaacctgctgaagcacgacagcaactacgccaagatgtactgcaaccccgacgccatgagcagcctgaccgagaagaccatctacagcggcgaggagaacatggacatcaccaagagccacaccgtggccatcgacaaccagatcttcaagcaggaccagagcaacgtgcagatcgccgccgcccccacccccgagaaggagatgatgctgcagaacctgatgaccaccagcgaggacggcaagatgaacgtgaactgcaacagcgtgccccacgtgagcaaggagagaatccagcagagcctgagcaaccccctgagcatcagcctgaccgacagaaagaccgagctgctgagcggcgagaacatggacctgaccgagagccacaccagcaacctgggcagccaggtgcccctggccgcctacaacctggcccccgagagcaccagcgagagccacagccagagcaagagcagcagcgacgagtgcgaggagatcaccaagagcagaaacgagcccttccagagaagcgacatcatcgccaagaacagcctgaccgacacctggaacaaggacaaggactgggtgctgaagatcctgccctacctggacaaggacagcccccagagcgccgactgcaaccaggagatcgccaccagccacaacatcgtgtactgcggcggcgtgctggacaagcagatcaccaacagaaacaccgtgagctgggagcagagcctgttcagcaccaccaagcccctgttcagcagcggccagttcagcatgaagaaccacgacaccgccatcagcagccacaccgtgaagagcgtgctgggccagaacagcaagctggccgagcccctgagaaagagcctgagcaaccccacccccgactactgccacgacaagatgatcatctgcagcgaggaggagcagaacatggacctgaccaagagccacaccgtggtgatcggcttcggccccagcgagctgcaggagctgggcaagaccaacctggagcacaccaccggccagctgaccaccatgaacagacagatcgccgtgaaggtggagaagtgcggcaagagccccatcgagaagagcggcgtgctgaagagcaactgcatcatggacgtgctggaggacgagagcgtgcagaagcccaagttccccaaggagaagcagaacgtgaagatctggggcagaaagagcgtgggcggccccaagatcgacaagaccatcgtgttcagcgaggacgacaagaacgacatggacatcaccaagagctacaccatcgagatcaaccacagacccctgctggagaagagagactgccacctggtgcccctggccggcaccagcgagaccatcctgtacacctgcagacaggacgacatggagatcaccagaagccacaccaccgccctggagtgcaagaccgtgagccccgacgagatcaccaccagacccatggacaagaccgtggtgttcgtggacaaccacgtggagctggagatgaccgagagccacaccgtgttcatcgactaccaggagaaggagagaaccgacagacccaacttcgagctgagccagagaaagagcctgggcacccccaccgtgatctgcacccccaccgaggagagcgtgttcttccccggcaacggcgagagcgacagactggtggccaacgacagccagctgacccccctggaggagtggagcaacaacagaggccccgtggaggtggccgacaacatggagctgagcaagagcgccacctgcaagaacatcaaggacgtgcagagccccggcttcctgaacgagcccctgagcagcaagagccagagaagaaagagcctgaagctgaagaacgacaagaccatcgtgttcagcgagaaccacaagaacgacatggacatcacccagagctgcatggtggagatcgacaacgagagcgccctggaggacaaggaggacttccacctggccggcgccagcaagaccatcctgtacagctgcggccaggacgacatggagatcaccagaagccacaccaccgccctggagtgcaagaccctgctgcccaacgagatcgccatcagacccatggacaagaccgtgctgttcaccgacaactacagcgacctggaggtgaccgacagccacaccgtgttcatcgactgccaggccaccgagaagatcctggaggagaaccccaagttcggcatcggcaagggcaagaacctgggcgtgagcttccccaaggacaacagctgcgtgcaggagatcgccgagaagcaggccctggccgtgggcaacaagatcgtgctgcacaccgagcagaagcagcagctgttcgccgccaccaacagaaccaccaacgagatcatcaagttccacagcgccgccatggacgagaaggtgatcggcaaggtggtggaccaggcctgcaccctggagaaggcccaggtggagagctgccagctgaacaacagagacagaagaaacgtggacttcaccagcagccacgccaccgccgtgtgcggcagcagcgacaactacagctgcctgcccaacgtgatcagctgcaccgacaacctggagggcagcgccatgctgctgtgcgacaaggacgaggagaaggccaactactgccccgtgcagaacgacctggcctacgccaacgacttcgccagcgagtactacctggagagcgagggccagcccctgagcgccccctgccccctgctggagaaggaggaggtgatccagaccagcaccaagggccagctggactgcgtgatcaccctgcacaaggaccaggacctgatcaaggaccccagaaacctgctggccaaccagaccctggtgtacagccaggacctgggcgagatgaccaagctgaacagcaagagagtgagcttcaagctgcccaaggaccagatgaaggtgtacgtggacgacatctacgtgatcccccagccccacttcagcaccgaccagccccccctgcccaagaagggccagagcagcatcaacaaggaggaggtgatcctgagcaaggccggcaacaagagcctgaacatcatcgagaacagcagcgcccccatctgcgagaacaagcccaagatcctgaacagcgaggagtggttcgccgccgcctgcaagaaggagctgaaggagaacatccagaccaccaactacaacaccgccctggacttccacagcaacagcgacgtgaccaagcaggtgatccagacccacgtgaacgccggcgaggcccccgaccccgtgatcaccagcaacgtgccctgcttccacagcatcaagcccaacctgaacaacctgaacggcaagaccggcgagttcctggccttccagaccgtgcacctgccccccctgcccgagcagctgctggagctgggcaacaaggcccacaacgacatgcacatcgtgcaggccaccgagatccacaacatcaacatcatcagcagcaacgccaaggacagcagagacgaggagaacaagaagagccacaacggcgccgagaccaccagcctgccccccaagaccgtgttcaaggacaaggtgagaagatgcagcctgggcatcttcctgcccagactgcccaacaagagaaactgcagcgtgaccggcatcgacgacctggagcagatccccgccgacaccaccgacatcaaccacctggagacccagcccgtgagcagcaaggacagcggcatcggcagcgtggccggcaagctgaacctgagccccagccagtacatcaacgaggagaacctgcccgtgtaccccgacgagatcaacagcagcgacagcatcaacatcgagaccgaggagaaggccctgatcgagacctaccagaaggagatcagcccctacgagaacaagatgggcaagacctgcaacagccagaagagaacctgggtgcaggaggaggaggacatccacaaggagaagaagatcagaaagaacgagatcaagttcagcgacaccacccaggacagagagatcttcgaccaccacaccgaggaggacatcgacaagagcgccaacagcgtgctgatcaagaacctgagcagaacccccagcagctgcagcagcagcctggacagcatcaaggccgacggcaccagcctggacttcagcacctacagaagcagccagatggagagccagttcctgagagacaccatctgcgaggagagcctgagagagaagctgcaggacggcagaatcaccatcagagagttcttcatcctgctgcaggtgcacatcctgatccagaagcccagacagagcaacctgcccggcaacttcaccgtgaacaccccccccacccccgaggacctgatgctgagccagtacgtgtacagacccaagatccagatctacagagaggactgcgaggccagaagacagaagatcgaggagctgaagctgagcgccagcaaccaggacaagctgctggtggacatcaacaagaacctgtgggagaagatgagacactgcagcgacaaggagctgaaggccttcggcatctacctgaacaagatcaagagctgcttcaccaagatgaccaaggtgttcacccaccagggcaaggtggccctgtacggcaagctggtgcagagcgcccagaacgagagagagaagctgcagatcaagatcgacgagatggacaagatcctgaagaagatcgacaactgcctgaccgagatggagaccgagaccaagaacctggaggacgaggagaagaacaaccccgtggaggagtgggacagcgagatgagagccgccgagaaggagctggagcagctgaagaccgaggaggaggagctgcagagaaacctgctggagctggaggtgcagaaggagcagaccctggcccagatcgacttcatgcagaagcagagaaacagaaccgaggagctgctggaccagctgagcctgagcgagtgggacgtggtggagtggagcgacgaccaggccgtgttcaccttcgtgtacgacaccatccagctgaccatcaccttcgaggagagcgtggtgggcttccccttcctggacaagagatacagaaagatcgtggacgtgaacttccagagcctgctggacgaggaccaggccccccccagcagcctgctggtgcacaagctgatcttccagtacgtggaggagaaggagagctggaagaagacctgcaccacccagcaccagctgcccaagatgctggaggagttcagcctggtggtgcaccactgcagactgctgggcgaggagatcgagtacctgaagagatggggccccaactacaacctgatgaacatcgacatcaacaacaacgagctgagactgctgttcagcagcagcgccgccttcgccaagttcgagatcaccctgttcctgagcgcctactaccccagcgtgcccctgcccagcaccatccagaaccacgtgggcaacaccagccaggacgacatcgccaccatcctgagcaaggtgcccctggagaacaactacctgaagaacgtggtgaagcagatctaccaggacctgttccaggactgccacttctaccactag

SEQ ID NO: 11572 - DNA, 714 bp, Artificial Sequence
  Description of Artificial Sequence: Synthetic coding sequence
atgggctgctgcggctgcagcggcggctgcggcagcggctgcggcggcagaggcagcggctgcggcggctgcggcagcggctgcggcggctgcggcagcggctgcggcggctgcggcagcggctgcggcggctgcggcggctgcggcagcggctgcgccggctgcggcggctgcggcagcggctgctgcgtgcccgtgtgctgctgcaagcccatgtgctgctgcgtgcccgcctgcagctgcagcagctgcggcaagggcggctgcggcagctgcggcggcagcaagagaggctgcgtgagctgcggcgtgagcaagggcgcctgcggcagctgcggcggcagcaagggcggctgcggcagctgcggcggcagcaagggcggctgcggcagctgcggcggcagcaagggcggctgcggcagctgcggcggcagcaagggcggctgcggcagctacggctgcagccagagcagctgctgcaagccctgctgctgcagcagcggctgcggcagcagctgctgccagagcagctgctgcaagccctactgctgccagagcagctgctgcaagccctactgctgccagagcagctgctgcaagccctgcagctgcttcagcggctgcggcagcagctgctgccagagcagctgctacaagccctgctgctgccagagcagctgctgcgtgcccgtgtgctgccagtgcaagatctag

SEQ ID NO: 11573 - DNA, 717 bp, Artificial Sequence
  Description of Artificial Sequence: Synthetic coding sequence
atgggctgcagcggctgcagcggcggctgcggcagcagctgcggcggctgcggcagcagctgcggcggctgcggcagcggctacggcggctgcggcagcggctgctgcgtgcccgtgtgctgctgcaagcccgtgtgctgctgcgtgcccgcctgcagctgcagcagctgcggcagctgcggcggcagcaagggcgtgtgcggcagctgcggcggctgcaagggcggctgcggcagctgcggcggcagcaagggcggctgcggcagcagctgctgcgtgcccgtgtgctgcagcagcagctgcggcagctgcggcggcagcaagggcgtgtgcggcttcagaggcggcagcaagggcggctgcggcagctgcggctgcagccagtgcagctgctacaagccctgctgctgcagcagcggctgcggcagcagctgctgccagagcagctgctgcaagcccagctgcagccagagcagctgctgcaagccctgctgcagccagagcagctgctgcaagccctgctgctgcagcagcggctgcggcagcagctgctgccagagcagctgctgcaagccctgctgcagccagagcagctgctgcaagccctgctgctgcagcagcggctgcggcagcagctgctgccagagcagctgctgcaagccctgcagcagccagagcagctgctgcgtgcccatctgctgccagtgcaagatctag

SEQ ID NO: 11574 - DNA, 1473 bp, Artificial Sequence; identical to SEQ ID NO: 9885
  Description of Artificial Sequence: Synthetic coding sequence

SEQ ID NO: 11575 - DNA, 5826 bp, Artificial Sequence
  Description of Artificial Sequence: Synthetic coding sequence
ctgctgaccagcgtgctgatgcccagcttcggctacttcatcagaagccccgagaagagagagcccatcgccctgatcagaaagagcgacgtgagcagaggcaacctggagaaggagatggcccacctgaaccacgacctgtacagcggcgacctgaacgagcagagccaggcccagctgagcgagggcagcatcaccctgcaggtggaggccgtggagagcaccagccaggtggacgagaacgacgtgaccctgaccgccgacaagggcaagaccgaggacaccttcttcatgagcaacaagccccagagatacaaggacaagctgcccgacagcggcgacagcatgctgagaatcagcaccatcgccagcgccatcgccgaggccagcgtgaacaccgaccccagccagctggccgccatgatcaaggccctgagcaacaagaccagagacaagaccttccaggaggacgagaagcagaaggactacagccacgtgagacacttcctgcccaacgacctggagaagagcaacggcagcaacgccctggacatggagaagtacctgaagaagaccgaggtgagcagatacgagagcgccctggagaacttcagcagagccagcatgagcgacacctgggacctgagcctgcccaaggagcagaccacccaggacatccaccccgtggacctgagcgccaccagcgtgagcgtgagagcccccgaggagaacaccgccgccatcgtgtacgtggagaacggcgagagcgagaaccaggagagcttcagaaccatcaacagcagcaacagcgtgaccaacagagagaacaacagcgccgtggtggacgtgaagacctgcagcatcgacaacaagctgcaggacgtgggcaacgacgagaaggccaccagcatcagcacccccagcgacagctacagcagcgtgagaaaccccagaatcaccagcctgtgcctgctgaaggactgcgaggagatcagagacaacagagagaaccagagacagaacgagtgcgtgagcgagatcagcaacagcgagaagcacgtgaccttcgagaaccacagaatcgtgagccccaagaacagcgacctgaagaacaccagccccgagcacggcggcagaggcagcgaggacgagcaggagagcttcagacccagcaccagccccctgagccacagcagccccagcgagatcagcggcaccagcagcagcggctgcgccctggagagcttcggcagcgccgcccagcagcagcagcccccctgcgagcaggagctgagccccctggtgtgcagccccgccggcgtgagcagactgacctacgtgagcgagcccgagagcagctaccccaccaccgccaccgacgacgccctggaggacagaaagagcgacatcaccagcgagctgagcaccaccatcatccagggcagccccgccgccctggaggagagagccatggagaagctgagagagaaggtgcccttccagaacagaggcaagggcaccctgagcagcatcatccagaacaacagcgacaccagaaaggccaccgagaccaccagcctgagcagcaagcccgagtacgtgaagcccgacttcagatggagcaaggaccccagcagcaagagcggcaacctgctggagaccagcgaggtgggctggaccagcaaccccgaggagctggaccccatcagactggccctgctgggcaagagcggcctgagctgccaggtgggcagcgccaccagccaccccgtgagctgccaggagcccatcgacgaggaccagagaatcagccccaaggacaagagcaccgccggcagagagttcagcggccaggtgagccaccagaccaccagcgagaaccagtgcacccccatccccagcagcaccgtgcacagcagcgtggccgacatgcagaacatgcccgccgccgtgcacgccctgctgacccagcccagcctgagcgccgcccccttcgcccagagatacctgggcaccctgcccagcaccggcagcaccaccctgccccagtgccacgccggcaacgccaccgtgtgcggcttcagcggcggcctgccctaccccgccgtggccggcgagcccgtgcagaacagcgtggccgtgggcatctgcctgggcagcaacatcggcagcggctggatgggcaccagcagcctgtgcaacccctacagcaacaccctgaaccagaacctgctgagcaccaccaagcccttccccgtgcccagcgtgggcaccaactgcggcatcgagccctgggacagcggcgtgaccagcggcctgggcagcgtgagagtgcccgaggagctgaagctgccccacgcctgctgcgtgggcatcgccagccagaccctgctgagcgtgctgaaccccaccgacagatggctgcaggtgagcatcggcgtgctgagcatcagcgtgaacggcgagaaggtggacctgagcacctacagatgcctggtgttcaagaacaaggccatcatcagaccccacgccaccgaggagatcaaggtgctgttcatccccagcagccccggcgtgttcagatgcaccttcagcgtggccagctggccctgcagcaccgacgccgagaccatcgtgcaggccgaggccctggccagcaccgtgaccctgaccgccatcgccgagagccccgtgatcgaggtggagaccgagaagaaggacgtgctggacttcggcgacctgacctacggcggctggaaggccctgcccctgaagctgatcaacagaacccacgccaccgtgcccatcagactgatcatcaacgccaacgccgtggcctggagatgcttcaccttcagcaaggagagcgtgagagcccccgtggaggtggccccctgcgccgacgtggtgaccagactggccggccccagcgtggtgaaccacatgatgcccgccagctacgacggccaggaccccgagttcctgatgatctgggtgctgttccacagccccaagaagcagatcagcagcagcgacatcctggacagcgccgaggagttcagcgccaaggtggacatcgaggtggacagccccaaccccacccccgtgctgagaagcgtgagcctgagagccagagccggcatcgccagaatccacgcccccagagacctgcagaccatgcacttcctggccaaggtggccagcagcagaaagcagcacctgcccctgaagaacgccggcaacatcgaggtgtacctggacatcaaggtgcccgagcagggcagccacttcagcgtggaccccaagaacctgctgctgaagcccggcgaggagcacgaggtgatcgtgagcttcacccccaaggaccccgaggcctgcgaggagagaatcctgaagatcttcgtgcagcccttcggcccccagtacgaggtggtgctgaagggcgaggtgatcagcagcggcagcaagcccctgagccccggcccctgcctggacatccccagcatcctgagcaacaagcagttcctggcctggggcggcgtgcccctgggcagaacccagctgcagaagctggccctgagaaacaacagcgccagcaccacccagcacctgagactgctgatcagaggccaggaccaggactgcttccagctgcagaacaccttcggcagcgagcagagactgaccagcaactgcgagatcagaatccaccccaaggaggacatcttcatcagcgtgctgttcgcccccaccagactgagctgcatgctggccagactggagatcaagcagctgggcaacagaagccagcccggcatcaagttcaccatccccctgagcggctacggcggcaccagcaacctgatcctggagggcgtgaagaagctgagcgacagctacatggtgaccgtgaacggcctggtgcccggcaaggagagcaagatcgtgttcagcgtgagaaacaccggcagcagagccgccttcgtgaaggccgtgggcttcaaggacagccagaagaaggtgctgctggaccccaaggtgctgagaatcttccccgacaagttcgtgctgaaggagagaacccaggagaacgtgaccctgatctacaaccccagcgacagaggcatcaacaacaagaccgccaccgagctgagcaccgtgtacctgttcggcggcgacgagatcagcagacagcagtacagaagagccctgctgcacaagcccgagatgatcaagcagatcctgcccgagcacagcgtgctgcagaacatcaacttcgtggaggccttccaggacgagctgctggtgaccgaggtgtacgacctgccccagagacccaacgacgtgcagctgttctacggcagcatgtgcaagatcatcctgagcgtgatcggcgagttcagagactgcatcagcagcagagagttcctgcagcccagcagcaaggccagcctggagagcaccagcgacctgggcgccagcggcaagcacggcggcaacgtgagcctggacgtgctgcccgtgaagggcccccagggcagccccctgctgagcagagccgccagaccccccctggaccagctggccagcgaggagccctggaccgtgctgcccgagcacctgatcctggtggcccccagcccctgcgacatggccaagaccggcagattccagatcgtgaacaacagcgtgagactgctgagattcgagctgtgctggcccgcccactgcctgaccgtgaccccccagcacggctgcgtggcccccgagagcaagctgcagatcctggtgagccccaacagcagcctgagcaccaagcagagcatgttcccctggagcggcctgatctacatccactgcgacgacggccagaagaagatcgtgaaggtgcagatcagagaggacctgacccaggtggagctgctgaccagactgaccagcaagcccttcggcatcctgagccccgtgagcgagcccagcgtgagccacctggtgaagcccatgaccaagccccccagcaccaaggtggagatcagaaacaagagcatcaccttccccaccaccgagcccggcgagaccagcgagagctgcctggagctggagaaccacggcaccaccgacgtgaagtggcacctgagcagcctggcccccccctacgtgaagggcgtggacgagagcggcgacgtgttcagagccacctacgccgccttcagatgcagccccatcagcggcctgctggagagccacggcatccagaaggtgagcatcaccttcctgcccagaggcagaggcgactacgcccagttctgggacgtggagtgccaccccctgaaggagccccacatgaagcacaccctgagattccagctgagcggccagagcatcgaggccgagaacgagcccgagaacgcctgcctgagcaccgacagcctgatcaagatcgaccacctggtgaagcccagaagacaggccgtgagcgaggccagcgccagaatccccgagcagctggacgtgaccgccagaggcgtgtacgcccccgaggacgtgtacagattcagacccaccagcgtgggcgagagcagaaccctgaaggtgaacctgagaaacaacagcttcatcacccacagcctgaagttcctgagccccagagagcccttctacgtgaagcacagcaagtacagcctgagagcccagcactacatcaacatgcccgtgcagttcaagcccaagagcgccggcaagttcgaggccctgctggtgatccagaccgacgagggcaagagcatcgccatcagactgatcggcgaggccctgggcaagaactag

SEQ ID NO: 11576 - DNA, 111 bp, Artificial Sequence
  Description of Artificial Sequence: Synthetic coding sequence
atgtgctactacggcaactactacggcggctacggctacggcggcctgggctgcggctacggcagctgctgcggctgcggcttcagaagactgggctgcggctacggctag

SEQ ID NO: 11577 - DNA, 528 bp, Artificial Sequence
  Description of Artificial Sequence: Synthetic coding sequence
atgagctacaactgctgcagcggcaacttcagcagcagaagctgcggcgactacctgagataccccgccagcagcagaggcttcagctaccccagcaacctggtgtacagcaccgacctgtgcagccccagcacctgccagctgggcagcagcctgtacagaggctgccaggagatctgctgggagcccaccagctgccagaccagctacgtggagagcagcccctgccagaccagctgctacagacccagaaccagcctgctgtgcagcccctgcaagaccacctacagcggcagcctgggcttcggcagcagcagctgcagaagcctgggctacggcagcagaagctgctacagcgtgggctgcggcagcagcggcgtgagaagcctgggctacggcagctgcggcttccccagcctgggctacggcagcggcttctgcagacccacctacctggccagcagaagctgccagagcccctgctacagacccgcctacggcagcaccttctgcagaagcacctgctag

SEQ ID NO: 11578 - DNA, 324 bp, Artificial Sequence
  Description of Artificial Sequence: Synthetic coding sequence
atgggcaagaagagaaccaagggcaagaccgtgcccatcgacgacagcagcgagaccctggagcccgtgtgcagacacatcagaaagggcctggagcagggcaacctgaagaaggccctggtgaacgtggagtggaacatctgccaggactgcaagaccgacaacaaggtgaaggacaaggccgaggaggagaccgaggagaagcccagcgtgtggctgtgcctgaagtgcggccaccagggctgcggcagaaacagccaggagcagcacgccctgaagcactacctgacccccagaagcgagccccactgcctggtgctgtag

SEQ ID NO: 11579 - DNA, 2469 bp, Artificial Sequence
  Description of Artificial Sequence: Synthetic coding sequence
atgggcaagaagagaaccaagggcaagaccgtgcccatcgacgacagcagcgagaccctggagcccgtgtgcagacacatcagaaagggcctggagcagggcaacctgaagaaggccctggtgaacgtggagtggaacatctgccaggactgcaagaccgacaacaaggtgaaggacaaggccgaggaggagaccgaggagaagcccagcgtgtggctgtgcctgaagtgcggccaccagggctgcggcagaaacagccaggagcagcacgccctgaagcactacctgacccccagaagcgagccccactgcctggtgctgagcctggacaactggagcgtgtggtgctacgtgtgcgacaacgaggtgcagtactgcagcagcaaccagctgggccaggtggtggactacgtgagaaagcaggccagcatcaccacccccaagcccgagaaggacaacggcaacatcgagctggagaacaagaagctggagaaggagagcaagaacgagcaggagagagagaagaaggagaacatggccaaggagaacccccccatgaacagcccctgccagatcaccgtgaagggcctgagcaacctgggcaacacctgcttcttcaacgccgtgatgcagaacctgagccagacccccgtgctgagagagctgctgaaggaggtgaagatgagcggcaccatcgtgaagatcgagccccccgacctggccctgaccgagcccctggagatcaacctggagccccccggccccctgaccctggccatgagccagttcctgaacgagatgcaggagaccaagaagggcgtggtgacccccaaggagctgttcagccaggtgtgcaagaaggccgtgagattcaagggctaccagcagcaggacagccaggagctgctgagatacctgctggacggcatgagagccgaggagcaccagagagtgagcaagggcatcctgaaggccttcggcaacagcaccgagaagctggacgaggagctgaagaacaaggtgaaggactacgagaagaagaagagcatgcccagcttcgtggacagaatcttcggcggcgagctgaccagcatgatcatgtgcgaccagtgcagaaccgtgagcctggtgcacgagagcttcctggacctgagcctgcccgtgctggacgaccagagcggcaagaagagcgtgaacgacaagaacctgaagaagaccgtggaggacgaggaccaggacagcgaggaggagaaggacaacgacagctacatcaaggagagaagcgacatccccagcggcaccagcaagcacctgcagaagaaggccaagaagcaggccaagaagcaggccaagaaccagagaagacagcagaagatccagggcaaggtgctgcacctgaacgacatctgcaccatcgaccaccccgaggacagcgagtacgaggccgagatgagcctgcagggcgaggtgaacatcaagagcaaccacatcagccaggagggcgtgatgcacaaggagtactgcgtgaaccagaaggacctgaacggccaggccaagatgatcgagagcgtgaccgacaaccagaagagcaccgaggaggtggacatgaagaacatcaacatggacaacgacctggaggtgctgaccagcagccccaccagaaacctgaacggcgcctacctgaccgagggcagcaacggcgaggtggacatcagcaacggcttcaagaacctgaacctgaacgccgccctgcaccccgacgagatcaacatcgagatcctgaacgacagccacacccccggcaccaaggtgtacgaggtggtgaacgaggaccccgagaccgccttctgcaccctggccaacagagaggtgttcaacaccgacgagtgcagcatccagcactgcctgtaccagttcaccagaaacgagaagctgagagacgccaacaagctgctgtgcgaggtgtgcaccagaagacagtgcaacggccccaaggccaacatcaagggcgagagaaagcacgtgtacaccaacgccaagaagcagatgctgatcagcctggccccccccgtgctgaccctgcacctgaagagattccagcaggccggcttcaacctgagaaaggtgaacaagcacatcaagttccccgagatcctggacctggcccccttctgcaccctgaagtgcaagaacgtggccgaggagaacaccagagtgctgtacagcctgtacggcgtggtggagcacagcggcaccatgagaagcggccactacaccgcctacgccaaggccagaaccgccaacagccacctgagcaacctggtgctgcacggcgacatcccccaggacttcgagatggagagcaagggccagtggttccacatcagcgacacccacgtgcaggccgtgcccaccaccaaggtgctgaacagccaggcctacctgctgttctacgagagaatcctgtag

SEQ ID NO: 11580 - DNA, 2472 bp, Artificial Sequence; identical to SEQ ID NO: 10121
  Description of Artificial Sequence: Synthetic coding sequence

SEQ ID NO: 11581 - DNA, 1167 bp, Artificial Sequence
  Description of Artificial Sequence: Synthetic coding sequence
atggaccccatcagaagcttctgcggcaagctgagaagcctggccagcaccctggactgcgagaccgccagactgcagagagccctggacggcgaggagagcgacttcgaggactaccccatgagaatcctgtacgacctgcacagcgaggtgcagaccctgaaggacgacgtgaacatcctgctggacaaggccagactggagaaccaggagggcatcgacttcatcaaggccaccaaggtgctgatggagaagaacagcatggacatcatgaagatcagagagtacttccagaagtacggctacagccccagagtgaagaagaacagcgtgcacgagcaggaggccatcaacagcgaccccgagctgagcaactgcgagaacttccagaagaccgacgtgaaggacgacctgagcgacccccccgtggccagcagctgcatcagcgagaagagccccagaagcccccagctgagcgacttcggcctggagagatacatcgtgagccaggtgctgcccaaccccccccaggccgtgaacaactacaaggaggagcccgtgatcgtgaccccccccaccaagcagagcctggtgaaggtgctgaagacccccaagtgcgccctgaagatggacgacttcgagtgcgtgacccccaagctggagcacttcggcatcagcgagtacaccatgtgcctgaacgaggactacaccatgggcctgaagaacgccagaaacaacaagagcgaggaggccatcgacaccgagagcagactgaacgacaacgtgttcgccacccccagccccatcatccagcagctggagaagagcgacgccgagtacaccaacagccccctggtgcccaccttctgcacccccggcctgaagatccccagcaccaagaacagcatcgccctggtgagcaccaactaccccctgagcaagaccaacagcagcagcaacgacctggaggtggaggacagaaccagcctggtgctgaacagcgacacctgcttcgagaacctgaccgaccccagcagccccaccatcagcagctacgagaacctgctgagaacccccaccccccccgaggtgaccaagatccccgaggacatcctgcagaagttccagtggatctaccccacccagaagctgaacaagatgagatag

SEQ ID NO: 11582 - DNA, 1353 bp, Artificial Sequence; identical to SEQ ID NO: 9948
  Description of Artificial Sequence: Synthetic coding sequence

SEQ ID NO: 11583 - DNA, 3378 bp, Artificial Sequence
  Description of Artificial Sequence: Synthetic coding sequence
atgaccgtggagcagaacgtgctgcagcagagcgccgcccagaagcaccagcagaccttcctgaaccagctgagagagatcaccggcatcaacgacacccagatcctgcagcaggccctgaaggacagcaacggcaacctggagctggccgtggccttcctgaccgccaagaacgccaagaccccccagcaggaggagaccacctactaccagaccgccctgcccggcaacgacagatacatcagcgtgggcagccaggccgacaccaacgtgatcgacctgaccggcgacgacaaggacgacctgcagagagccatcgccctgagcctggccgagagcaacagagccttcagagagaccggcatcaccgacgaggagcaggccatcagcagagtgctggaggccagcatcgccgagaacaaggcctgcctgaagagaacccccaccgaggtgtggagagacagcagaaacccctacgacagaaagagacaggacaaggcccccgtgggcctgaagaacgtgggcaacacctgctggttcagcgccgtgatccagagcctgttcaacctgctggagttcagaagactggtgctgaactacaagccccccagcaacgcccaggacctgcccagaaaccagaaggagcacagaaacctgcccttcatgagagagctgagatacctgttcgccctgctggtgggcaccaagagaaagtacgtggaccccagcagagccgtggagatcctgaaggacgccttcaagagcaacgacagccagcagcaggacgtgagcgagttcacccacaagctgctggactggctggaggacgccttccagatgaaggccgaggaggagaccgacgaggagaagcccaagaaccccatggtggagctgttctacggcagattcctggccgtgggcgtgctggagggcaagaagttcgagaacaccgagatgttcggccagtaccccctgcaggtgaacggcttcaaggacctgcacgagtgcctggaggccgccatgatcgagggcgagatcgagagcctgcacagcgagaacagcggcaagagcggccaggagcactggttcaccgagctgccccccgtgctgaccttcgagctgagcagattcgagttcaaccaggccctgggcagacccgagaagatccacaacaagctggagttcccccaggtgctgtacctggacagatacatgcacagaaacagagagatcaccagaatcaagagagaggagatcaagagactgaaggactacctgaccgtgctgcagcagagactggagagatacctgagctacggcagcggccccaagagattccccctggtggacgtgctgcagtacgccctggagttcgccagcagcaagcccgtgtgcaccagccccgtggacgacatcgacgccagcagcccccccagcggcagcatccccagccagaccctgcccagcaccaccgagcagcagggcgccctgagcagcgagctgcccagcaccagccccagcagcgtggccgccatcagcagcagaagcgtgatccacaagcccttcacccagagcagaatcccccccgacctgcccatgcaccccgcccccagacacatcaccgaggaggagctgagcgtgctggagagctgcctgcacagatggagaaccgagatcgagaacgacaccagagacctgcaggagagcatcagcagaatccacagaaccatcgagctgatgtacagcgacaagagcatgatccaggtgccctacagactgcacgccgtgctggtgcacgagggccaggccaacgccggccactactgggcctacatcttcgaccacagagagagcagatggatgaagtacaacgacatcgccgtgaccaagagcagctgggaggagctggtgagagacagcttcggcggctacagaaacgccagcgcctactgcctgatgtacatcaacgacaaggcccagttcctgatccaggaggagttcaacaaggagaccggccagcccctggtgggcatcgagaccctgccccccgacctgagagacttcgtggaggaggacaaccagagattcgagaaggagctggaggagtgggacgcccagctggcccagaaggccctgcaggagaagctgctggccagccagaagctgagagagagcgagaccagcgtgaccaccgcccaggccgccggcgaccccgagtacctggagcagcccagcagaagcgacttcagcaagcacctgaaggaggagaccatccagatcatcaccaaggccagccacgagcacgaggacaagagccccgagaccgtgctgcagagcaagcccgagaacaccaccagccagcccctgagcaaccagagagtggtggaggtggccatcccccacgtgggcaagttcatgatcgagagcaaggagggcggctacgacgacgagatcatgatgacccccaacatgcagggcatcatcatggccatcggcaagagcagaagcgtgtacgacagatgcggccccgaggccggcttcttcaaggccatcaagctggagtacgccagactggtgaagctggcccaggaggacaccccccccgagaccgactacagactgcaccacgtggtggtgtacttcatccagaaccaggcccccaagaagatcatcgagaagaccctgctggagcagttcggcgacagaaacctgagcttcgacgagagatgccacaacatcatgaaggtggcccaggccaagctggagatgatcaagcccgaggaggtgaacctggaggagtacgaggagtggcaccaggactacagaaagttcagagagaccaccatgtacctgatcatcggcctggagaacttccagagagagagctacatcgacagcctgctgttcctgatctgcgcctaccagaacaacaaggagctgctgagcaagggcctgtacagaggccacgacgaggagctgatcagccactacagaagagagtgcctgctgaagctgaacgagcaggccgccgagctgttcgagagcggcgaggacagagaggtgaacaacggcctgatcatcatgaacgagttcatcgtgcccttcctgcccctgctgctggtggacgagatggaggagaaggacatcctggccgtggaggacatgagaaacagatggtgcagctacctgggccaggagatggagccccacctgcaggagaagctgaccgacttcctgcccaagctgctggactgcagcatggagatcaagagcttccacgagccccccaagctgcccagctacagcacccacgagctgtgcgagagattcgccagaatcatgctgagcctgagcagaacccccgccgacggcagatag

SEQ ID NO: 11584 - DNA, 1608 bp, Artificial Sequence
  Description of Artificial Sequence: Synthetic coding sequence
atggacctgagacaggcctgcagaacccccagcagagacgaggccggcgtggagctgctgatgacctacttcatccagctgggcttcgtggagagcagattcttcccccccaccagacagatgggcctgctgttcacctggtacgacagcctgaccggcgtgcccgtgagccagcagaacctgctgctggagaaggccagcgtgctgttcaacaccggcgccctgtacacccagatcggcaccagatgcgacagacagacccaggccggcctggagagcgccatcgacgccttccagagagccgccggcgtgctgaactacctgaaggacaccttcacccacacccccagctacgacatgagccccgccatgctgagcgtgctggtgaagatgatgctggcccaggcccaggagagcgtgttcgagaagatcagcctgcccggcatcagaaacgagttcttcatgctggtgaaggtggcccaggaggccgccaaggtgggcgaggtgtaccagcagctgcacgccgccatgagccaggcccccgtgaaggagaacatcccctacagctgggccagcctggcctgcgtgaaggcccaccactacgccgccctggcccactacttcaccgccatcctgctgatcgaccaccaggtgaagcccggcaccgacctggaccaccaggagaagtgcctgagccagctgtacgaccacatgcccgagggcctgacccccctggccaccctgaagaacgaccagcagagaagacagctgggcaagagccacctgagaagagccatggcccaccacgaggagagcgtgagagaggccagcctgtgcaagaagctgagaagcatcgaggtgctgcagaaggtgctgtgcgccgcccaggagagaagcagactgacctacgcccagcaccaggaggaggacgacctgctgaacctgatcgacgcccccagcgtggtggccaagaccgagcaggaggtggacatcatcctgccccagttcagcaagctgaccgtgaccgacttcttccagaagctgggccccctgagcgtgttcagcgccaacaagagatggaccccccccagaagcatcagattcaccgccgaggagggcgacctgggcttcaccctgagaggcaacgcccccgtgcaggtgcacttcctggacccctactgcagcgccagcgtggccggcgccagagagggcgactacatcgtgagcatccagctggtggactgcaagtggctgaccctgagcgaggtgatgaagctgctgaagagcttcggcgaggacgagatcgagatgaaggtggtgagcctgctggacagcaccagcagcatgcacaacaagagcgccacctacagcgtgggcatgcagaagacctacagcatgatctgcctggccatcgacgacgacgacaagaccgacaagaccaagaagatcagcaagaagctgagcttcctgagctggggcaccaacaagaacagacagaagagcgccagcaccctgtgcctgcccagcgtgggcgccgccagaccccaggtgaagaagaagctgcccagccccttcagcctgctgaacagcgacagcagctggtactag

SEQ ID NO: 11585 - DNA, 2952 bp, Artificial Sequence
  Description of Artificial Sequence: Synthetic coding sequence
atggcccccagactgcagctggagaaggccgcctggagatgggccgagaccgtgagacccgaggaggtgagccaggagcacatcgagaccgcctacagaatctggctggagccctgcatcagaggcgtgtgcagaagaaactgcaagggcaaccccaactgcctggtgggcatcggcgagcacatctggctgggcgagatcgacgagaacagcttccacaacatcgacgaccccaactgcgagagaagaaagaagaacagcttcgtgggcctgaccaacctgggcgccacctgctacgtgaacaccttcctgcaggtgtggttcctgaacctggagctgagacaggccctgtacctgtgccccagcacctgcagcgactacatgctgggcgacggcatccaggaggagaaggactacgagccccagaccatctgcgagcacctgcagtacctgttcgccctgctgcagaacagcaacagaagatacatcgaccccagcggcttcgtgaaggccctgggcctggacaccggccagcagcaggacgcccaggagttcagcaagctgttcatgagcctgctggaggacaccctgagcaagcagaagaaccccgacgtgagaaacatcgtgcagcagcagttctgcggcgagtacgcctacgtgaccgtgtgcaaccagtgcggcagagagagcaagctgctgagcaagttctacgagctggagctgaacatccagggccacaagcagctgaccgactgcatcagcgagttcctgaaggaggagaagctggagggcgacaacagatacttctgcgagaactgccagagcaagcagaacgccaccagaaagatcagactgctgagcctgccctgcaccctgaacctgcagctgatgagattcgtgttcgacagacagaccggccacaagaagaagctgaacacctacatcggcttcagcgagatcctggacatggagccctacgtggagcacaagggcggcagctacgtgtacgagctgagcgccgtgctgatccacagaggcgtgagcgcctacagcggccactacatcgcccacgtgaaggacccccagagcggcgagtggtacaagttcaacgacgaggacatcgagaagatggagggcaagaagctgcagctgggcatcgaggaggacctggccgagcccagcaagagccagaccagaaagcccaagtgcggcaagggcacccactgcagcagaaacgcctacatgctggtgtacagactgcagacccaggagaagcccaacaccaccgtgcaggtgcccgccttcctgcaggagctggtggacagagacaacagcaagttcgaggagtggtgcatcgagatggccgagatgagaaagcagagcgtggacaagggcaaggccaagcacgaggaggtgaaggagctgtaccagagactgcccgccggcgccgagccctacgagttcgtgagcctggagtggctgcagaagtggctggacgagagcacccccaccaagcccatcgacaaccacgcctgcctgtgcagccacgacaagctgcaccccgacaagatcagcatcatgaagagaatcagcgagtacgccgccgacatcttctacagcagatacggcggcggccccagactgaccgtgaaggccctgtgcaaggagtgcgtggtggagagatgcagaatcctgagactgaagaaccagctgaacgaggactacaagaccgtgaacaacctgctgaaggccgccgtgaagggcagcgacggcttctgggtgggcaagagcagcctgagaagctggagacagctggccctggagcagctggacgagcaggacggcgacgccgagcagagcaacggcaagatgaacggcagcaccctgaacaaggacgagagcaaggaggagagaaaggaggaggaggagctgaacttcaacgaggacatcctgtgcccccacggcgagctgtgcatcagcgagaacgagagaagactggtgagcaaggaggcctggagcaagctgcagcagtacttccccaaggcccccgagttccccagctacaaggagtgctgcagccagtgcaagatcctggagagagagggcgaggagaacgaggccctgcacaagatgatcgccaacgagcagaagaccagcctgcccaacctgttccaggacaagaacagaccctgcctgagcaactggcccgaggacaccgacgtgctgtacatcgtgagccagttcttcgtggaggagtggagaaagttcgtgagaaagcccaccagatgcagccccgtgagcagcgtgggcaacagcgccctgctgtgcccccacggcggcctgatgttcaccttcgccagcatgaccaaggaggacagcaagctgatcgccctgatctggcccagcgagtggcagatgatccagaagctgttcgtggtggaccacgtgatcaagatcaccagaatcgaggtgggcgacgtgaaccccagcgagacccagtacatcagcgagcccaagctgtgccccgagtgcagagagggcctgctgtgccagcagcagagagacctgagagagtacacccaggccaccatctacgtgcacaaggtggtggacaacaagaaggtgatgaaggacagcgcccccgagctgaacgtgagcagcagcgagaccgaggaggacaaggaggaggccaagcccgacggcgagaaggaccccgacttcaaccagatcatgcacgccttcagcgtggcccccttcgaccagaacctgagcatcgacggcaagatcctgagcgacgactgcgccaccctgggcaccctgggcgtgatccccgagagcgtgatcctgctgaaggccgacgagcccatcgccgactacgccgccatggacgacgtgatgcaggtgtgcatgcccgaggagggcttcaagggcaccggcctgctgggccactag

SEQ ID NO: 11586 - DNA, 738 bp, Artificial Sequence
  Description of Artificial Sequence: Synthetic coding sequence
atgagcgtgtgcagcagcgacctgagctacggcagcagagtgtgcctgcccggcagctgcgacagctgcagcgacagctggcaggtggacgactgccccgagagctgctgcgagcccccctgctgcgcccccgccccctgcctgagcctggtgtgcacccccgtgagcagagtgagcagcccctgctgcagagtgacctgcgagcccagcccctgccagagcggctgcaccagcagctgcacccccagctgctgccagcagagcagctgccagcccgcctgctgcaccagcagcccctgccagcaggcctgctgcgtgcccgtgtgctgcaagaccgtgtgctgcaagcccgtgtgctgcatgcccgtgtgctgcggccccagcagcagctgctgccagcagagcagctgccagcccgcctgctgcatcagcagcccctgccagcagagctgctgcgtgcccgtgtgctgcaagcccatctgctgcgtgcccgtgtgcagcggcgccagcagcctgtgctgccagcagagcagctgccagcccgcctgctgcaccaccagctgctgcagacccagcagcagcgtgagcctgctgtgcagacccgtgtgcagacccgccagaagagtgcccgtgcccagctgctgcgtgcccaccagcagctgccagcccagctgcggcagactggccagctgcggcagcctgctgtgcagacccacctgcagcagactggcctgctag

SEQ ID NO: 11587 - DNA, 1098 bp, Artificial Sequence
  Description of Artificial Sequence: Synthetic coding sequence
atggccgccagcaccatgagcgtgtgcagcagcgacctgagctacggcagcagagtgtgcctgcccggcagctgcgacagctgcagcgacagctggcaggtggacgactgccccgagagctgctgcgagcccccctgctgcgcccccgccccctgcctgagcctggtgtgcacccccgtgagcagagtgagcagcccctgctgccccgtgacctgcgagcccagcccctgccagagcggctgcaccagcagctgcacccccagctgctgccagcagagcagctgccagctggcctgctgcgccagcagcccctgccagcaggcctgctgcgtgcccgtgtgctgcaagaccgtgtgctgcaagcccgtgtgctgcgtgagcgtgtgctgcggcgacagcagctgctgccagcagagcagctgccagagcgcctgctgcaccagcagcccctgccagcaggcctgctgcgtgcccgtgtgctgcaagcccgtgtgcagcggcatcagcagcagctgctgccagcagagcagctgcgtgagctgcgtgagcagcccctgctgccaggccgtgtgcgagcccagcccctgccagagcggctgcaccagcagctgcacccccagctgctgccagcagagcagctgccagcccacctgctgcaccagcagcccctgccagcaggcctgctgcgtgcccgtgtgctgcgtgcccgtgtgctgcgtgcccacctgcagcgaggacagcagcagctgctgccagcagagcagctgccagcccgcctgctgcaccagcagcccctgccagcacgcctgctgcgtgcccgtgtgcagcggcgccagcaccagctgctgccagcagagcagctgccagcccgcctgctgcaccgccagctgctgcagacccagcagcagcgtgagcctgctgtgccaccccgtgtgcaagagcacctgctgcgtgcccgtgcccagctgcggcgccagcgccagcagctgccagcccagctgctgcagaaccgccagctgcgtgagcctgctgtgcagacccatgtgcagcagacccgcctgctacagcctgtgcagcggccagaagagcagctgctag

SEQ ID NO: 11588 - DNA, 816 bp, Artificial Sequence
  Description of Artificial Sequence: Synthetic coding sequence
atggccgcctgcaccatgagcgtgtgcagcagcgcctgcagcgacagctggagagtggacgactgccccgagagctgctgcgagcccccctgcggcaccgccccctgcctgaccctggtgtgcacccccgtgagctgcgtgagcagcccctgctgccaggccgcctgcgagcccagcccctgccagagcggctgcaccagcagctgcacccccagctgctgccagcccgcctgctgcgccagcagcccctgccagcaggcctgctgcgtgcccgtgtgctgcaagcccgtgtgctgcctgcccacctgcagcaaggacagcagcagctgctgccagcagagcagctgccagcccacctgctgcgccagcagcagctgccagcagagctgctgcgtgcccgtgtgctgcaagcccgtgtgctgcgtgcccacctgcagcgaggacagcagcagctgctgccagcacagcagctgccagcccacctgctgcaccagcagcccctgccagcagagctgctacgtgcccgtgtgctgcaagcccgtgtgcttcaagcccatctgctgcgtgcccgtgtgcagcggcgccagcaccagctgctgccagcagagcagctgccagcccgcctgctgcaccaccagctgctgcagacccagcagcagcgtgagcctgctgtgcagacccatctgcagacccgcctgctgcgtgcccatcagcagctgctgcgcccccgccagcagctaccaggccagctgctgcagacccgccagctgcgtgagcctgctgtgcagacccgcctgcagcagactggcctgctag

SEQ ID NO: 11589 - DNA, 1206 bp, Artificial Sequence
  Description of Artificial Sequence: Synthetic coding sequence
atgagcgtgtgcagcagcgacctgagctacagcagcagagtgtgcctgcccggcagctgcgacagctgcagcgacagctggcaggtggacgactgccccgagagctgctgcgagcccccctgctgcgcccccagctgctgcgcccccgccccctgcctgagcctggtgtgcacccccgtgagcagagtgagcagcccctgctgccccgtgacctgcgagcccagcccctgccagagcggctgcaccagcagctgcacccccagctgctgccagcagagcagctgccagctggcctgctgcgccagcagcccctgccagcaggcctgctgcgtgcccgtgtgctgcaagaccgtgtgctgcaagcccgtgtgctgcgtgcccgtgtgctgcggcgacagcagctgctgccagcagagcagctgccagagcgcctgctgcaccagcagcccctgccagcaggcctgctgcgtgcccatctgctgcaagcccgtgtgcagcggcatcagcagcagctgctgccagcagagcagctgcgtgagctgcgtgagcagcccctgctgccaggccgtgtgcgagcccagcccctgccagagcggctgcatcagcagctgcacccccagctgctgccagcagagcagctgccagcccgcctgctgcaccagcagcagctgccagcaggcctgctgcgtgcccgtgtgctgcaagaccgtgtgctgcaagcccgtgtgcagcgaggacagcagcagctgctgccagcagagcagctgccagcccgcctgctgcaccagcagcccctgccagcaggcctgctgcgtgcccgtgtgctgcaagcccgtgtgctgcaagcccgtgggcagcgtgcccatctgcagcggcgccagcagcctgtgctgccagcagagcagctgccagcccgcctgctgcaccagcagccagagccagcagggctgctgcgtgcccgtgtgctgcaagcccgtgagctgcgtgcccgtgtgcagcggcgccagcagcagctgctgccagcagagcagctgccagcccgcctgctgcaccaccagctgctgcagacccagcagcagcgtgagcctgctgtgcagacccgtgtgcagacccgcctgctgcgtgcccgtgcccagctgctgcgcccccaccagcagctgccagcccagctgctgcagacccgccagctgcgtgagcctgctgtag

SEQ ID NO: 11590 - DNA, 849 bp, Artificial Sequence
  Description of Artificial Sequence: Synthetic coding sequence
atggccgccagcaccatgagcgtgtgcagcagcgcctgcagcgacagctggcaggtggacgcctgccccgagagctgctgcgagccccactgctgcgccctgagctgctgcgcccccgccccctgcctgaccctggtgtgcacccccgtgagcagagtgagcagcccctgctgccaggccgcctgcgagcccagcccctgccagagcggctgcaccagcagctgcacccccagctgctgccagcagagcagctgccagcccgcctgctgcaccagcagcccctgccagcaggcctgctgcgtgcccgtgtgctgcaagcccgtgtgctgcctgcccacctgcagcaaggacagcagcagctgctgccagcagagcagctgccagcccacctgctgcgccagcagcagcagccagcagagctgctgcgtgcccgtgtgctgcaagcccgtgtgctacgtgcccacctgcagcgaggacagcagcagctgctgccagcagagcagctgccaccccgcctgctgcaccagcagcccctgccagcaggcctgctgcgtgcccgtgagatgcaagcccgtgtgctgcaagcccatctgctgcgtgcccgtgtgcagcggcgccagcaccagctgctgccagcagagcagctgccagcccgcctgctgcaccaccagctgctgcagacccagcagcagcgtgagcctgctgtgcagacccgtgtgcagacccgcctgctgcatgcccgtgagcagctgctgcgcccccgccagcagctgccaggccagctgctgcagacccgccagctgcgtgagcctgctgtgcagacccgcctgcagcagacccgcctgctag

SEQ ID NO: 11591 - DNA, 891 bp, Artificial Sequence
  Description of Artificial Sequence: Synthetic coding sequence
atggccagcagccccctgcccggccccaacgacatcctgctggccagccccagcagcgccttccagcccgacaccctgagccagcccagacccggccacgccaacctgaagcccaaccaggtgggccaggtgatcctgtacggcatccccatcgtgagcctggtgatcgacggccaggagagactgtgcctggcccagatcagcaacaccctgctgaagaacttcagctacaacgagatccacaacagaagagtggccctgggcatcacctgcgtgcagtgcacccccgtgcagctggagatcctgagaagagccggcgccatgcccatcagcagcagaagatgcggcatgatcaccaagagagaggccgagagactgtgcaagagcttcctgggcgagaacagaccccccaagctgcccgacaacttcgccttcgacgtgagccacgagtgcgcctggggctgcagaggcagcttcatccccgccagatacaacagcagcagagccaagtgcatcaagtgcagctactgcaacatgtacttcagccccaacaagttcatcttccacagccacagaacccccgacgccaagtacacccagcccgacgccgccaacttcaacagctggagaagacacctgaagctgaccgacaagagcccccaggacgagctggtgttcgcctgggaggacgtgaaggccatgttcaacggcggcagcagaaagagagccctgccccagcccggcgcccaccccgcctgccaccccctgagcagcatcagaaccagaagcatcgccttcagcagccagaccctgatgctgctggaggagatcttcggcgagaaggaccaggaggactacatgagaatcaacgaggacaacatctggctgtag

SEQ ID NO: 11592 - DNA, 5346 bp, Artificial Sequence
  Description of Artificial Sequence: Synthetic coding sequence
gtgaagaagatccacagacacagactgagccccgccaccgagaagggcgccgccagcagcggcgagggcgacaaggacccccccccccccgcccacgaggacatcgccgtgaagggcaccgccaccgccgccggcaccggccccggcaccggcgccgccgccgccgccgccgccgccgtgccccccccccaccccgccgccgccgccgccgccgccgccgccgccgccgccgccgccgccgccgccgtgccccccccccaccccaacatcagagccctgcagacccaggccccccagcagatccccagaggccccgtgcagcagcccctggaggacagaatcttcacccccgccgtgagcgccgtgtacagcaccgtgacccaggtggccagacagcccggcacccccacccccagcccctacagcgcccacgagatcaacaagggccaccccaacctggccgccaccccccccggccacgccagcagccccggcctgagccagaccccctaccccagcggccagaacgccggccccaccaccctggtgtacccccagaccccccagaccatgaacagccagccccagaccagaagccccgtgatcttcagccccagccagttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagctgcccagccaggtgcccgagcacagccccgtggtgtacggcaccgtggagagcgcccacctggccgccagcacccccgtgaccgccgccagcgaccagaagcaggaggagaagcccaagcccgaccccgtgctgaagagccccagccccgtgctgagactggtgctgagcggcgagaagaaggagcaggagggccagaccagcgagaccaccgccatcgtgagcatcgccgagctgcccctgccccccagccccaccaccgtgagcagcgtggccagaagcaccatcgccgcccccaccagcagcgccctgagcagccagcccatcttcaccaccgccatcgacgacagatgcgagctgagcagccccagagaggacaccatccccatccccagcctgaccagctgcaccgagaccagcgaccccctgcccaccaacgagaacgacgacgacatctgcaagaagccctgcagcgtggcccccaacgacatccccctggtgagcagcaccaacctgatcaacgagatcaacggcgtgagcgagaagctgagcgccaccgagagcatcgtggagatcgtgaagcaggaggtgctgcccctgaccctggagctggagatcctggagaacccccccgaggagatgaagctggagtgcatccccgcccccatcacccccagcaccgtgcccagcttcccccccaccccccccaccccccccgccagccccccccacacccccgtgatcgtgcccgccgccgccaccaccgtgagcagccccagcgccgccatcaccgtgcagagagtgctggaggaggacgagagcatcagaacctgcctgagcgaggacgccaaggagatccagaacaagatcgaggtggaggccgacggccagaccgaggagatcctggacagccagaacctgaacagcagaagaagccccgtgcccgcccagatcgccatcaccgtgcccaagacctggaagaagcccaaggacagaaccagaaccaccgaggagatgctggaggccgagctggagctgaaggccgaggaggagctgagcatcgacaaggtgctggagagcgagcaggacaagatgagccagggcttccaccccgagagagaccccagcgacctgaagaaggtgaaggccgtggaggagaacggcgaggaggccgagcccgtgagaaacggcgccgagagcgtgagcgagggcgagggcatcgacgccaacagcggcagcaccgacagcagcggcgacggcgtgaccttccccttcaagcccgagagctggaagcccaccgacaccgagggcaagaagcagtacgacagagagttcctgctggacttccagttcatgcccgcctgcatccagaagcccgagggcctgccccccatcagcgacgtggtgctggacaagatcaaccagcccaagctgcccatgagaaccctggaccccagaatcctgcccagaggccccgacttcacccccgccttcgccgacttcggcagacagacccccggcggcagaggcgtgcccctgctgaacgtgggcagcagaagaagccagcccggccagagaagagagcccagaaagatcatcaccgtgagcgtgaaggaggacgtgcacctgaagaaggccgagaacgcctggaagcccagccagaagagagacagccaggccgacgaccccgagaacatcaagacccaggagctgttcagaaaggtgagaagcatcctgaacaagctgaccccccagatgttcaaccagctgatgaagcaggtgagcggcctgaccgtggacaccgaggagagactgaagggcgtgatcgacctggtgttcgagaaggccatcgacgagcccagcttcagcgtggcctacgccaacatgtgcagatgcctggtgaccctgaaggtgcccatggccgacaagcccggcaacaccgtgaacttcagaaagctgctgctgaacagatgccagaaggagttcgagaaggacaaggccgacgacgacgtgttcgagaagaagcagaaggagctggaggccgccagcgcccccgaggagagaaccagactgcacgacgagctggaggaggccaaggacaaggccagaagaagaagcatcggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcgtgaaggagagaaagaccagcagcagaatcagattcatgctgcaggacgtgatcgacctgagactgtgcaactgggtgagcagaagagccgaccagggccccaagaccatcgagcagatccacaaggaggccaagatcgaggagcaggaggagcagagaaaggtgcagcagctgatgaccaaggagaagagaagacccggcgtgcagagagtggacgagggcggctggaacaccgtgcagggcgccaagaacagcagagtgctggaccccagcaagttcctgaagatcaccaagcccaccatcgacgagaagatccagctggtgcccaaggcccagctgggcagctggggcaagggcagcagcggcggcgccaaggccagcgagaccgacgccctgagaagcagcgccagcagcctgaacagattcagcgccctgcagccccccgcccccagcggcagcacccccagcacccccgtggagttcgacagcagaagaaccctgaccagcagaggcagcatgggcagagagaagaacgacaagcccctgcccagcgccaccgccagacccaacaccttcatgagaggcggcagcagcaaggacctgctggacaaccagagccaggaggagcagagaagagagatgctggagaccgtgaagcagctgaccggcggcgtggacgtggagagaaacagcaccgaggccgagagaaacaagaccagagagagcgccaagcccgagatcagcgccatgagcgcccacgacaaggccgccctgagcgaggaggagctggagagaaagagcaagagcatcatcgacgagttcctgcacatcaacgacttcaaggaggccatgcagtgcgtggaggagctgaacgcccagggcctgctgcacgtgttcgtgagagtgggcgtggagagcaccctggagagaagccagatcaccagagaccacatgggccagctgctgtaccagctggtgcagagcgagaagctgagcaagcaggacttcttcaagggcttcagcgagaccctggagctggccgacgacatggccatcgacatcccccacatctggctgtacctggccgagctggtgacccccatgctgaaggagggcggcatcagcatgagagagctgaccatcgagttcagcaagcccctgctgcccgtgggcagagccggcgtgctgctgagcgagatcctgcacctgctgtgcaagcagatgagccacaagaaggtgggcgccctgtggagagaggccgacctgagctggaaggacttcctgcccgagggcgaggacgtgcacaacttcctgctggagcagaagctggacttcatcgagagcgacagcccctgcagcagcgaggccctgagcaagaaggagctgagcgccgaggagctgtacaagagactggagaagctgatcatcgaggacaaggccaacgacgagcagatcttcgactgggtggaggccaacctggacgagatccagatgagcagccccaccttcctgagagccctgatgaccgccgtgtgcaaggccgccatcatcgccgacagcagcaccttcagagtggacaccgccgtgatcaagcagagagtgcccatcctgctgaagtacctggacagcgacaccgagaaggagctgcaggccctgtacgccctgcaggccagcatcgtgaagctggaccagcccgccaacctgctgagaatgttcttcgactgcctgtacgacgaggaggtgatcagcgaggacgccttctacaagtgggagagcagcaaggaccccgccgagcagaacggcaagggcgtggccctgaagagcgtgaccgccttcttcacctggctgagagaggccgaggaggagagcgaggacaactag

SEQ ID NO: 11593 - DNA, 4758 bp, Artificial Sequence; identical to SEQ ID NO: 9464
  Description of Artificial Sequence: Synthetic coding sequence

SEQ ID NO: 11594 - DNA, 3087 bp, Artificial Sequence
  Description of Artificial Sequence: Synthetic coding sequence
atggccagcgaggccgtgaaggtggtggtgagatgcagacccatgaaccagagagagagagagctgagatgccagcccgtggtgaccgtggactgcgccagagcccagtgctgcatccagaaccccggcgccgccgacgagccccccaagcagttcaccttcgacggcgcctaccacgtggaccacgtgaccgagcagatctacaacgagatcgcctaccccctggtggagggcgtgaccgagggctacaacggcaccatcttcgcctacggccagaccggcagcggcaagagcttcaccatgcagggcctgcccgacccccccagccagagaggcatcatccccagagccttcgagcacgtgttcgagagcgtgcagtgcgccgagaacaccaagttcctggtgagagccagctacctggagatctacaacgaggacgtgagagacctgctgggcgccgacaccaagcagaagctggagctgaaggagcaccccgagaagggcgtgtacgtgaagggcctgagcatgcacaccgtgcacagcgtggcccagtgcgagcacatcatggagaccggctggaagaacagaagcgtgggctacaccctgatgaacaaggacagcagcagaagccacagcatcttcaccatcagcatcgagatgagcgccgtggacgagagaggcaaggaccacctgagagccggcaagctgaacctggtggacctggccggcagcgagagacagagcaagaccggcgccaccggcgagagactgaaggaggccaccaagatcaacctgagcctgagcgccctgggcaacgtgatcagcgccctggtggacggcagatgcaagcacgtgccctacagagacagcaagctgaccagactgctgcaggacagcctgggcggcaacaccaagaccctgatggtggcctgcctgagccccgccgacaacaactacgacgagaccctgagcaccctgagatacgccaacagagccaagaacatcagaaacaagcccagaatcaacgaggaccccaaggacgccctgctgagagagtaccaggaggagatcaagaagctgaaggccatcctgacccagcagatgagccccagcagcctgagcgccctgctgagcagacaggtgccccccgaccccgtgcaggtggaggagaagctgctgccccagcccgtgatccagcacgacgtggaggccgagaagcagctgatcagagaggagtacgaggagagactggccagactgaaggccgactacaaggccgagcaggagagcagagccagactggaggaggacatcaccgccatgagaaacagctacgacgtgagactgagcaccctggaggagaacctgagaaaggagaccgaggccgtgctgcaggtgggcgtgctgtacaaggccgaggtgatgagcagagccgagttcgccagcagcgccgagtacccccccgccttccagtacgagaccgtggtgaagcccaaggtgttcagcaccaccgacaccctgcccagcgacgacgtgagcaagacccaggtgagcagcagattcgccgagctgcccaaggtggagcccagcaagagcgagatcagcctgggcagcagcgagagcagcagcctggaggagaccagcgtgagcgaggccttccccggccccgaggagcccagcaacgtggaggtgagcatgcccaccgaggagagcagaagcagatacttcctggacgagtgcctgggccaggaggccgccggccacctgctgggcgagcagaactacctgccccaggaggagccccaggaggtgcccctgcagggcctgctgggcctgcaggaccccttcgccgaggtggaggccaagctggccagactgagcagcaccgtggccagaaccgacgccccccaggccgacgtgcccaaggtgcccgtgcaggtgcccgcccccaccgacctgctggagcccagcgacgccagacccgaggccgaggccgccgacgacttcccccccagacccgaggtggacctggccagcgaggtggccctggaggtggtgagaaccgccgagcccggcgtgtggctggaggcccaggcccccgtggccctggtggcccagcccgagcccctgcccgccaccgccggcgtgaagagagagagcgtgggcatggaggtggccgtgctgaccgacgaccccctgcccgtggtggaccagcagcaggtgctggccagactgcagctgctggagcagcaggtggtgggcggcgagcaggccaagaacaaggacctgaaggagaagcacaagagaagaaagagatacgccgacgagagaagaaagcagctggtggccgccctgcagaacagcgacgaggacagcggcgactgggtgctgctgaacgtgtacgacagcatccaggaggaggtgagagccaagagcaagctgctggagaagatgcagagaaagctgagagccgccgaggtggagatcaaggacctgcagagcgagttccagctggagaagatcgactacctggccaccatcagaagacaggagagagacagcatgctgctgcagcagctgctggagcaggtgcagcccctgatcagaagagactgcaactacagcaacctggagaagatcctgagagagagctgctgggacgaggacaacggcttctggaagatcccccaccccgtgatcaccaagaccagcctgcccgtggtgagcaccggcccccagaacaagcccgccagaaagaccagcgccgccgacaacggcgagcccaacatggaggacgacagatacagactgatgctgagcagaagcaacagcgagaacatcgccagcaactacttcagaagcaagagagccagccagatcctgagcaccgacgccagaaagagcctgacccaccacaacagcccccccggcctgagctgccccctgagcaacaacagcgccatcccccccacccaggcccccgagatgccccagcccagacccttcagactggagagcctggacatccccttcaccaaggccaagagaaagaagagcaagagcaacttcggcagcgagcccctgtag

SEQ ID NO: 11595 - DNA, 921 bp, Artificial Sequence
  Description of Artificial Sequence: Synthetic coding sequence
atgagacagcacgacaccagaaacggcagaatcgtgctgatcagcggcagaagaagcttctgcagcatcttcagcgtgctgccctacagagacagcacccaggtgggcgacctgaagctggacggcggcagacagagcaccggcgccgtgagcctgaaggagatcatcggcctggagggcgtggagctgggcgccgacggcaagaccgtgagctacacccagttcctgctgcccaccaacgccttcggcgccagaagaaacaccatcgacagcaccagcagcttcagccagttcagaaacctgagccacagaagcctgagcatcggcagagccagcggcacccagggcagcctggacaccggcagcgacctgggcgacttcatggactacgaccccaacctgctggacgacccccagtggccctgcggcaagcacaagagagtgctgatcttccccagctacatgaccaccgtgatcgactacgtgaagcccagcgacctgaagaaggacatgaacgagaccttcaaggagaagttcccccacatcaagctgaccctgagcaagatcagaagcctgaagagagagatgagaaagctggcccaggaggactgcggcctggaggagcccaccgtggccatggccttcgtgtacttcgagaagctggccctgaagggcaagctgaacaagcagaacagaaagctgtgcgccggcgcctgcgtgctgctggccgccaagatcggcagcgacctgaagaagcacgaggtgaagcacctgatcgacaagctggaggagaagttcagactgaacagaagagagctgatcgccttcgagttccccgtgctggtggccctggagttcgccctgcacctgcccgagcacgaggtgatgccccactacagaagactggtgcagagcagctag

SEQ ID NO: 11596 - DNA, 2820 bp, Artificial Sequence
  Description of Artificial Sequence: Synthetic coding sequence
atggccgcccagccccccagaggcatcagactgagcgccctgtgccccaagttcctgcacaccaacagcaccagccacacctggcccttcagcgccgtggccgagctgatcgacaacgcctacgaccccgacgtgaacgccaagcagatctggatcgacaagaccgtgatcaacgaccacatctgcctgaccttcaccgacaacggcaacggcatgaccagcgacaagctgcacaagatgctgagcttcggcttcagcgacaaggtgaccatgaacggccacgtgcccgtgggcctgtacggcaacggcttcaagagcggcagcatgagactgggcaaggacgccatcgtgttcaccaagaacggcgagagcatgagcgtgggcctgctgagccagacctacctggaggtgatcaaggccgagcacgtggtggtgcccatcgtggccttcaacaagcacagacagatgatcaacctggccgagagcaaggccagcctggccgccatcctggagcacagcctgttcagcaccgagcagaagctgctggccgagctggacgccatcatcggcaagaagggcaccagaatcatcatctggaacctgagaagctacaagaacgccaccgagttcgacttcgagaaggacaagtacgacatcagaatccccgaggacctggacgagatcaccggcaagaagggctacaagaagcaggagagaatggaccagatcgcccccgagagcgactacagcctgagagcctactgcagcatcctgtacctgaagcccagaatgcagatcatcctgagaggccagaaggtgaagacccagctggtgagcaagagcctggcctacatcgagagagacgtgtacagacccaagttcctgagcaagaccgtgagaatcaccttcggcttcaactgcagaaacaaggaccactacggcatcatgatgtaccacagaaacagactgatcaaggcctacgagaaggtgggctgccagctgagagccaacaacatgggcgtgggcgtggtgggcatcatcgagtgcaacttcctgaagcccacccacaacaagcaggacttcgactacaccaacgagtacagactgaccatcaccgccctgggcgagaagctgaacgactactggaacgagatgaaggtgaagaagaacaccgagtaccccctgaacctgcccgtggaggacatccagaagagacccgaccagacctgggtgcagtgcgacgcctgcctgaagtggagaaagctgcccgacggcatggaccagctgcccgagaagtggtactgcagcaacaaccccgacccccagttcagaaactgcgaggtgcccgaggagcccgaggacgaggacctggtgcaccccacctacgagaagacctacaagaagaccaacaaggagaagttcagaatcagacagcccgagatgatccccagaatcaacgccgagctgctgttcagacccaccgccctgagcacccccagcttcagcagccccaaggagagcgtgcccagaagacacctgagcgagggcaccaacagctacgccaccagactgctgaacaaccaccaggtgcccccccagagcgagcccgagagcaacagcctgaagagaagactgagcaccagaagcagcatcctgaacgccaagaacagaagactgagcagccagttcgagaacagcgtgtacaagggcgacgacgacgacgaggacgtgatcatcctggaggagaacagcacccccaagcccgccgtggaccacgacatcgacatgaagagcgagcagagccacgtggagcagggcggcgtgcaggtggagttcgtgggcgacagcgagccctgcggccagaccggcagcaccagcaccagcagcagcagatgcgaccagggcaacaccgccgccacccagaccgaggtgcccagcctggtggtgaagaaggaggagaccgtggaggacgagatcgacgtgagaaacgacgccgtgatcctgcccagctgcgtggaggccgaggccaagatccacgagacccaggagaccaccgacaagagcgccgacgacgccggctgccagctgcaggagctgagaaaccagctgctgctggtgaccgaggagaaggagaactacaagagacagtgccacatgttcaccgaccagatcaaggtgctgcagcagagaatcctggagatgaacgacaagtacgtgaagaaggagacctgccaccagagcaccgagaccgacgccgtgttcctgctggagagcatcaacggcaagagcgagagccccgaccacatggtgagccagtaccagcaggccctggaggagatcgagagactgaagaagcagtgcagcgccctgcagcacgtgaaggccgagtgcagccagtgcagcaacaacgagagcaagagcgagatggacgagatggccgtgcagctggacgacgtgttcagacagctggacaagtgcagcatcgagagagaccagtacaagagcgaggtggagctgctggagatggagaagagccagatcagaagccagtgcgaggagctgaagaccgaggtggagcagctgaagagcaccaaccagcagaccgccaccgacgtgagcaccagcagcaacatcgaggagagcgtgaaccacatggacggcgagagcctgaagctgagaagcctgagagtgaacgtgggccagctgctggccatgatcgtgcccgacctggacctgcagcaggtgaactacgacgtggacgtggtggacgagatcctgggccaggtggtggagcagatgagcgagatcagcagcacctag

SEQ ID NO: 11597 - DNA, 1149 bp, Artificial Sequence; identical to SEQ ID NO: 11197
  Description of Artificial Sequence: Synthetic coding sequence

SEQ ID NO: 11598 - DNA, 5058 bp, Artificial Sequence
  Description of Artificial Sequence: Synthetic coding sequence
atgagcctgcccttctaccagagatgccaccagcactacgacctgagctacagaaacaaggacgtgagaagcaccgtgagccactaccagagagagaagaagagaagcgccgtgtacacccagggcagcaccgcctacagcagcagaagcagcgccgcccacagaagagagagcgaggccttcagaagagccagcgccagcagcagccagcagcaggccagccagcacgccctgagcagcgaggtgagcagaaaggccgccagcgcctacgactacggcagcagccacggcctgaccgacagcagcctgctgctggacgactacagcagcaagctgagccccaagcccaagagagccaagcacagcctgctgagcggcgaggagaaggagaacctgcccagcgactacatggtgcccatcttcagcggcagacagaagcacgtgagcggcatcaccgacaccgaggaggagagaatcaaggaggccgccgcctacatcgcccagagaaacctgctggccagcgaggagggcatcaccaccagcaagcagagcaccgccagcaagcagaccaccgccagcaagcagagcaccgccagcaagcagagcaccgccagcaagcagagcaccgccagcagacagagcaccgccagcagacagagcgtggtgagcaagcaggccaccagcgccctgcagcaggaggagaccagcgagaagaagagcagaaaggtggtgatcagagagaaggccgagagactgagcctgagaaagaccctggaggagaccgagacctaccacgccaagctgaacgaggaccacctgctgcacgcccccgagttcatcatcaagcccagaagccacaccgtgtgggagaaggagaacgtgaagctgcactgcagcatcgccggctggcccgagcccagagtgacctggtacaagaaccaggtgcccatcaacgtgcacgccaaccccggcaagtacatcatcgagagcagatacggcatgcacaccctggagatcaacggctgcgacttcgaggacaccgcccagtacagagccagcgccatgaacgtgaagggcgagctgagcgcctacgccagcgtggtggtgaagagatacaagggcgagttcgacgagaccagattccacgccggcgccagcaccatgcccctgagcttcggcgtgaccccctacggctacgccagcagattcgagatccacttcgacgacaagttcgacgtgagcttcggcagagagggcgagaccatgagcctgggctgcagagtggtgatcacccccgagatcaagcacttccagcccgagatccagtggtacagaaacggcgtgcccctgagccccagcaagtgggtgcagaccctgtggagcggcgagagagccaccctgaccttcagccacctgaacaaggaggacgagggcctgtacaccatcagagtgagaatgggcgagtactacgagcagtacagcgcctacgtgttcgtgagagacgccgacgccgagatcgagggcgcccccgccgcccccctggacgtgaagtgcctggaggccaacaaggactacatcatcatcagctggaagcagcccgccgtggacggcggcagccccatcctgggctacttcatcgacaagtgcgaggtgggcaccgacagctggagccagtgcaacgacacccccgtgaagttcgccagattccccgtgaccggcctgatcgagggcagaagctacatcttcagagtgagagccgtgaacaagatgggcatcggcttccccagcagagtgagcgagcccgtggccgccctggaccccgccgagaaggccagactgaagagcagacccagcgccccctggaccggccagatcatcgtgaccgaggaggagcccagcgagggcatcgtgcccggcccccccaccgacctgagcgtgaccgaggccaccagaagctacgtggtgctgagctggaagccccccggccagagaggccacgagggcatcatgtacttcgtggagaagtgcgaggccggcaccgagaactggcagagagtgaacaccgagctgcccgtgaagagccccagattcgccctgttcgacctggccgagggcaagagctactgcttcagagtgagatgcagcaacagcgccggcgtgggcgagcccagcgaggccaccgaggtgaccgtggtgggcgacaagctggacatccccaaggcccccggcaagatcatccccagcagaaacaccgacaccagcgtggtggtgagctgggaggagagcaaggacgccaaggagctggtgggctactacatcgaggccagcgtggccggcagcggcaagtgggagccctgcaacaacaaccccgtgaagggcagcagattcacctgccacggcctggtgaccggccagagctacatcttcagagtgagagccgtgaacgccgccggcctgagcgagtacagccaggacagcgaggccatcgaggtgaaggccgccatcggcggcggcgtgagccccgacgtgtgccccgccctgagcgacgagcccggcggcctgaccgccagcagaggcagagtgcacgaggccagcccccccaccttccagaaggacgccctgctgggcagcaagcccaacaagcccagcctgcccagcagcagccagaacctgggccagaccgaggtgagcaaggtgagcgagaccgtgcaggaggagctgaccccccccccccagaaggccgccccccagggcaagagcaagagcgaccccctgaagaagaagaccgacagagccccccccagccccccctgcgacatcacctgcctggagagcttcagagacagcatggtgctgggctggaagcagcccgacaagatcggcggcgccgagatcaccggctactacgtgaactacagagaggtgatcgacggcgtgcccggcaagtggagagaggccaacgtgaaggccgtgagcgaggaggcctacaagatcagcaacctgaaggagaacatggtgtaccagttccaggtggccgccatgaacatggccggcctgggcgcccccagcgccgtgagcgagtgcttcaagtgcgaggagtggaccatcgccgtgcccggccccccccacagcctgaagtgcagcgaggtgagaaaggacagcctggtgctgcagtggaagccccccgtgcacagcggcagaacccccgtgaccggctacttcgtggacctgaaggaggccaaggccaaggaggaccagtggagaggcctgaacgaggccgccatcaagaacgtgtacctgaaggtgagaggcctgaaggagggcgtgagctacgtgttcagagtgagagccatcaaccaggccggcgtgggcaagcccagcgacctggccggccccgtggtggccgagaccagacccggcaccaaggaggtggtggtgaacgtggacgacgacggcgtgatcagcctgaacttcgagtgcgacaagatgacccccaagagcgagttcagctggagcaaggactacgtgagcaccgaggacagccccagactggaggtggagagcaagggcaacaagaccaagatgaccttcaaggacctgggcatggacgacctgggcatctacagctgcgacgtgaccgacaccgacggcatcgccagcagctacctgatcgacgaggaggagctgaagagactgctggccctgagccacgagcacaagttccccaccgtgcccgtgaagagcgagctggccgtggagatcctggagaagggccaggtgagattctggatgcaggccgagaagctgagcggcaacgccaaggtgaactacatcttcaacgagaaggagatcttcgagggccccaagtacaagatgcacatcgacagaaacaccggcatcatcgagatgttcatggagaagctgcaggacgaggacgagggcacctacaccttccagctgcaggacggcaaggccaccaaccacagcaccgtggtgctggtgggcgacgtgttcaagaagctgcagaaggaggccgagttccagagacaggagtggatcagaaagcagggcccccacttcgtggagtacctgagctgggaggtgaccggcgagtgcaacgtgctgctgaagtgcaaggtggccaacatcaagaaggagacccacatcgtgtggtacaaggacgagagagagatcagcgtggacgagaagcacgacttcaaggacggcatctgcaccctgctgatcaccgagttcagcaagaaggacgccggcatctacgaggtgatcctgaaggacgacagaggcaaggacaagagcagactgaagctggtggacgaggccttcaaggagctgatgatggaggtgtgcaagaagatcgccctgagcgccaccgacctgaagatccagagcaccgccgagggcatccagctgtacagcttcgtgacctactacgtggaggacctgaaggtgaactggagccacaacggcagcgccatcagatacagcgacagagtgaagaccggcgtgaccggcgagcagatctggctgcagatcaacgagcccacccccaacgacaagggcaagtacgtgatggagctgttcgacggcaagaccggccaccagaagaccgtggacctgagcggccaggcctacgacgaggcctacgccgagttccagagactgaagaagagcctgctgttccagaaggacagagccagagtgctgggcggcctgcccgacgtggtgaccatccaggagggcaaggccctgaacctgacctgcaacgtgtggggcgaccccccccccgaggtgagctggctgaagaacgagaaggccctggccagcgacgaccactgcaacctgaagttcgaggccggcagaaccgcctacttcaccatcaacggcgtgagcaccgccgacagcggcaagtacggcctggtggtgaagaacaagtacggcagcgagaccagcgacttcaccgtgagcgtgttcatccccgaggaggaggccagaatggccgccctggagagcctgaagggcggcaagaaggccaagtag

SEQ ID NO: 11599 - DNA, 3456 bp, Artificial Sequence
  Description of Artificial Sequence: Synthetic coding sequence
atgatggccgccgccctgggcccccccgaggtgatcgcccagctggagaacgccgccaaggtgctgatggccccccccagcatggtgaacaacgagcagagacagcacgccgagcacatcttcctgagcttcagaaagagcaagagccccttcgccgtgtgcaagcacatcctggagaccagcaaggtggactacgtgctgttccaggccgccaccgccatcatggaggccgtggtgagagagtggatcctgctggagaagggcagcatcgagagcctgagaaccttcctgctgacctacgtgctgcagagacccaacctgcagaagtacgtgagagagcagatcctgctggccgtggccgtgatcgtgaagagaggcagcctggacaagagcatcgactgcaagagcatcttccacgaggtgagccagctgatcagcagcggcaaccccaccgtgcagaccctggcctgcagcatcctgaccgccctgctgagcgagttcagcagcagcagcaagaccagcaacatcggcctgagcatggagttccacggcaactgcaagagagtgttccaggaggaggacctgagacagatcttcatgctgaccgtggaggtgctgcaggagttcagcagaagagagaacctgaacgcccagatgagcagcgtgttccagagatacctggccctggccaaccaggtgctgagctggaacttcctgccccccaagctgggcagacactacatcgccatgttcgagagcagccagaacgtgctgctgaagcccaccgagagctggagagagaccctgctggacagcagagtgatggagctgttcttcaccgtgcacagaaagatcagagaggacagcgacatggcccaggacagcctgcagtgcctggcccagctggccagcctgcacggccccatcttccccgacgagggcagccaggtggactacctggcccacttcatcgagggcctgctgaacaccatcaacggcatcgagatcgaggacagcgaggccgtgggcatcagcagcatcatcagcaacctgatcaccgtgttccccagaaacgtgctgaccgccatccccagcgagctgttcagcagcttcgtgaactgcctgacccacctgacctgcagcttcggcagaagcgccgccctggaggaggtgctggacaaggacgacatggtgtacatggaggcctacgacaagctgctggagagctggctgaccctggtgcaggacgacaagcacttccacaagggcttcttcacccagcacgccgtgcaggtgttcaacagctacatccagtgccacctggccgcccccgacggcaccagaaacctgaccgccaacggcgtggccagcagagaggaggaggagatcagcgagctgcaggaggacgacagagaccagttcagcgaccagctggccagcgtgggcatgctgggcagaatcgccgccgagcactgcatccccctgctgaccagcctgctggaggagagagtgaccagactgcacggccagctgcagagacaccagcagcagctgctggccagccccggcagcagcaccgtggacaacaagatgctggacgacctgtacgaggacatccactggctgatcctggtgaccggctacctgctggccgacgacacccagggcgagacccccctgatcccccccgagatcatggagtacagcatcaagcacagcagcgaggtggacatcaacaccaccctgcagatcctgggcagccccggcgagaaggccagcagcatccccggctacaacagaaccgacagcgtgatcagactgctgagcgccatcctgagagtgagcgaggtggagagcagagccatcagagccgacctgacccacctgctgagcccccagatgggcaaggacatcgtgtggttcctgaagagatgggccaagacctacctgctggtggacgagaagctgtacgaccagatcagcctgcccttcagcaccgccttcggcgccgacaccgagggcagccagtggatcatcggctacctgctgcagaaggtgatcagcaacctgagcgtgtggagcagcgagcaggacctggccaacgacaccgtgcagctgctggtgaccctggtggagagaagagagagagccaacctggtgatccagtgcgagaactggtggaacctggccaagcagttcgccagcagaagcccccccctgaacttcctgagcagccccgtgcagagaaccctgatgaaggccctggtgctgggcggcttcgcccacatggacaccgagaccaagcagcagtactggaccgaggtgctgcagcccctgcagcagagattcctgagagtgatcaaccaggagaacttccagcagatgtgccagcaggaggaggtgaagcaggagatcaccgccaccctggaggccctgtgcggcatcgccgaggccacccagatcgacaacgtggccatcctgttcaacttcctgatggacttcctgaccaactgcatcggcctgatggaggtgtacaagaacacccccgagaccgtgaacctgatcatcgaggtgttcgtggaggtggcccacaagcagatctgctacctgggcgagagcaaggccatgaacctgtacgaggcctgcctgaccctgctgcaggtgtacagcaagaacaacctgggcagacagagaatcgacgtgaccgccgaggaggagcagtaccaggacctgctgctgatcatggagctgctgaccaacctgctgagcaaggagttcatcgacttcagcgacaccgacgaggtgttcagaggccacgagcccggccaggccgccaacagaagcgtgagcgccgccgacgtggtgctgtacggcgtgaacctgatcctgcccctgatgagccaggacctgctgaagttccccaccctgtgcaaccagtactacaagctgatcaccttcatctgcgagatcttccccgagaagatcccccagctgcccgaggacctgttcaagagcctgatgtacagcctggagctgggcatgaccagcatgagcagcgaggtgtgccagctgtgcctggaggccctgacccccctggccgagcagtgcgccaaggcccaggagaccgacagccccctgttcctggccaccagacacttcctgaagctggtgttcgacatgctggtgctgcagaagcacaacaccgagatgaccaccgccgccggcgaggccttctacaccctggtgtgcctgcaccaggccgagtacagcgagctggtggagaccctgctgagcagccagcaggaccccgtgatctaccagagactggccgacgccttcaacaagctgaccgccagcagcaccccccccaccctggacagaaagcagaagatggccttcctgaagagcctggaggagttcatggccaacgtgggcggcctgctgtgcgtgaagtag

SEQ ID NO: 11600 - DNA, 420 bp, Artificial Sequence
  Description of Artificial Sequence: Synthetic coding sequence
atgggcggcggcgagagatacaacatccccgccccccagagcagaaacgtgagcaagaaccagcagcagctgaacagacagaagaccaaggagcagaacagccagatgaagatcgtgcacaagaagaaggagagaggccacggctacaacagcagcgccgccgcctggcaggccatgcagaacggcggcaagaacaagaacttccccaacaaccagagctggaacagcagcctgagcggccccagactgctgttcaagagccaggccaaccagaactacgccggcgccaagttcagcgagccccccagccccagcgtgctgcccaagccccccagccactgggtgcccgtgagcttcaaccccagcgacaaggagatcatgaccttccagctgaagaccctgctgaaggtgcaggtgtag

SEQ ID NO: 11601 - DNA, 984 bp, Artificial Sequence
  Description of Artificial Sequence: Synthetic coding sequence
atgaaggagatgctggccaaggacctggaggagagccagggcggcaagagcagcgaggtgctgagcgccaccgagctgagagtgcagctggcccagaaggagcaggagctggccagagccaaggaggccctgcaggccatgaaggccgacagaaagagactgaagggcgagaagaccgacctggtgagccagatgcagcagctgtacgccaccctggagagcagagaggagcagctgagagacttcatcagaaactacgagcagcacagaaaggagagcgaggacgccgtgaaggccctggccaaggagaaggacctgctggagagagagaagtgggagctgagaagacaggccaaggaggccaccgaccacgccaccgccctgagaagccagctggacctgaaggacaacagaatgaaggagctggaggccgagctggccatggccaagcagagcctggccaccctgaccaaggacgtgcccaagagacacagcctggccatgcccggcgagaccgtgctgaacggcaaccaggagtgggtggtgcaggccgacctgcccctgaccgccgccatcagacagagccagcagaccctgtaccacagccaccccccccaccccgccgacagacaggccgtgagagtgagcccctgccacagcagacagcccagcgtgatcagcgacgccagcgccgccgagggcgacagaagcagcacccccagcgacatcaacagccccagacacagaacccacagcctgtgcaacggcgacagccccggccccgtgcagaagaacctgcacaaccccatcgtgcagagcctggaggacctggaggaccagaagagaaagaagaagaaggagaagatgggcttcggcagcatcagcagagtgttcgccagaggcaagcagagaaagagcctggaccccggcctgttcgacggcaccgcccccgactactacatcgaggaggacgccgactggtag

SEQ ID NO: 11602 - DNA, 984 bp, Artificial Sequence; identical to SEQ ID NO: 11601
  Description of Artificial Sequence: Synthetic coding sequence

SEQ ID NO: 11603 - DNA, 609 bp, Artificial Sequence
  Description of Artificial Sequence: Synthetic coding sequence
atggacgagcaggccctgctgggcctgaaccccaacgccgacagcgacttcagacagagagccctggcctacttcgagcagctgaagatcagccccgacgcctggcaggtgtgcgccgaggccctggcccagagaacctacagcgacgaccacgtgaagttcttctgcttccaggtgctggagcaccaggtgaagtacaagtacagcgagctgaccaccgtgcagcagcagctgatcagagagaccctgatcagctggctgcaggcccagatgctgaacccccagcccgagaagaccttcatcagaaacaaggccgcccaggtgttcgccctgctgttcgtgaccgagtacctgaccaagtggcccaagttcttcttcgacatcctgagcgtggtggacctgaaccccagaggcgtggacctgtacctgagaatcctgatggccatcgacagcgagctggtggacagagacgtggtgcacaccagcgaggaggccagaagaaacaccctgatcaaggacaccatgagagagcagtgcatccccaacctggtggagagctggtaccagatcctgcagaactaccagttcaccaacagcgaggtgacctag

SEQ ID NO: 11604 - DNA, 1803 bp, Artificial Sequence
  Description of Artificial Sequence: Synthetic coding sequence
atgagcagagtggccaagtacagaagacaggtgagcgaggaccccgacatcgacagcctgctggagaccctgagccccgaggagatggaggagctggagaaggagctggacgtggtggaccccgacggcagcgtgcccgtgggcctgagacagagaaaccagaccgagaagcagagcaccggcgtgtacaacagagaggccatgctgaacttctgcgagaaggagaccaagaagctgatgcagagagagatgagcatggacgagagcaagcaggtggagaccaagaccgacgccaagaacggcgaggagagaggcagagacgccagcaagaaggccctgggccccagaagagacagcgacctgggcaaggagcccaagagaggcggcctgaagaagagcttcagcagagacagagacgaggccggcggcaagagcggcgagaagcccaaggaggagaagatcatcagaggcatcgacaagggcagagtgagagccgccgtggacaagaaggaggccggcaaggacggcagaggcgaggagagagccgtggccaccaagaaggaggaggagaagaagggcagcgacagaaacaccggcctgagcagagacaaggacaagaagagagaggagatgaaggaggtggccaagaaggaggacgacgagaaggtgaagggcgagagaagaaacaccgacaccagaaaggagggcgagaagatgaagagagccggcggcaacaccgacatgaagaaggaggacgagaaggtgaagagaggcaccggcaacaccgacaccaagaaggacgacgagaaggtgaagaagaacgagcccctgcacgagaaggaggccaaggacgacagcaagaccaagacccccgagaagcagacccccagcggccccaccaagcccagcgagggccccgccaaggtggaggaggaggccgcccccagcatcttcgacgagcccctggagagagtgaagaacaacgaccccgagatgaccgaggtgaacgtgaacaacagcgactgcatcaccaacgagatcctggtgagattcaccgaggccctggagttcaacaccgtggtgaagctgttcgccctggccaacaccagagccgacgaccacgtggccttcgccatcgccatcatgctgaaggccaacaagaccatcaccagcctgaacctggacagcaaccacatcaccggcaagggcatcctggccatcttcagagccctgctgcagaacaacaccctgaccgagctgagattccacaaccagagacacatctgcggcggcaagaccgagatggagatcgccaagctgctgaaggagaacaccaccctgctgaagctgggctaccacttcgagctggccggccccagaatgaccgtgaccaacctgctgagcagaaacatggacaagcagagacagaagagactgcaggagcagagacaggcccaggaggccaagggcgagaagaaggacctgctggaggtgcccaaggccggcgccgtggccaagggcagccccaagcccagcccccagcccagccccaagcccagccccaagaacagccccaagaagggcggcgcccccgccgcccccccccccccccccccccccctggccccccccctgatcatggagaacctgaagaacagcctgagccccgccacccagagaaagatgggcgacaaggtgctgcccgcccaggagaagaacagcagagaccagctgctggccgccatcagaagcagcaacctgaagcagctgaagaagctggagctgcccctgctgctgcagtag

SEQ ID NO: 11605 - DNA, 201 bp, Artificial Sequence
  Description of Artificial Sequence: Synthetic coding sequence
atgatcggcaccaccgaggtgccctgctgcggccccagcgccacctgggccctgagatggagcgaccagatcaccctgcccagcctgccctggaccatgagcagcctgtggtgcatccccctgaagggcatgctggccacctgccccgtgagcctgctggagcacgcctacagcaacgccctgagaggctggaagccctag

SEQ ID NO: 11606 - DNA, 2121 bp, Artificial Sequence
  Description of Artificial Sequence: Synthetic coding sequence
atggccaccgccaacttcggcaagatccagatcggcatctacgtggagatcaagagaagcgacggcagaatccaccaggccatggtgaccagcctgaacgaggacaacgagagcgtgaccgtggagtggatcgagaacggcgacaccaagggcaaggagatcgacctggagagcatcttcagcctgaaccccgacctggtgcccgacgaggagatcgagcccagccccgagaccccccccccccccgccagcagcgccaaggtgaacaagatcgtgaagaacagaagaaccgtggccagcatcaagaacgacccccccagcagagacaacagagtggtgggcagcgccagagccagacccagccagttccccgagcagagcagcagcgcccagcagaacggcagcgtgagcgacatcagccccgtgcaggccgccaagaaggagttcggcccccccagcagaagaaagagcaactgcgtgaaggaggtggagaagctgcaggagaagagagagaagagaagactgcagcagcaggagctgagagagaagagagcccaggacgtggacgccaccaaccccaactacgagatcatgtgcatgatcagagacttcagaggcagcctggactacagacccctgaccaccgccgaccccatcgacgagcacagaatctgcgtgtgcgtgagaaagagacccctgaacaagaaggagacccagatgaaggacctggacgtgatcaccatccccagcaaggacgtggtgatggtgcacgagcccaagcagaaggtggacctgaccagatacctggagaaccagaccttcagattcgactacgccttcgacgacagcgcccccaacgagatggtgtacagattcaccgccagacccctggtggagaccatcttcgagagaggcatggccacctgcttcgcctacggccagaccggcagcggcaagacccacaccatgggcggcgacttcagcggcaagaaccaggactgcagcaagggcatctacgccctggccgccagagacgtgttcctgatgctgaagaagcccaactacaagaagctggagctgcaggtgtacgccaccttcttcgagatctacagcggcaaggtgttcgacctgctgaacagaaagaccaagctgagagtgctggaggacggcaagcagcaggtgcaggtggtgggcctgcaggagagagaggtgaagtgcgtggaggacgtgctgaagctgatcgacatcggcaacagctgcagaaccagcggccagaccagcgccaacgcccacagcagcagaagccacgccgtgttccagatcatcctgagaagaaagggcaagctgcacggcaagttcagcctgatcgacctggccggcaacgagagaggcgccgacaccagcagcgccgacagacagaccagactggagggcgccgagatcaacaagagcctgctggccctgaaggagtgcatcagagccctgggcagaaacaagccccacacccccttcagagccagcaagctgacccaggtgctgagagacagcttcatcggcgagaacagcagaacctgcatgatcgccaccatcagccccggcatggccagctgcgagaacaccctgaacaccctgagatacgccaacagagtgaaggagctgaccgtggaccccaccgccgccggcgacgtgagacccatcatgcaccacccccccaaccagatcgacgacctggagacccagtggggcgtgggcagcagcccccagagagacgacctgaagctgctgtgcgagcagaacgaggaggaggtgagcccccagctgttcaccttccacgaggccgtgagccagatggtggagatggaggagcaggtggtggaggaccacagagccgtgttccaggagagcatcagatggctggaggacgagaaggccctgctggagatgaccgaggaggtggactacgacgtggacagctacgccacccagctggaggccatcctggagcagaagatcgacatcctgaccgagctgagagacaaggtgaagagcttcagagccgccctgcaggaggaggagcaggccagcaagcagatcaaccccaagagacccagagccctgtag

SEQ ID NO: 11607 - DNA, 1281 bp, Artificial Sequence; identical to SEQ ID NO: 9897
  Description of Artificial Sequence: Synthetic coding sequence

SEQ ID NO: 11608 - DNA, 996 bp, Artificial Sequence
  Description of Artificial Sequence: Synthetic coding sequence
atgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagacccctggtgctgctgatccccctgagactgggcctgaccgacatcaacgaggcctacgtggagaccctgaagcactgcttcatgatgccccagagcctgggcgtgatcggcggcaagcccaacagcgcccactacttcatcggctacgtgggcgaggagctgatctacctggacccccacaccacccagcccgccgtggagcccaccgacggctgcttcatccccgacgagagcttccactgccagcaccccccctgcagaatgagcatcgccgagctggaccccagcatcgccgtgggcttcttctgcaagaccgaggacgacttcaacgactggtgccagcaggtgaagaagctgagcctgctgggcggcgccctgcccatgttcgagctggtggagctgcagcccagccacctggcctgccccgacgtgctgaacctgagcctgggcgagagctgccaggtgcaggtgggcagcctgggcgacagcagcgacgtggagagactggagagattcttcgacagcgaggacgaggacttcgagatcctgagcctgtag

SEQ ID NO: 11609 - DNA, 1461 bp, Artificial Sequence; identical to SEQ ID NO: 9447
  Description of Artificial Sequence: Synthetic coding sequence

SEQ ID NO: 11610 - DNA, 3075 bp, Artificial Sequence; identical to SEQ ID NO: 10542
  Description of Artificial Sequence: Synthetic coding sequence

SEQ ID NO: 11611 - DNA, 339 bp, Artificial Sequence
  Description of Artificial Sequence: Synthetic coding sequence
atggacgacaaggccagcgtgggcaagatcagcgtgagcagcgacagcgtgagcaccctgaacagcgaggacttcgtgctggtgagcagacagggcgacgagacccccagcaccaacaacggcagcgacgacgagaagaccggcctgaagatcgtgggcaacggcagcgagcagcagctgcagaaggagctggccgacgtgctgatggacccccccatggacgaccagcccggcgagaaggagctggtgaagagaagccagctggacggcgagggcgacggccccctgagcaaccagctgagcgccagcagcaccatcaaccccgtgcccctggtgtag

SEQ ID NO: 11612 - DNA, 441 bp, Artificial Sequence
  Description of Artificial Sequence: Synthetic coding sequence
atgctgaaggaggactgcgccagcgagctgaaggtgcacctggccaagagcctgcccctgcccagcagcgtgaacagacccagaatcgacctgatcgtgttcgtggtgaacctgcacagcaagtacagcctgcagaacaccgaggagagcctgagacacgtggacgccagcttcttcctgggcaaggtgtgcttcctggccaccggcgccggcagagagagccactgcagcatccacagacacaccgtggtgaagctggcccacacctaccagagccccctgctgtactgcgacctggaggtggagggcttcagagccaccatggcccagagactggtgagagtgctgcagatctgcgccggccacgtgcccggcgtgagcgccctgaacctgctgagcctgctgagaagcagcgagggccccagcctggaggacctgtag

SEQ ID NO: 11613 - DNA, 1203 bp, Artificial Sequence
  Description of Artificial Sequence: Synthetic coding sequence
atggccagcgacacccaggccgtgcccgacgtgagcggcagaagcagagccagaagatacgccgagtggagcagcggcctgagaagcggcagagccggcggcggcgagaccagcgtggagagaagaagaacctgcgccttcgacaccctggaggccttcctgatcatggacggcgaggacatccccgacttcagcagcctgaaggaggagaccgcctactggaaggagctgagcctgaagtacaagcagagcttccaggaggccagagacgagctggtggagttccaggagggcagcagagagctggaggccgagctggaggcccagctggtgcaggccgagcagagaaacagagacctgcaggccgacaaccagagactgaagtacgaggtggaggccctgaaggagaagctggagcaccagtacgcccagagctacaagcaggtgagcgtgctggaggacgacctgagccagaccagagccatcaaggagcagctgcacaagtacgtgagagagctggagcaggccaacgacgacctggagagagccaagagagccaccatcgtgagcctggaggacttcgagcagagactgaaccaggccatcgagagaaacgccttcctggagagcgagctggacgagaaggagagcctgctggtgagcgtgcagagactgaaggacgaggccagagacctgagacaggagctggccgtgagagagagacagcaggaggtgaccagaaagagcgcccccagcagccccaccctggactgcgagaagatggacagcgccgtgcaggccagcctgagcctgcccgccacccccgtgggcaagggcaccgagaacaccttccccagccccaaggccatccccaacggcttcggcaccagccccctgacccccagcgccagaatcagcgccctgaacatcgtgggcgacctgctgagaaaggtgggcgccctggagagcaagctggccgcctgcagaaacttcgccaaggaccaggccagcagaaagagctacatcagcggcaacgtgaactgcggcgtgctgaacggcaacggcaccaagttcagcagaagcggccacaccagcttcttcgacaagggcgccgtgaacggcttcgaccccgccccccccccccccggcctgggcagcagcagacccagcagcgcccccggcatgctgcccctgagcgtgtag

SEQ ID NO: 11614 - DNA, 699 bp, Artificial Sequence
  Description of Artificial Sequence: Synthetic coding sequence
atgacccccccccagcagcccccccccctgagaagcgagcccggcaccctgggcagcgccgccagcagctacagccccctgggcctgaacggcgtgcccggcagcatctgggacttcgtgagcggcagcttcagccccagccccagccccatcctgagcgccggcccccccagcagcagcagcgccagccccaacggcgccgagctggccagagtgagaagacagctggacgaggccaagagaaagatcagacagtgggaggagagctggcagcaggtgaagcaggtgtgcgacgcctggcagagagaggcccaggaggccaaggagagagccagagtggccgacagcgacagacagctggccctgcagaagaaggaggaggtggaggcccaggtgaagcagctgcaggaggagctggagggcctgggcgtggccagcaccctgcccggcctgagaggctgcggcgacatcggcaccatccccctgcccaagctgcacagcctgcagagccagctgagactggacctggaggccgtggacggcgtgatcttccagctgagagccaagcagtgcgtggcctgcagagagagagcccacggcgccgtgctgagaccctgccagcaccacatcctgtgcgagccctgcgccgccaccgcccccgagtgcccctactgcaagggccagcccctgcagtggtag

SEQ ID NO: 11615 - DNA, 1500 bp, Artificial Sequence
  Description of Artificial Sequence: Synthetic coding sequence
atgctgccctggccccccgccctggccatgcccatgcccaccgagggcacccccccccccctgagcggcacccccatccccgtgcccgcctacttcagacacgccgagcccggcttcagcctgaagagacccagaggcctgagcagaagcctgcccccccccccccccgccaagggcagcatccccatcagcagactgttcccccccagaacccccggctggcaccagctgcagcccagaagagtgagcttcagaggcgaggccagcgagaccctgcagagccccggctacgaccccagcagacccgagagcttcttccagcagagcttccagagactgagcagactgggccacggcagctacggcgaggtgttcaaggtgagaagcaaggaggacggcagactgtacgccgtgaagagaagcatgagccccttcagaggccccaaggacagagccagaaagctggccgaggtgggcagccacgagaaggtgggccagcacccctgctgcgtgagactggagcaggcctgggaggagggcggcatcctgtacctgcagaccgagctgtgcggccccagcctgcagcagcactgcgaggcctggggcgccagcctgcccgaggcccaggtgtggggctacctgagagacaccctgctggccctggcccacctgcacagccagggcctggtgcacctggacgtgaagcccgccaacatcttcctgggccccagaggcagatgcaagctgggcgacttcggcctgctggtggagctgggcaccgccggcgccggcgaggtgcaggagggcgaccccagatacatggcccccgagctgctgcagggcagctacggcaccgccgccgacgtgttcagcctgggcctgaccatcctggaggtggcctgcaacatggagctgccccacggcggcgagggctggcagcagctgagacagggctacctgccccccgagttcaccgccggcctgagcagcgagctgagaagcgtgctggtgatgatgctggagcccgaccccaagctgagagccaccgccgaggccctgctggccctgcccgtgctgagacagcccagagcctggggcgtgctgtggtgcatggccgccgaggccctgagcagaggctgggccctgtggcaggccctgctggccctgctgtgctggctgtggcacggcctggcccaccccgccagctggctgcagcccctgggcccccccgccaccccccccggcagccccccctgcagcctgctgctggacagcagcctgagcagcaactgggacgacgacagcctgggccccagcctgagccccgaggccgtgctggccagaaccgtgggcagcaccagcacccccagaagcagatgcacccccagagacgccctggacctgagcgacatcaacagcgagccccccagaggcagcttccccagcttcgagcccagaaacctgctgagcctgttcgaggacaccctggaccccacctag

SEQ ID NO: 11616 - DNA, 3153 bp, Artificial Sequence; identical to SEQ ID NO: 9469
  Description of Artificial Sequence: Synthetic coding sequence

SEQ ID NO: 11617 - DNA, 363 bp, Artificial Sequence
  Description of Artificial Sequence: Synthetic coding sequence
atgagcatcggcgtgcccatcaaggtgctgcacgaggccgagggccacatcgtgacctgcgagaccaacaccggcgaggtgtacagaggcaagctgatcgaggccgaggacaacatgaactgccagatgagcaacatcaccgtgacctacagagacggcagagtggcccagctggagcaggtgtacatcagaggcagcaagatcagattcctgatcctgcccgacatgctgaagaacgcccccatgctgaagagcatgaagaacaagaaccagggcagcggcgccggcagaggcaaggccgccatcctgaaggcccagggctacctgagcagcctggagtgggtgctggtgcacatctgctag

SEQ ID NO: 11618 - DNA, 1182 bp, Artificial Sequence; identical to SEQ ID NO: 10754
  Description of Artificial Sequence: Synthetic coding sequence

SEQ ID NO: 11619 - DNA, 228 bp, Artificial Sequence
  Description of Artificial Sequence: Synthetic coding sequence
atgagcccccagaagagagtgaagaacgtgcaggcccagaacagaaccagccagggcagcagcagcttccagaccaccctgagcgcctggaaggtgaagcaggaccccagcaacagcaagaacatcagcaagcacggccagaacaaccccgtgggcgactacgagcacgccgacgaccaggccgaggaggacgccctgcagatggccgtgggctacttcgagaagtag

SEQ ID NO: 11620 - DNA, 996 bp, Artificial Sequence
  Description of Artificial Sequence: Synthetic coding sequence
atggccttcgtgaccagacagttcatgagaagcgtgagcagcagcagcaccgccagcgccagcgccaagaagatcatcgtgaagcacgtgaccgtgatcggcggcggcctgatgggcgccggcatcgcccaggtggccgccgccaccggccacaccgtggtgctggtggaccagaccgaggacatcctggccaagagcaagaagggcatcgaggagagcctgagaaaggtggccaagaagaagttcgccgagaacctgaaggccggcgacgagttcgtggagaagaccctgagcaccatcgccaccagcaccgacgccgccagcgtggtgcacagcaccgacctggtggtggaggccatcgtggagaacctgaaggtgaagaacgagctgttcaagagactggacaagttcgccgccgagcacaccatcttcgccagcaacaccagcagcctgcagatcaccagcatcgccaacgccaccaccagacaggacagattcgccggcctgcacttcttcaaccccgtgcccgtgatgaagctggtggaggtgatcaagacccccatgaccagccagaagaccttcgagagcctggtggacttcagcaaggccctgggcaagcaccccgtgagctgcaaggacacccccggcttcatcgtgaacagactgctggtgccctacctgatggaggccatcagactgtacgagagagacttccagacctgcggcgacagcaacagcggcctgggcttcagcctgaagggcgacgccagcaaggaggacatcgacaccgccatgaagctgggcgccggctaccccatgggccccttcgagctgctggactacgtgggcctggacaccaccaagttcatcgtggacggctggcacgagatggacgccgagaaccccctgcaccagcccagccccagcctgaacaagctggtggccgagaacaagttcggcaagaagaccggcgagggcttctacaagtacaagtag

SEQ ID NO: 11621 - DNA, 1281 bp, Artificial Sequence; identical to SEQ ID NO: 9897
  Description of Artificial Sequence: Synthetic coding sequence

SEQ ID NO: 11622 - DNA, 1290 bp, Artificial Sequence
  Description of Artificial Sequence: Synthetic coding sequence
atgcccaacgtgctgctgccccccaaggagagcaacctgttcaagagaatcctgaagtgctacgagcagaagcagtacaagaacggcctgaagttctgcaagatgatcctgagcaaccccaagttcgccgagcacggcgagaccctggccatgaagggcctgaccctgaactgcctgggcaagaaggaggaggcctacgagttcgtgagaaagggcctgagaaacgacgtgaagagccacgtgtgctggcacgtgtacggcctgctgcagagaagcgacaagaagtacgacgaggccatcaagtgctacagaaacgccctgaagctggacaaggacaacctgcagatcctgagagacctgagcctgctgcagatccagatgagagacctggagggctacagagagaccagataccagctgctgcagctgagacccacccagagagccagctggatcggctacgccatcgcctaccacctgctgaaggactacgacatggccctgaagctgctggaggagttcagacagacccagcaggtgccccccaacaagatcgactacgagtacagcgagctgatcctgtaccagaaccaggtgatgagagaggccgacctgctgcaggagagcctggagcacatcgagatgtacgagaagcagatctgcgacaagctgctggtggaggagatcaagggcgagatcctgctgaagctgggcagactgaaggaggccagcgaggtgttcaagaacctgatcgacagaaacgccgagaactggtgctactacgagggcctggagaaggccctgcagatcagcaccctggaggagagactgcagatctacgaggagatcagcaagcagcaccccaaggccatcacccccagaagactgcccctgaccctggtgcccggcgagagattcagagagctgatggacaagttcctgagagtgaacttcagcaagggctgcccccccctgttcaccaccctgaagagcctgtactacaacaccgagaaggtgagcatcatccaggagctggtgaccaactacgaggccagcctgaagacctgcgacttcttcagcccctacgagaacggcgagaaggagccccccaccaccctgctgtgggtgcagtacttcctggcccagcacttcgacaagctgggccagtacagcctggccctggactacatcaacgccgccatcgccagcacccccaccctgatcgagctgttctacatgaaggccaagatctacaaggtgaagagcgagagctgcttcctgagcagctag

SEQ ID NO: 11623 - DNA, 360 bp, Artificial Sequence
  Description of Artificial Sequence: Synthetic coding sequence
atggacaagaacatcggcgagcagctgaacaaggcctacgaggccttcagacaggcctgcatggacagagacagcgccgtgaaggagctgcagcagaagaccgagaactacgagcagagaatcagagagcagcaggagcagctgagcctgcagcagaccatcatcgacaagctgaagagccagctgctgctggtgaacagcacccaggacaacaactacggctgcgtgcccctgctggaggacagcgagaccagaaagaacaacctgaccctggaccagccccaggacaaggtgatcagcggcatcgccagagagaagctgcccaaggtggacatcgccagcgccgagagcagcatctag

SEQ ID NO: 11624 - DNA, 699 bp, Artificial Sequence; identical to SEQ ID NO: 11614
  Description of Artificial Sequence: Synthetic coding sequence

SEQ ID NO: 11625 - DNA, 1461 bp, Artificial Sequence; identical to SEQ ID NO: 9447
  Description of Artificial Sequence: Synthetic coding sequence

SEQ ID NO: 11626 - DNA, 3075 bp, Artificial Sequence; identical to SEQ ID NO: 10542
  Description of Artificial Sequence: Synthetic coding sequence

SEQ ID NO: 11627 - DNA, 1767 bp, Artificial Sequence; identical to SEQ ID NO: 9996
  Description of Artificial Sequence: Synthetic coding sequence

SEQ ID NO: 11628 - DNA, 666 bp, Artificial Sequence
  Description of Artificial Sequence: Synthetic coding sequence
atgctgaagaacaagggccacagcagcaagaaggacaacctggccgtgaacgccgtggccctgcaggaccacatcctgcacgacctgcagctgagaaacctgagcgtggccgaccacagcaagacccaggtgcagaagaaggagaacaagagcctgaagagagacaccaaggccatcatcgacaccggcctgaagaagaccacccagtgccccaagctggaggacagcgagaaggagtacgtgctggaccccaagcccccccccctgaccctggcccagaagctgggcctgatcggccccccccccccccccctgagcagcgacgagtgggagaaggtgaagcagagaagcctgctgcagggcgacagcgtgcagccctgccccatctgcaaggaggagttcgagctgagaccccaggtgctgctgagctgcagccacgtgttccacaaggcctgcctgcaggccttcgagaagttcaccaacaagaagacctgccccctgtgcagaaagaaccagtaccagaccagagtgatccacgacggcgccagactgttcagaatcaagtgcgtgaccagaatccaggcctactggagaggctgcgtggtgagaaagtggtacagaaacctgagaaagaccgtgccccccaccgacgccaagctgagatag

SEQ ID NO: 11629 - DNA, 900 bp, Artificial Sequence; identical to SEQ ID NO: 9591
  Description of Artificial Sequence: Synthetic coding sequence

SEQ ID NO: 11630 - DNA, 2193 bp, Artificial Sequence
  Description of Artificial Sequence: Synthetic coding sequence
atggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 11631 - DNA, 1563 bp, Artificial Sequence
  Description of Artificial Sequence: Synthetic coding sequence
atgttcgtgagcgacttcagaaaggagttctacgaggtggtgcagagccagagagtgctgctgttcgtggccagcgacgtggacgccctgtgcgcctgcaagatcctgcaggccctgttccagtgcgaccacgtgcagtacaccctggtgcccgtgagcggctggcaggagctggagaccgccttcctggagcacaaggagcagatcaagctgctgatcaagcaggacgacgacctggaggtgcccgcctacgaggacatcttcagagacgaggaggaggacgaggagcacagcggcaacgacagcgacggcagcgagcccagcgagaagagaaccagactggaggaggagatcgtggagcagaccatgagaagaagacagagaagagagtgggaggccagaagaagagacatcctgttcgactacgagcagtacgagtaccacggcaccagcagcgccatggtgatgttcgagctggcctggatgctgagcaaggacctgaacgacatgctgtggtgggccatcgtgggcctgaccgaccagtgggtgcaggacaagatcacccagatgaagtacgtgaccgacgtgggcgtgctgcagagacacgtgagcagacacaaccacagaaacgaggacgaggagaacaccctgagcgtggactgcaccagaatcagcttcgagtacgacctgagactggtgctgtaccagcactggagcctgcacgacagcctgtgcaacaccagctacaccgccgccagattcaagctgtggagcgtgcacggccagaagagactgcaggagttcctggccgacatgggcctgcccctgaagcaggtgaagcagaagttccaggccatggacatcagcctgaaggagaacctgagagagatgatcgaggagagcgccaacaagttcggcatgaaggacatgagagtgcagaccttcagcatccacttcggcttcaagcacaagttcctggccagcgacgtggtgttcgccaccatgagcctgatggagagccccgagaaggacggcagcggcaccgaccacttcatccaggccctggacagcctgagcagaagcaacctggacaagctgtaccacggcctggagctggccaagaagcagctgagagccacccagcagaccatcgccagctgcctgtgcaccaacctggtgatcagccagggccccttcctgtactgcagcctgatggagggcacccccgacgtgatgctgttcagcagacccgccagcctgagcctgctgagcaagcacctgctgaagagcttcgtgtgcagcaccaagaacagaagatgcaagctgctgcccctggtgatggccgcccccctgagcatggagcacggcaccgtgaccgtggtgggcatcccccccgagaccgacagcagcgacagaaagaacttcttcggcagagccttcgagaaggccgccgagagcaccagcagcagaatgctgcacaaccacttcgacctgagcgtgatcgagctgaaggccgaggacagaagcaagttcctggacgccctgatcagcctgctgagctag

SEQ ID NO: 11632 - DNA, 567 bp, Artificial Sequence; identical to SEQ ID NO: 10128
  Description of Artificial Sequence: Synthetic coding sequence

SEQ ID NO: 11633 - DNA, 1182 bp, Artificial Sequence
  Description of Artificial Sequence: Synthetic coding sequence
atggacgccgccaccctgacctacgacaccctgagattcgccgagttcgaggacttccccgagaccagcgagcccgtgtggatcctgggcagaaagtacagcatcttcaccgagaaggacgagatcctgagcgacgtggccagcagactgtggttcacctacagaaagaacttccccgccatcggcggcaccggccccaccagcgacaccggctggggctgcatgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagacccctggtgctgctgatccccctgagactgggcctgaccgacatcaacgaggcctacgtggagaccctgaagcactgcttcatgatgccccagagcctgggcgtgatcggcggcaagcccaacagcgcccactacttcatcggctacgtgggcgaggagctgatctacctggacccccacaccacccagcccgccgtggagcccaccgacggctgcttcatccccgacgagagcttccactgccagcaccccccctgcagaatgagcatcgccgagctggaccccagcatcgccgtgggcttcttctgcaagaccgaggacgacttcaacgactggtgccagcaggtgaagaagctgagcctgctgggcggcgccctgcccatgttcgagctggtggagctgcagcccagccacctggcctgccccgacgtgctgaacctgagcctggacagcagcgacgtggagagactggagagattcttcgacagcgaggacgaggacttcgagatcctgagcctgtag

SEQ ID NO: 11634 - DNA, 780 bp, Artificial Sequence; identical to SEQ ID NO: 9811
  Description of Artificial Sequence: Synthetic coding sequence

SEQ ID NO: 11635 - DNA, 852 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtgaagctgctgttcgagagaggcaaggaggccctggagagcgagttcagaagcctgatgaccagacacagcaaggtggtgagccccgtgctgatcctggacctgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggcgagccccccagctggcccatcagcgccaccgccagaggctag

SEQ ID NO: 11636 - DNA, 2121 bp, Artificial Sequence
  Description of Artificial Sequence: Synthetic coding sequence
atgaacgaggccatggccaccgacagccccagaagacccagcagatgcaccggcggcgtggtggtgagaccccaggccgtgaccgagcagagctacatggagagcgtggtgaccttcctgcaggacgtggtgccccaggcctacagcggcacccccctgaccgaggagaaggagaagatcgtgtgggtgagattcgagaacgccgacctgaacgacaccagcagaaacctggagttccacgagatccacagcaccggcaacgagccccccctgctgatcatgatcggctacagcgacggcatgcaggtgtggagcatccccatcagcggcgaggcccaggagctgttcagcgtgagacacggccccatcagagccgccagaatcctgcccgccccccagttcggcgcccagaagtgcgacaacttcgccgagaagagacccctgctgggcgtgtgcaagagcatcggcagcagcggcaccagccccccctactgctgcgtggacctgtacagcctgagaaccggcgagatggtgaagagcatccagttcaagacccccatctacgacctgcactgcaacaagagaatcctggtggtggtgctgcaggagaagatcgccgccttcgacagctgcaccttcaccaagaagttcttcgtgaccagctgctacccctgccccggccccaacatgaaccccatcgccctgggcagcagatggctggcctacgccgagaacaagctgatcagatgccaccagagcagaggcggcgcctgcggcgacaacatccagagctacaccgccaccgtgatcagcgccgccaagaccctgaagagcggcctgaccatggtgggcaaggtggtgacccagctgaccggcaccctgcccagcggcgtgaccgaggacgacgtggccatccacagcaacagcagaagaagccccctggtgcccggcatcatcaccgtgatcgacaccgagaccgtgggcgagggccaggtgctggtgagcgaggacagcgacagcgacggcatcgtggcccacttccccgcccacgagaagcccgtgtgctgcatggccttcaacaccagcggcatgctgctggtgaccaccgacaccctgggccacgacttccacgtgttccagatcctgacccacccctggagcagcagccagtgcgccgtgcaccacctgtacaccctgcacagaggcgagaccgaggccaaggtgcaggacatctgcttcagccacgactgcagatgggtggtggtgagcaccctgagaggcaccagccacgtgttccccatcaacccctacggcggccagccctgcgtgagaacccacatgagccccagagtggtgaacagaatgagcagattccagaagagcgccggcctggaggagatcgagcaggagctgaccagcaagcagggcggcagatgcagccccgtgcccggcctgagcagcagccccagcggcagccccctgcacggcaagctgaacagccaggacagctacaacaacttcaccaacaacaaccccggcaaccccagactgagccccctgcccagcctgatggtggtgatgcccctggcccagatcaagcagcccatgaccctgggcaccatcaccaagagaaccggcccctacctgttcggcgccggctgcttcagcatcaaggccccctggagctacatcatgaccaagtacatcttctacatcaagccccccaacaaggtgaagccccccccccagatcagccccagcaagagcatgggcggcgagttctgcgtggccgccatcttcggcaccagcagaagctggttcgccaacaacgccggcctgaagagagagaaggaccagagcaagcaggtggtggtggagagcctgtacatcatcagctgctacggcaccctggtggagcacatgatggagcccagacccctgagcaccgcccccaagatcagcgacgacacccccctggagatgatgaccagccccagagccagctggaccctggtgagaaccccccagtggaacgagctgcagccccccttcaacgccaaccaccccctgctgctggccgccgacgccgtgcagtactaccagttcctgctggccggctag

SEQ ID NO: 11637 - DNA, 1815 bp, Artificial Sequence
  Description of Artificial Sequence: Synthetic coding sequence
atgggcggctgcttcagcaagcccaagcccggcgccgccctgcccaccgtggagctgaagatcgaggtggtgctgcccgagaaggagagaggcaaggaggagctgagcgccagcggcaagggcagccccagagcctaccagggcaacggcaccgccagacacttccacaccgaggagagactgagcaccccccacccctaccccagcccccaggactgcgtggaggccgccgtgtgccacgtgaaggacctggagaacggccagatgagagaggtggagctgggctggggcaaggtgctgctggtgaaggacaacggcgagttccacgccctgggccacaagtgcccccactacggcgcccccctggtgaagggcgtgctgagcagaggcagagtgagatgcccctggcacggcgcctgcttcaacatcagcaccggcgacctggaggacttccccggcctggacagcctgcacaagttccaggtgaagatcgagaaggagaaggtgtacgtgagagccagcaagcaggccctgcagctgcagagaagaaccaaggtgatggccaagtgcatcagccccagcgccggctacagcagcagcaccaacgtgctgatcgtgggcgccggcgccgccggcctggtgtgcgccgagaccctgagacaggagggcttcagcgacagaatcgtgctgtgcaccctggacagacacctgccctacgacagacccaagctgagcaagagcctggacacccagcccgagcagctggccctgagacccaaggagttcttcagagcctacggcatcgaggtgctgaccgaggcccaggtggtgaccgtggacgtgagaaccaagaaggtggtgttcaaggacggcttcaagctggagtacagcaagctgctgctggcccccggcagcagccccaagaccctgagctgcaagggcaaggaggtggagaacgtgttcaccatcagaacccccgaggacgccaacagagtggtgagactggccagaggcagaaacgtggtggtggtgggcgccggcttcctgggcatggaggtggccgcctacctgaccgagaaggcccacagcgtgagcgtggtggagctggaggagacccccttcagaagattcctgggcgagagagtgggcagagccctgatgaagatgttcgagaacaacagagtgaagttctacatgcagaccgaggtgagcgagctgagaggccaggagggcaagctgaaggaggtggtgctgaagagcagcaaggtggtgagagccgacgtgtgcgtggtgggcatcggcgccgtgcccgccaccggcttcctgagacagagcggcatcggcctggacagcagaggcttcatccccgtgaacaagatgatgcagaccaacgtgcccggcgtgttcgccgccggcgacgccgtgaccttccccctggcctggagaaacaacagaaaggtgaacatcccccactggcagatggcccacgcccagggcagagtggccgcccagaacatgctggcccaggaggccgagatgagcaccgtgccctacctgtggaccgccatgttcggcaagagcctgagatacgccggctacggcgagggcttcgacgacgtgatcatccagggcgacctggaggagctgaagttcgtggccttctacaccaagggcgacgaggtgatcgccgtggccagcatgaactacgaccccatcgtgagcaaggtggccgaggtgctggccagcggcagagccatcagaaagagagaggtggagaccggcgacatgagctggctgaccggcaagggcagctag

SEQ ID NO: 11638 - DNA, 744 bp, Artificial Sequence
  Description of Artificial Sequence: Synthetic coding sequence
atgagcaccgccgccgtgcccgagctgaagcagatcagcagagtggaggccatgagactgggccccggctggagccacagctgccacgccatgctgtacgccgccaaccccggccagctgttcggcagaatccccatgagattcagcgtgctgatgcagatgagattcgacggcctgctgggcttccccggcggcttcgtggacagaagattctggagcctggaggacggcctgaacagagtgctgggcctgggcctgggctgcctgagactgaccgaggccgactacctgagcagccacctgaccgagggcccccacagagtggtggcccacctgtacgccagacagctgaccctggagcagctgcacgccgtggagatcagcgccgtgcacagcagagaccacggcctggaggtgggccccccccccggccccagacccccccccagaggcctggccctggccccctggaaggcccccatgggcaacaccagccccgagggccccctggccggcctgggcagagtgagcctgagccccgccatgggctggggcgagggcagcggcgccggcagacccggcaaggagggcagaggctggggccccgccctgggcctgccccagggctgcgtgaccagcgccctgctgcccgccatcgccaaccccggcagcggcggcgtgggcagcgtgggcagaaagggctggggcagaagcggcgactgcctgggcagctgggagacctag

SEQ ID NO: 11639 - DNA, 1338 bp, Artificial Sequence; identical to SEQ ID NO: 9613
  Description of Artificial Sequence: Synthetic coding sequence

SEQ ID NO: 11640 - DNA, 1335 bp, Artificial Sequence
  Description of Artificial Sequence: Synthetic coding sequence
ttcagagtgcccgccgccggcagaagatgccccctggccagaggcgccagaagaccccccgacagcgcctgcggcagattcccccccgaccccggcagcccccccgaggaggaggacgccgacctgagcgagagagaggagagctggctgctggccgagagagaggagaaccaggaggccgagttccccggcctgagaagagccgtgcagctgaacctgagcagacccatcgaggagcagggccccctggacgtgatcatccacaagctgaccgacgtgatcctggaggccgaccagaacgacagccagagcctggagctggtgcacagattccaggagtacatcgacgcccaccccgagaccatcgtgctggaccccctgcccgccatcagaaccctgctggacagaagcaagagctacgagctgatcagaaagatcgaggcctacatggaggacgacagaatctgcagcccccccttcatggagctgaccagcctgtgcggcgacgacaccatgagactgctggagaagaacggcctgaccttccccttcatctgcaagaccagagtggcccacggcaccaacagccacgagatggccatcgtgttcaaccaggagggcctgaacgccatccagcccccctgcgtggtgcagaacttcatcaaccacaacgccgtgctgtacaaggtgttcgtggtgggcgagagctacaccgtggtgcagagacccagcctgaagaacttcagcgccggcaccagcgacagagagagcatcttcttcaacagccacaacgtgagcaagcccgagagcagcagcgtgctgaccgagctggacaagatcgagggcgtgttcgagagacccagcgacgaggtgatcagagagctgagcagagccctgagacaggccctgggcgtgagcctgttcggcatcgacatcatcatcaacaaccagaccggccagcacgccgtgatcgacatcaacgccttccccggctacgagggcgtgagcgagttcttcaccgacctgctgaaccacatcgccaccgtgctgcagggccagagcaccgccatggccgccaccggcgacgtggccctgctgagacacagcaagctgctggccgagcccgccggcggcctggtgggcgagagaacctgcagcgccagccccggctgctgcggcagcatgatgggccaggacgccccctggaaggccgaggccgacgccggcggcaccgccaagctgccccaccagagactgggctgcaacgccggcgtgagccccagcttccagcagcactgcgtggccagcctggccaccaaggccagcagccagtag

SEQ ID NO: 11641 - DNA, 864 bp, Artificial Sequence
  Description of Artificial Sequence: Synthetic coding sequence
atgtgcggcagaagaagaagacagagagccgccctgctgagccactgggaccccaccctgagcagcgactgggacggcgagagaaccgccccccagtgcctgctgagaatcaagagagacatcatgagcatctacaaggagcccccccccggcatgttcgtggtgcccgacaccgtggacatgaccaagatccacgccctgatcaccggccccttcgacaccccctacgagggcggcttcttcctgttcgtgttcagatgcccccccgactaccccatccacccccccagagtgaagctgatgaccaccggcaacaacaccgtgagattcaaccccaacttctacagaaacggcaaggtgtgcctgagcatcctgggcacctggaccggccccgcctggagccccgcccagagcatcagcagcgtgctgatcagcatccagagcctgatgaccgagaacccctaccacaacgagcccggcttcgagcaggagagacaccccggcgacagcaagaactacaacgagtgcatcagacacgagaccatcagagtggccgtgtgcgacatgatggagggcaagtgcccctgccccgagcccctgagaggcgtgatggagaagagcttcctggagtactacgacttctacgaggtggcctgcaaggacagactgcacctgcagggccagaccatgcaggaccccttcggcgagaagagaggccacttcgactaccagagcctgctgatgagactgggcctgatcagacagaaggtgctggagagactgcacaacgagaacgccgagatggacagcgacagcagcagcagcggcaccgagaccgacctgcacggcagcctgagagtgtag

SEQ ID NO: 11642 - DNA, 852 bp, Artificial Sequence
  Description of Artificial Sequence: Synthetic coding sequence
cccccctgcagcctgatcagcgactgctgcgccggcaaccagagagacagcgtgggcgtgggccccagcgagcccggctgctacccctgccccggccccaacatgaaccccatcgccctgggcagcagatggctggcctacgccgagaacaagctgatcagatgccaccagagcagaggcggcgcctgcggcgacaacatccagagctacaccgccaccgtgatcagcgccgccaagaccctgaagagcggcctgaccatggtgggcaaggtggtgacccagctgaccggcaccctgcccagcggcgtgaccgaggacgacgtggccatccacagcaacagcagaagaagccccctggtgcccggcatcatcaccgtgatcgacaccgagaccgtgggcgagggccaggtgctggtgagcgaggacagcgacagcgacggcatcgtggcccacttccccgcccacgagaagcccgtgtgctgcatggccttcaacaccagcggcatgctgctggtgaccaccgacaccctgggccacgacttccacgtgttccagatcctgacccacccctggagcagcagccagtgcgccgtgcaccacctgtacaccctgcacagaggcgagaccgaggccaaggtgcaggacatctgcttcagccacgactgcagatgggtggtggtgagcaccctgagaggcaccagccacgtgttccccatcaacccctacggcggccagccctgcgtgagaacccacatgagccccagagtggtgaacagaatgagcagattccagaagagcgccggcctggaggagatcgagcaggagctgaccagcaagcagggcggcagatag

SEQ ID NO: 11643 - DNA, 2235 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcagagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcagagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 11644 - DNA, 1089 bp, Artificial Sequence; identical to SEQ ID NO: 9912
  Description of Artificial Sequence: Synthetic coding sequence

SEQ ID NO: 11645 - DNA, 2130 bp, Artificial Sequence
  Description of Artificial Sequence: Synthetic coding sequence
atggccgacgccggcatcagaagagtggtgcccagcgacctgtaccccctggtgctgggcttcctgagagacaaccagctgagcgaggtggccaacaagttcgccaaggccaccggcgccacccagcaggacgccaacgccagcagcctgctggacatctacagcttctggctgaagagcgccaaggtgcccgagagaaagctgcaggccaacggccccgtggccaagaaggccaagaagaaggccagcagcagcgacagcgaggacagcagcgaggaggaggaggaggtgcagggcccccccgccaagaaggccgccgtgcccgccaagagagtgggcctgccccccggcaaggccgccgccaaggccagcgagagcagcagcagcgaggagagcagcgacgacgacgacgaggaggaccagaagaagcagcccgtgcagaagggcgtgaagccccaggccaaggccgccaaggccccccccaagaaggccaagagcagcgacagcgacagcgacagcagcagcgaggacgagccccccaagaaccagaagcccaagatcacccccgtgaccgtgaaggcccagaccaaggccccccccaagcccgccagagccgcccccaagatcgccaacggcaaggccgccagcagcagcagcagcagcagcagcagcagcagcagcgacgacagcgaggaggagaaggccgccgccacccccaagaaggtgtggaccatcaccagcgtgagagccgagaccgtgcccaagaagcaggtggtggccaaggcccccgtgaaggccgccaccacccccaccagaaagagcagcagcagcgaggacagcagcagcgacgaggaggaggagcagaagaagcccatgaagaacaagcccggcccctacagcagcgtgcccccccccagcgcccccccccccaagaagagcctgggcacccagccccccaagaaggccgtggagaagcagcagcccgtggagagcagcgaggacagcagcgacgagagcgacagcagcagcgaggaggagaagaagccccccaccaaggccgtggtgagcaaggccaccaccaagcccccccccgccaagaaggccgccgagagcagcagcgacagcagcgacagcgacagcagcgaggacgacgaggcccccagcaagcccgccggcaccaccaagaacagcagcaacaagcccgccgtgaccaccaagagccccgccgtgaagcccgccgccgcccccaagcagcccgtgggcggcggccagaagctgctgaccagaaaggccgacagcagcagcagcgaggaggagagcagcagcagcgaggaggagaagaccaagaagatggtggccaccaccaagcccaaggccaccgccaaggccgccctgagcctgcccgccaagcaggccccccagggcagcagagacagcagcagcgacagcgacagcagcagcagcgaggaggaggaggagaagaccagcaagagcgccgtgaagaagaagccccagaaggtggccggcggcgccgcccccagcaagcccgccagcgccaagaagggcaaggccgagagcagcaacagcagcagcagcgacgacagcagcgaggaggaggaggagaagctgaagggcaagggcagccccagaccccaggcccccaaggccaacggcaccagcgccctgaccgcccagaacggcaaggccgccaagaacagcgaggaggaggaggaggagaagaagaaggccgccgtggtggtgagcaagagcggcagcctgaagaagagaaagcagaacgaggccgccaaggaggccgagaccccccaggccaagaagatcaagctgcagacccccaacaccttccccaagagaaagaagggcgagaagagagccagcagccccttcagaagagtgagagaggaggagatcgaggtggacagcagagtggccgacaacagcttcgacgccaagagaggcgccgccggcgactggggcgagagagccaaccaggtgctgaagttcaccaagggcaagagcttcagacacgagaagaccaagaagaagagaggcagctacagaggcggcagcatcagcgtgcaggtgaacagcatcaagttcgacagcgagtag

SEQ ID NO: 11646 - DNA, 558 bp, Artificial Sequence; identical to SEQ ID NO: 10639
  Description of Artificial Sequence: Synthetic coding sequence

SEQ ID NO: 11647 - DNA, 1764 bp, Artificial Sequence; identical to SEQ ID NO: 10411
  Description of Artificial Sequence: Synthetic coding sequence

SEQ ID NO: 11648 - DNA, 1098 bp, Artificial Sequence
  Description of Artificial Sequence: Synthetic coding sequence
atgaaggagctgtggtgcgtgatggactgggccgtgcccggcctgctgggcagcggcacctacttcaagaagcagttcagcgaccccgtggagcacggccagagacacaccgccaccaagagagagctggccaccggcagaaaggccatgcagagactggccaagaagatgagcggctggttcctgagaagaaccaagaccctgatcaaggaccagctgcccaagaaggaggacagaatggtgtactgcagcctgaccgacttccagaaggccgtgtaccagaccgtgctggagaccgaggacgtgaccctgatcctgcagagcagcgagccctgcacctgcagaagcggccagaagagaagaaactgctgctacaagaccaacagccacggcgagaccgtgaagaccctgtacctgagctacctgaccgtgctgcagaaggtggccaaccacgtggccctgctgcaggccgccagcaccagcaagcagcaggagaccctgatcaagagaatctgcgaccaggtgttcagcagattccccgacttcgtgcagaagagcaaggacgccgccttcgagaccctgagcgaccccaagtacagcggcaagatgaaggtgctgcagcagctgctgaaccactgcagaaagaacagagacaaggtgctgctgttcagcttcagcaccaagctgctggacgtgctgcagcagtactgcatggccagcggcctggactacagaagactggacggcagcaccaagagcgaggagagactgaagatcgtgaaggagttcaacagcacccaggacgtgaacatctgcctggtgagcaccatggccggcggcctgggcctgaacttcgtgggcgccaacgtggtggtgctgttcgaccccacctggaaccccgccaacgacctgcaggccatcgacagaacccagacccactgcagaagagagagagacgccgagcccctgagcagcgcccccggcctgcagaacggcagcgagaacgccgtgccctacccctggtggtgctgcgtgaccggcgccagcatcagctgctggagatgcgagatctgcagaatccaggacgtgctggagtag

SEQ ID NO: 11649 - DNA, 1104 bp, Artificial Sequence
  Description of Artificial Sequence: Synthetic coding sequence
atggagaagaagaagatggtgacccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgacccagaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcatccccggcttcccctaccccaccgccgccaccaccgccgccgccttcagaggcgcccacctgagaggcagaggcagaaccgtgtacggcgccgtgagagccgtgccccccaccgccatccccgcctaccccggcgtggacatgcagcccaccgacatgcacagcctgctgctgcagccccagccccccctgctgcagcccctgcagcccctgaccgtgaccgtgatggccggctgcacccagcccacccccaccatgcccctgcccctgcccctggccatggagctggccctgtggagagtgtacaccgaggtggccaccgccgacctgccccccaccgaggtgacctag

SEQ ID NO: 11650 - DNA, 1764 bp, Artificial Sequence; identical to SEQ ID NO: 10411
  Description of Artificial Sequence: Synthetic coding sequence

SEQ ID NO: 11651 - DNA, 1143 bp, Artificial Sequence
  Description of Artificial Sequence: Synthetic coding sequence
atggacgccgccaccctgacctacgacaccctgagattcgccgagttcgaggacttccccgagaccagcgagcccgtgtggatcctgggcagaaagtacagcatcttcaccgagaaggacgagatcctgagcgacgtggccagcagactgtggttcacctacagaaagaacttccccgccatcggcggcaccggccccaccagcgacaccggctggggctgcatgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagacccctggtgctgctgatccccctgagactgggcctgaccgacatcaacgaggcctacgtggagaccctgaagcactgcttcatgatgccccagagcctgggcgtgatcggcggcaagcccaacagcgcccactacttcatcggctacgtgggcgaggagctgatctacctggacccccacaccacccagcccgccgtggagcccaccgacggctgcttcatccccgacgagagcttccactgccagcaccccccctgcagaatgagcatcgccgagctggaccccagcatcgccgtgggcttcttctgcaagaccgaggacgacttcaacgactggtgccagcaggtgaagaagctgagcctgctgggcggcgccctgcccatgttcgagctggtggagctgcagcccagccacctggcctgccccgacgtgctgaacctgagcctgggcgagagctgccaggtgcagatcctgctgatgtag

SEQ ID NO: 11652 - DNA, 2124 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtgaagctgctgttcgagagaggcaaggaggccctggagagcgagttcagaagcctgatgaccagacacagcaaggtggtgagccccgtgctgatcctggacctgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggcaccatcagaaaggcccagaacctgctgaagcagtacagccagcacggcctggacggcaagaagggcggcagcaacctgatccccctggagggccacgagcacgacttcagagtgaagcacctgagcgaggccctgaacgacaagcacggccccctggccggcagagacgacatgctggacgtggagaccgacgcctacatccactgcgtgagcgccttcgtgaagctggcccagagcgagtaccagctgctggccgacatcatccccgagcaccaccagaagaagaccttcgacagcctgatccaggacgccctggacggcctgatgctggagggcgagaacatcgtgagcgccgccagaaaggccatcgtgagacacgacttcagcaccgtgctgaccgtgttccccatcctgagacacctgaagcagaccaagcccgagttcgaccaggtgctgcagggcaccgccgccagcaccaagaacaagctgcccggcctgatcaccagcatggagaccatcggcgccaaggccctggaggacttcgccgacaacatcaagaacgaccccgacaaggagtacaacatgcccaaggacggcaccgtgcacgagctgaccagcaacgccatcctgttcctgcagcagctgctggacttccaggagaccgccggcgccatgctggccagccaggagaccagcagcagcgccaccagctacagcagcgagttcagcaagagactgctgagcacctacatctgcaaggtgctgggcaacctgcagctgaacctgctgagcaagagcaaggtgtacgaggaccccgccctgagcgccatcttcctgcacaacaactacaactacatcctgaagagcctggagaagagcgagctgatccagctggtggccgtgacccagaagaccgccgagagaagctacagagagcacatcgagcagcagatccagacctaccagagaagctggctgaaggtgaccgactacatcgccgagaagaacctgcccgtgttccagcccggcgtgaagctgagagacaaggagagacagatcatcaaggagagattcaagggcttcaacgacggcctggaggagctgtgcaagatccagaaggcctgggccatccccgacaccgagcagagagacagaatcagacaggcccagaagaccatcgtgaaggagacctacggcgccttcctgcagaagttcggcagcgtgcccttcaccaagaaccccgagaagtacatcaagtacggcgtggagcaggtgggcgacatgatcgacagactgttcgacaccagcgcctag

SEQ ID NO: 11653 - DNA, 1026 bp, Artificial Sequence; identical to SEQ ID NO: 10405
  Description of Artificial Sequence: Synthetic coding sequence

SEQ ID NO: 11654 - DNA, 1488 bp, Artificial Sequence
  Description of Artificial Sequence: Synthetic coding sequence
atggccggcgtgggcagaagcggcggcccctggggcagaaccagaggcggcagaagcggcagactgggcgtgagcctgggcgccctgagcagcctgcccctggaggagctgcccagacccctgtgctgcagaagatgcagaagacacttcggcttcgccctgagaggcgagaccatccccgtgagcgtggccggcagcgccagcagccagttcgcccccctggccctgcacctgagcctgctgctgagcagaatcagcgccagcagactgaccagatggcccccccccgacaagagagagggcagcgccgtggaccccggcaagagaagaagcctggccgccacccccagcagcagcctgccctgcaccctgatcgccctgggcctgagacacgagaaggaggccaacgagctgatggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacctgctggccctgggcctgaagcacttcgagggcaccgagttcctgaaccccctgatcagcaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggtgcagcccagcagcagcaagagcgtgggcggcagaagaagcctgaaggtgctgagagagtaccagggcctgccctag

SEQ ID NO: 11655 - DNA, 180 bp, Artificial Sequence
  Description of Artificial Sequence: Synthetic coding sequence
atggccgcccccggcgccctgctggtgatgggcgtgagcggcagcggcaactgggacggcaacagcatgatgctgatgatcatcaccagaagaaagatcgagggcagatgggagaaggcctacagaagcatgaccagaaccggcttccacggcagcgtgacctgcatgaccttctactag

SEQ ID NO: 11656 - DNA, 207 bp, Artificial Sequence
  Description of Artificial Sequence: Synthetic coding sequence
atgggcgagaccgagggcaagaaggacgaggccgactacaagagactgcagaccttccccctggtgagacacagcgacatgcccgaggagatgagagtggagaccatggagctgtgcgtgaccgcctgcgagaagttcagcaacaacaacgaggtgctgcccgccgtgcaggccgcccccagagccttcgacggcccctgcggctag

SEQ ID NO: 11657 - DNA, 2451 bp, Artificial Sequence; identical to SEQ ID NO: 10736
  Description of Artificial Sequence: Synthetic coding sequence

SEQ ID NO: 11658 - DNA, 1119 bp, Artificial Sequence; identical to SEQ ID NO: 9937
  Description of Artificial Sequence: Synthetic coding sequence

SEQ ID NO: 11659 - DNA, 480 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtggtgagaggcccccagaacaacgtgagaagcctgggcatcagcgtgagcgccctggtgagctag

SEQ ID NO: 11660 - DNA, 243 bp, Artificial Sequence
  Description of Artificial Sequence: Synthetic coding sequence
atggccagcgaggagctgcagaaggacctggaggaggtgaaggtgctgctggagaaggccaccagaaagagagtgagagacgccctgaccgccgagaagagcaagatcgagaccgagatcaagaacaagatgcagcagaagagccagaagaaggccgagctgctggacaacgagaagcccgccgccgtggtggcccccatcaccaccggctacaccgacggcatcagccagatcagcctgtag

SEQ ID NO: 11661 - DNA, 606 bp, Artificial Sequence
  Description of Artificial Sequence: Synthetic coding sequence
atgcccagcgagaccctgtgggagatcgccaaggccgaggtggagaagagaggcatcaacggcagcgagggcgacggcgccgagatcgccgagaagttcgtgttcttcatcggcagcaagaacggcggcaagaccaccatcatcctgagatgcctggacagagacgagccccccaagcccaccctggccctggagtacacctacggcagaagagccaagggccacaacacccccaaggacatcgcccacttctgggagctgggcggcggcaccagcctgctggacctgatcagcatccccatcaccggcgacaccctgagaaccttcagcctggtgctggtgctggacctgagcaagcccaacgacctgtggcccaccatggagaacctgctgcaggccaccaagagccacgtggacaaggtgatcatgaagctgggcaagaccaacgccaaggccgtgagcgagatgagacagaagatctggaacaacatgcccaaggaccaccccgtgagctgctgcctgggcctgctgctggagagcctggtgcccttcatcgtgaacgacaacatcaccaacaacttcttcagattcctgtgcatgacctag

SEQ ID NO: 11662 - DNA, 1401 bp, Artificial Sequence
  Description of Artificial Sequence: Synthetic coding sequence
atgagctacagacccgtggtgagccccgtgatgagcctgaccagaagatgcatgagaagcagaaccagcatgagaaccgacgccgtgttcctgatcctgtacaaggagctgtactacagacacatctacgccaaggtgagcggcggccccagcctggagcagagattcgagagctactacaactactgcaacctgttcaactacatcctgaacgccgacggccccgcccccctggagctgcccaaccagtggctgtgggacatcatcgacgagttcatctaccagttccagagcttcagccagtacagatgcaagaccgccaagaagagcgaggaggagatcgacttcctgagaagcaaccccaagatctggaacgtgcacagcgtgctgaacgtgctgcacagcctggtggacaagagcaacatcaacagacagctggaggtgtacaccagcggcggcgaccccgagagcgtggccggcgagtacggcagacacagcctgtacaagatgctgggctacttcagcctggtgggcctgctgagactgcacagcctgctgggcgactactaccaggccatcaaggtgctggagaacatcgagctgaacaagaagagcatgtacagcagagtgcccgagtgccaggtgaccacctactactacgtgggcttcgcctacctgatgatgagaagataccaggacgccatcagagtgttcgccaacatcctgctgtacatccagagaaccaagagcatgttccagagaaccacctacaagtacgagatgatcaacaagcagaacgagcagatgcacgccctgctggccatcgccctgaccatgtaccccatgagaatcgacgagagcatccacctgcagctgagagagaagtacggcgacaagatgctgagaatgcagaagggcgacccccaggtgtacgaggagctgttcagctacagctgccccaagttcctgagccccgtggtgcccaactacgacaacgtgcaccccaactaccacaaggagcccttcctgcagcagctgaaggtgttcagcgacgaggtgcagcagcaggcccagctgagcaccatcagaagcttcctgaagctgtacaccaccatgcccgtggccaagctggccggcttcctggacctgaccgagcaggagttcagaatccagctgctggtgttcaagcacaagatgaagaacctggtgtggaccagcggcatcagcgccctggacggcgagttccagagcgccagcgaggtggacttctacatcgacaaggacatgatccacatcgccgacaccaaggtggccagaagatacggcgacttcttcatcagacagatccacaagttcgaggagctgaacagaaccctgaagaagatgggccagagaccctag

SEQ ID NO: 11663 - DNA, 597 bp, Artificial Sequence
  Description of Artificial Sequence: Synthetic coding sequence
atgagcagagccgtgaccatcgccgaggccttctgccacatcctgttcagaatcatcagcgagatcctgatgagaatgctggaggagcagtgcctgttccccctgcccgagccccaggacctgttccaggccagccagatgaagttcgaggacttccagaaggacctgagaaagctgaagaaggacctgaaggcctgcgaggtggaggccggcaaggtgtaccaggtgagcagcaaggagcacatgcagcccttcaaggagaacatggagcagttcatcatccaggccaagatcgaccaggaggccgaggagaacagcctgaccgagacccacaagtgcttcctggagaccaccgcctacttcttcatgaagcccaagctgggcgagaaggaggtgagccccaacgccttcttcagcatctggcacgagttcagcagcgacttcaaggacttctggaagaaggagaacaagctgctgctgcaggagagagtgaaggaggccgaggaggtgtgcagacagaagaagggcaagagcctgtacaagatcaagcccagacacgacagcggcatcaaggccaagatcagcatgaagacctag

SEQ ID NO: 11664 - DNA, 441 bp, Artificial Sequence
  Description of Artificial Sequence: Synthetic coding sequence
atggagcccaccagagactgccccctgttcggcggcgccttcagcgccatcctgcccatgggcgccatcgacgtgagcgacctgagacccgtgcccgacaaccaggaggtgttctgccaccccgtgaccgaccagagcctgatcgtggagctgctggagctgcaggcccacgtgagaggcgaggccgccgccagataccacttcgaggacgtgggcggcgtgcagggcgccagagccgtgcacgtggagagcgtgcagcccctgagcctggagaacctggccctgagaggcagatgccaggaggcctgggtgctgagcggcaagcagcagatcgccaaggagaaccagcaggtggccaaggacgtgaccctgcaccaggccctgctgagactgccccagtaccagaccgacctgctgctgaccttcaaccagcccccctag

SEQ ID NO: 11665 - DNA, 1584 bp, Artificial Sequence
  Description of Artificial Sequence: Synthetic coding sequence
atgagcctgtgcggcgccagagccaacgccaagatgatggccgcctacaacggcggcaccagcgccgccgccgccggccaccaccaccaccaccaccaccacctgccccacctgccccccccccacctgcaccaccaccaccacccccagcaccacctgcaccccggcagcgccgccgccgtgcaccccgtgcagcagcacaccagcagcgccgccgccgccgccgccgccgccgccgccgccgccgccatgctgaaccccggccagcagcagccctacttccccagccccgcccccggccaggcccccggccccgccgccgccgcccccgcccaggtgcaggccgccgccgccgccaccgtgaaggcccaccaccaccagcacagccaccacccccagcagcagctggacatcgagcccgacagacccatcggctacggcgccttcggcgtggtgtggagcgtgaccgaccccagagacggcaagagagtggccctgaagaagatgcccaacgtgttccagaacctggtgagctgcaagagagtgttcagagagctgaagatgctgtgcttcttcaagcacgacaacgtgctgagcgccctggacatcctgcagcccccccacatcgactacttcgaggagatctacgtggtgaccgagctgatgcagagcgacctgcacaagatcatcgtgagcccccagcccctgagcagcgaccacgtgaaggtgttcctgtaccagatcctgagaggcctgaagtacctgcacagcgccggcatcctgcacagagacatcaagcccggcaacctgctggtgaacagcaactgcgtgctgaagatctgcgacttcggcctggccagagtggaggagctggacgagagcagacacatgacccaggaggtggtgacccagtactacagagcccccgagatcctgatgggcagcagacactacagcaacgccatcgacatctggagcgtgggctgcatcttcgccgagctgctgggcagaagaatcctgttccaggcccagagccccatccagcagctggacctgatcaccgacctgctgggcacccccagcctggaggccatgagaaccgcctgcgagggcgccaaggcccacatcctgagaggcccccacaagcagcccagcctgcccgtgctgtacaccctgagcagccaggccacccacgaggccgtgcacctgctgtgcagaatgctggtgttcgaccccagcaagagaatcagcgccaaggacgccctggcccacccctacctggacgagggcagactgagataccacacctgcatgtgcaagtgctgcttcagcaccagcaccggcagagtgtacaccagcgacttcgagcccgtgaccaaccccaagttcgacgacaccttcgagaagaacctgagcagcgtgagacaggtgaaggagatcatccaccagttcatcctggagcagcagaagggcaacagagtgcccctgtgcatcaacccccagagcgccgccttcaagagcttcatcagcagcaccgtggcccagcccagcgagatgccccccagccccctggtgtgggagtag

SEQ ID NO: 11666 - DNA, 2742 bp, Artificial Sequence
  Description of Artificial Sequence: Synthetic coding sequence
atgaacgaggccatggccaccgacagccccagaagacccagcagatgcaccggcggcgtggtggtgagaccccaggccgtgaccgagcagagctacatggagagcgtggtgaccttcctgcaggacgtggtgccccaggcctacagcggcacccccctgaccgaggagaaggagaagatcgtgtgggtgagattcgagaacgccgacctgaacgacaccagcagaaacctggagttccacgagatccacagcaccggcaacgagccccccctgctgatcatgatcggctacagcgacggcatgcaggtgtggagcatccccatcagcggcgaggcccaggagctgttcagcgtgagacacggccccatcagagccgccagaatcctgcccgccccccagttcggcgcccagaagtgcgacaacttcgccgagaagagacccctgctgggcgtgtgcaagagcatcggcagcagcggcaccagccccccctactgctgcgtggacctgtacagcctgagaaccggcgagatggtgaagagcatccagttcaagacccccatctacgacctgcactgcaacaagagaatcctggtggtggtgctgcaggagaagatcgccgccttcgacagctgcaccttcaccaagaagttcttcgtgaccagctgctacccctgccccggccccaacatgaaccccatcgccctgggcagcagatggctggcctacgccgagaacaagctgatcagatgccaccagagcagaggcggcgcctgcggcgacaacatccagagctacaccgccaccgtgatcagcgccgccaagaccctgaagagcggcctgaccatggtgggcaaggtggtgacccagctgaccggcaccctgcccagcggcgtgaccgaggacgacgtggccatccacagcaacagcagaagaagccccctggtgcccggcatcatcaccgtgatcgacaccgagaccgtgggcgagggccaggtgctggtgagcgaggacagcgacagcgacggcatcgtggcccacttccccgcccacgagaagcccgtgtgctgcatggccttcaacaccagcggcatgctgctggtgaccaccgacaccctgggccacgacttccacgtgttccagatcctgacccacccctggagcagcagccagtgcgccgtgcaccacctgtacaccctgcacagaggcgagaccgaggccaaggtgcaggacatctgcttcagccacgactgcagatgggtggtggtgagcaccctgagaggcaccagccacgtgttccccatcaacccctacggcggccagccctgcgtgagaacccacatgagccccagagtggtgaacagaatgagcagattccagaagagcgccggcctggaggagatcgagcaggagctgaccagcaagcagggcggcagatgcagccccgtgcccggcctgagcagcagccccagcggcagccccctgcacggcaagctgaacagccaggacagctacaacaacttcaccaacaacaaccccggcaaccccagactgagccccctgcccagcctgatggtggtgatgcccctggcccagatcaagcagcccatgaccctgggcaccatcaccaagagaaccggcaaggtgaagccccccccccagatcagccccagcaagagcatgggcggcgagttctgcgtggccgccatcttcggcaccagcagaagctggttcgccaacaacgccggcctgaagagagagaaggaccagagcaagcaggtggtggtggagagcctgtacatcatcagctgctacggcaccctggtggagcacatgatggagcccagacccctgagcaccgcccccaagatcagcgacgacacccccctggagatgatgaccagccccagagccagctggaccctggtgagaaccccccagtggaacgagctgcagccccccttcaacgccaaccaccccctgctgctggccgccgacgccgtgcagtactaccagttcctgctggccggcctggtgccccccggcagccccggccccatcaccagacacggcagctacgacagcctggccagcgaccacagcggccaggaggacgaggagtggctgagccaggtggagatcgtgacccacaccggcccccacagaagactgtggatgggcccccagttccagttcaagaccatccaccccagcggccagaccaccgtgatcagcagcagcagcagcgtgctgcagagccacggccccagcgacaccccccagcccctgctggacttcgacaccgacgacctggacctgaacagcctgagaatccagcccgtgagaagcgaccccgtgagcatgcccggcagcagcagacccgtgagcgacagaagaggcgtgagcaccgtgatcgacgccgccagcggcaccttcgacagaagcgtgaccctgctggaggtgtgcggcagctggcccgagggcttcggcctgagacacatgagcagcatggagcacaccgaggagggcctgagagagagactggccgacgccatggccgagagccccagcagagacgtggtgggcagcggcaccgagctgcagagagagggcagcatcgagaccctgagcaacagcagcggcagcaccagcggcagcatccccagaaacttcgacggctacagaagccccctgcccaccaacgagagccagcccctgagcctgttccccaccggcttcccctag

SEQ ID NO: 11667 - DNA, 2160 bp, Artificial Sequence; identical to SEQ ID NO: 9844
  Description of Artificial Sequence: Synthetic coding sequence

SEQ ID NO: 11668 - DNA, 324 bp, Artificial Sequence
  Description of Artificial Sequence: Synthetic coding sequence
atgagcgtgctgagacccctggacaagctgcccggcctgaacaccgccaccatcctgctggtgggcaccgaggacgccctgctgcagcagctggccgacagcatgctgaaggaggactgcgccagcgagctgaaggtgcacctggccaagagcctgcccctgcccagcagcgtgaacagacccagaatcgacctgatcgtgttcgtggtgaacctgcacagcaagtacagcctgcagaacaccgaggagagcctgagacacgtggacgccagcttcttcctgggcaaggtgtgcttcctggccaccggcggcggcagactgtag

SEQ ID NO: 11669 - DNA, 1599 bp, Artificial Sequence
  Description of Artificial Sequence: Synthetic coding sequence
atgttcgtgctgggcatccccctgtgccccgccctgagcttcagcggcggcgacgacagccagacccagctgttcgtgagcagcaaggacgtgatcaaggagatcgaggacttcgacagcctggaggccctgagactggagggcaacaccgtgggcgtggaggccgccagagtgatcgccaaggccctggagaagaagagcgagctgaagagatgccactggagcgacatgttcaccggcagactgagaaccgagatcccccccgccctgatcagcctgggcgagggcctgatcaccgccggcgcccagctggtggagctggacctgagcgacaacgccttcggccccgacggcgtgcagggcttcgaggccctgctgaagagcagcgcctgcttcaccctgcaggagctgaagctgaacaactgcggcatgggcatcggcggcggcaaggtgatcggcaccctggaggaggtgcacatgccccagaacggcatcaaccaccccggcatcaccgccctggcccaggccttcgccgtgaaccccctgctgagagtgatcaacctgaacgacaacaccttcaccgagaagggcgccgtggccatggccgagaccctgaagaccctgagacaggtggaggtgatcaacttcggcgactgcctggtgagaagcaagggcgccgtggccatcgccgacgccatcagaggcggcctgcccaagctgaaggagctgaacctgagcttctgcgagatcaagagagacgccgccctggccgtggccgaggccatggccgacaaggccgagctggagaagctggacctgaacggcaacaccctgggcgaggagggctgcgagcagctgcaggaggtgctggagggcttcaacatggccaaggtgctggccagcctgagcgacgacgaggacgaggaggaggaggaggagggcgaggaggaggaggaggaggccgaggaggaggaggaggaggacgaggaggaggaggaggaggaggaggaggaggaggaggaggagccccagcagagaggccagggcgagaagagcgccacccccagcagaaagatcctggaccccaacaccggcgagcccgcccccgtgctgagcagccccccccccgccgacgtgagcaccttcctggccttccccagccccgagaagctgctgagactgggccccaagagcagcgtgctgatcgcccagcagaccgacaccagcgaccccgagaaggtggtgagcgccttcctgaaggtgagcagcgtgttcaaggacgaggccaccgtgagaatggccgtgcaggacgccgtggacgccctgatgcagaaggccttcaacagcagcagcttcaacagcaacaccttcctgaccagactgctggtgcacatgggcctgctgaagagcgaggacaaggtgaaggccatcgccaacctgtacggccccctgatggccctgaaccacatggtgcagcaggactacttccccaaggccctggcccccctgctgctggccttcgtgaccaagcccaacagcgccctggagagctgcagcttcgccagacacagcctgctgcagaccctgtacaaggtgtag

SEQ ID NO: 11670 - DNA, 1383 bp, Artificial Sequence; identical to SEQ ID NO: 10506
  Description of Artificial Sequence: Synthetic coding sequence

SEQ ID NO: 11671 - DNA, 567 bp, Artificial Sequence; identical to SEQ ID NO: 10128
  Description of Artificial Sequence: Synthetic coding sequence

SEQ ID NO: 11672 - DNA, 1596 bp, Artificial Sequence
  Description of Artificial Sequence: Synthetic coding sequence
atgaacaagaccaaccaggtgtacgccgccaacgaggaccacaacagccagttcatcgacgactacagcagcagcgacgagagcctgagcgtgagccacttcagcttcagcaagcagagccacagacccagaaccatcagagacagaaccagcttcagcagcaagctgcccagccacaacaagaagaacagcaccttcatccccagaaagcccatgaagtgcagcaacgagaaggtggtgaaccaggagcagagctacgagagcatggacaagttcctggacggcgtgcaggaggtggcctacatccacagcaaccagaacgtgatcggcagcagcaaggccgagaaccacatgagcagatgggccgcccacgacgtgttcgagctgaagcagttcagccagctgcccgccaacatcgccgtgtgcagcagcaagacctacaaggagaaggtggacgccgacaccctgccccacaccaagaagggccagcagcccagcgagggcagcatcagcctgcccctgtacatcagcaaccccgtgaaccagaagaagaagaaggtgtaccacaccaaccagaccaccttcatcatcggcgagacccccaagggcatcagaagaaagcagttcgaggagatggccagctacttcaacagcagcagcgtgaacgagttcgccaagcacatcaccaacgccaccagcgaggagagacagaagatgctgagagacttctacgccagccagtaccccgaggtgaaggagttcttcgtggacagcgtgagccagttcaacaacagcagcttcgagaagggcgagcagagaaccagaaagaagagcgacaagagagagagcctgatcaagcccagactgagcgacagcgagaccctgagcttcaaggacagcaccaacaagatcagccaggtgtgcagcctgaagacctacaagagaaagagcgtgaagttccagaaccacatcagctacagagaggaggtgttcttcaacgacgccgagaccaagaagagccccgtgagcagcacccaggagatcgacagcggcaagaacagccaggccagcgaggacaccgtgaccagcagaagcctgaacagcgagagcgagaccagagagagaagactggagaacaccatgaaggaccagcaggacctgaccagaaccggcatcagcagaaaggagcccctgctgaagctggagaacaagaagatcgagaaccccgtgctggagaacaccagcgtgatcagcctgctgggcgacaccagcatcctggacgacctgttcaagagccacggcaacagccccacccagctgcccaagaaggtgctgagcggccccatggagaaggccaagcagagacccaaggacttctgggacatcctgaacgagcagaacgacgagagcctgagcaagctgaccgacctggccgtgatcgagaccctgtgcgagaaggcccccctggccgcccccttcaagagaagagaggagcccgccaccagcctgtggaagagcaacgagaagttcctgtggaagaagttcagccccagcgacaccgacgagaacgccaccaacacccagagcaccacctag

SEQ ID NO: 11673 - DNA, 1089 bp, Artificial Sequence
  Description of Artificial Sequence: Synthetic coding sequence
atgaccggccacaccagaagcagcctgcccagatgcaccggcatcgtgctgctgatcaagctgagattcagcgagagactgaccggccacctgcacgcccagggcacccccccctacgtgatcaacctggaccccgccgtgcacgaggtgcccttccccgccaacatcgacatcagagacaccgtgaagtacaaggaggtgatgaagcagtacggcctgggccccaacggcggcatcgtgaccagcctgaacctgttcgccaccagattcgaccaggtgatgaagttcatcgagaaggcccagaacatgagcaagtacgtgctgatcgacacccccggccagatcgaggtgttcacctggagcgccagcggcaccatcatcaccgaggccctggccagcagcttccccaccgtggtgatctacgtgatggacaccagcagaagcaccaaccccgtgaccttcatgagcaacatgctgtacgcctgcagcatcctgtacaagaccaagctgcccttcatcgtggtgatgaacaagaccgacatcatcgaccacagcttcgccgtggagtggatgcaggacttcgaggccttccaggacgccctgaaccaggagaccacctacgtgagcaacctgaccagaagcatgagcctggtgctggacgagttctacagcagcctgagagtggtgggcgtgagcgccgtgctgggcaccggcctggacgagctgttcgtgcaggtgaccagcgccgccgaggagtacgagagagagtacagacccgagtacgagagactgaagaagagcctggccaacgccgagagccagcagcagagagagcagctggagagactgagaaaggacatgggcagcgtggccctggacgccggcaccgccaaggacagcctgagccccgtgctgcaccccagcgacctgatcctgaccagaggcaccctggacgaggaggacgaggaggccgacagcgacaccgacgacatcgaccacagagtgaccgaggagagccacgaggagcccgccttccagaacttcatgcaggagagcatggcccagtactggaagagaaacaacaagtag

SEQ ID NO: 11674 - DNA, 1338 bp, Artificial Sequence; identical to SEQ ID NO: 10183
  Description of Artificial Sequence: Synthetic coding sequence

SEQ ID NO: 11675 - DNA, 405 bp, Artificial Sequence
  Description of Artificial Sequence: Synthetic coding sequence
atgagcgagaacgccgcccccggcctgatcagcgagctgctgctgcagagaggcaccaccaaggtggccaccggcctggtgctgaacagagaccagagactggcctgggccgagaacagcatcgacttcatcagcagagagctgtgcgcccacagcatcagaaagctgcaggcccacgtgctgctgatcaaggccgtgcacggctacttcgacagcagacagaactacagcgagaaggagagcctgagcttcatgatcgacaccatgaagagcaccctgaaggagcagttccagttcgtggaggtgcccggcaaccactgcgtgcacatgagcgagccccagcacgtggccagcatcatcagcagcttcctgcagtgcacccacatgctgcccgcccagctgtag

SEQ ID NO: 11676 - DNA, 321 bp, Artificial Sequence
  Description of Artificial Sequence: Synthetic coding sequence
atgagcagcaagggcagcagcaccgacggcagaaccgacctggccaacggcagcctgagcagcagccccgaggagatgagcggcgccgaggagggcagagagaccagcagcggcatcgaggtggaggccagcgacctgagcctgagcctgaccggcgacgacggcggccccaacagaaccagcaccgagagcagaggcaccgacaccgagagcagcggcgaggacaaggacagcgacagcatggaggacaccggccactacagcatcaacgacgagaacagagtgcacgacagaagcgaggaggaggaggaggaggagtag

SEQ ID NO: 11677 - DNA, 990 bp, Artificial Sequence; identical to SEQ ID NO: 9812
  Description of Artificial Sequence: Synthetic coding sequence

SEQ ID NO: 11678 - DNA, 2235 bp, Artificial Sequence
  Description of Artificial Sequence: Synthetic coding sequence
atggccaccgccaacttcggcaagatccagatcggcatctacgtggagatcaagagaagcgacggcagaatccaccaggccatggtgaccagcctgaacgaggacaacgagagcgtgaccgtggagtggatcgagaacggcgacaccaagggcaaggagatcgacctggagagcatcttcagcctgaaccccgacctggtgcccgacgaggagatcgagcccagccccgagaccccccccccccccgccagcagcgccaaggtgaacaagatcgtgaagaacagaagaaccgtggccagcatcaagaacgacccccccagcagagacaacagagtggtgggcagcgccagagccagacccagccagttccccgagcagagcagcagcgcccagcagaacggcagcgtgagcgacatcagccccgtgcaggccgccaagaaggagttcggcccccccagcagaagaaagagcaactgcgtgaaggaggtggagaagctgcaggagaagagagagaagagaagactgcagcagcaggagctgagagagaagagagcccaggacgtggacgccaccaaccccaactacgagatcatgtgcatgatcagagacttcagaggcagcctggactacagacccctgaccaccgccgaccccatcgacgagcacagaatctgcgtgtgcgtgagaaagagacccctgaacaagaaggagacccagatgaaggacctggacgtgatcaccatccccagcaaggacgtggtgatggtgcacgagcccaagcagaaggtggacctgaccagatacctggagaaccagaccttcagattcgactacgccttcgacgacagcgcccccaacgagatggtgtacagattcaccgccagacccctggtggagaccatcttcgagagaggcatggccacctgcttcgcctacggccagaccggcagcggcaagacccacaccatgggcggcgacttcagcggcaagaaccaggactgcagcaagggcatctacgccctggccgccagagacgtgttcctgatgctgaagaagcccaactacaagaagctggagctgcaggtgtacgccaccttcttcgagatctacagcggcaaggtgttcgacctgctgaacagaaagaccaagctgagagtgctggaggacggcaagcagcaggtgcaggtggtgggcctgcaggagagagaggtgaagtgcgtggaggacgtgctgaagctgatcgacatcggcaacagctgcagaaccagcggccagaccagcgccaacgcccacagcagcagaagccacgccgtgttccagatcatcctgagaagaaagggcaagctgcacggcaagttcagcctgatcgacctggccggcaacgagagaggcgccgacaccagcagcgccgacagacagaccagactggagggcgccgagatcaacaagagcctgctggccctgaaggagtgcatcagagccctgggcagaaacaagccccacacccccttcagagccagcaagctgacccaggtgctgagagacagcttcatcggcgagaacagcagaacctgcatgatcgccaccatcagccccggcatggccagctgcgagaacaccctgaacaccctgagatacgccaacagagtgaaggagttcggcatcagccccagcgacatccccttcagccagggcagcggcagcagacccgacctgagccccagctacgagtacgacgacttcagccccagcgtgaccagagtgaaggagctgaccgtggaccccaccgccgccggcgacgtgagacccatcatgcaccacccccccaaccagatcgacgacctggagacccagtggggcgtgggcagcagcccccagagagacgacctgaagctgctgtgcgagcagaacgaggaggaggtgagcccccagctgttcaccttccacgaggccgtgagccagatggtggagatggaggagcaggtggtggaggaccacagagccgtgttccaggagagcatcagatggctggaggacgagaaggccctgctggagatgaccgaggaggtggactacgacgtggacagctacgccacccagctggaggccatcctggagcagaagatcgacatcctgaccgagctgagagacaaggtgaagagcttcagagccgccctgcaggaggaggagcaggccagcaagcagatcaaccccaagagacccagagccctgtag

SEQ ID NO: 11679 - DNA, 1701 bp, Artificial Sequence; identical to SEQ ID NO: 9446
  Description of Artificial Sequence: Synthetic coding sequence

SEQ ID NO: 11680 - DNA, 798 bp, Artificial Sequence; identical to SEQ ID NO: 9400
  Description of Artificial Sequence: Synthetic coding sequence

SEQ ID NO: 11681 - DNA, 2808 bp, Artificial Sequence
  Description of Artificial Sequence: Synthetic coding sequence
atgaacgaggccatggccaccgacagccccagaagacccagcagatgcaccggcggcgtggtggtgagaccccaggccgtgaccgagcagagctacatggagagcgtggtgaccttcctgcaggacgtggtgccccaggcctacagcggcacccccctgaccgaggagaaggagaagatcgtgtgggtgagattcgagaacgccgacctgaacgacaccagcagaaacctggagttccacgagatccacagcaccggcaacgagccccccctgctgatcatgatcggctacagcgacggcatgcaggtgtggagcatccccatcagcggcgaggcccaggagctgttcagcgtgagacacggccccatcagagccgccagaatcctgcccgccccccagttcggcgcccagaagtgcgacaacttcgccgagaagagacccctgctgggcgtgtgcaagagcatcggcagcagcggcaccagccccccctactgctgcgtggacctgtacagcctgagaaccggcgagatggtgaagagcatccagttcaagacccccatctacgacctgcactgcaacaagagaatcctggtggtggtgctgcaggagaagatcgccgccttcgacagctgcaccttcaccaagaagttcttcgtgaccagctgctacccctgccccggccccaacatgaaccccatcgccctgggcagcagatggctggcctacgccgagaacaagctgatcagatgccaccagagcagaggcggcgcctgcggcgacaacatccagagctacaccgccaccgtgatcagcgccgccaagaccctgaagagcggcctgaccatggtgggcaaggtggtgacccagctgaccggcaccctgcccagcggcgtgaccgaggacgacgtggccatccacagcaacagcagaagaagccccctggtgcccggcatcatcaccgtgatcgacaccgagaccgtgggcgagggccaggtgctggtgagcgaggacagcgacagcgacggcatcgtggcccacttccccgcccacgagaagcccgtgtgctgcatggccttcaacaccagcggcatgctgctggtgaccaccgacaccctgggccacgacttccacgtgttccagatcctgacccacccctggagcagcagccagtgcgccgtgcaccacctgtacaccctgcacagaggcgagaccgaggccaaggtgcaggacatctgcttcagccacgactgcagatgggtggtggtgagcaccctgagaggcaccagccacgtgttccccatcaacccctacggcggccagccctgcgtgagaacccacatgagccccagagtggtgaacagaatgagcagattccagaagagcgccggcctggaggagatcgagcaggagctgaccagcaagcagggcggcagatgcagccccgtgcccggcctgagcagcagccccagcggcagccccctgcacggcaagctgaacagccaggacagctacaacaacttcaccaacaacaaccccggcaaccccagactgagccccctgcccagcctgatggtggtgatgcccctggcccagatcaagcagcccatgaccctgggcaccatcaccaagagaaccggcaaggtgaagccccccccccagatcagccccagcaagagcatgggcggcgagttctgcgtggccgccatcttcggcaccagcagaagctggttcgccaacaacgccggcctgaagagagagaaggaccagagcaagcaggtggtggtggagagcctgtacatcatcagctgctacggcaccctggtggagcacatgatggagcccagacccctgagcaccgcccccaagatcagcgacgacacccccctggagatgatgaccagccccagagccagctggaccctggtgagaaccccccagtggaacgagctgcagccccccttcaacgccaaccaccccctgctgctggccgccgacgccgtgcagtactaccagttcctgctggccggcctggtgccccccggcagccccggccccatcaccagacacggcagctacgacagcctggccagcgaccacagcggccaggaggacgaggagtggctgagccaggtggagatcgtgacccacaccggcccccacagaagactgtggatgggcccccagttccagttcaagaccatccaccccagcggccagaccaccgtgatcagcagcagcagcagcgtgctgcagagccacggccccagcgacaccccccagcccctgctggacttcgacaccgacgacctggacctgaacagcctgagaatccagcccgtgagaagcgaccccgtgagcatgcccggcagcagcagacccgtgagcgacagaagaggcgtgagcaccgtgatcgacgccgccagcggcaccttcgacagaagcgtgaccctgctggaggtgtgcggcagctggcccgagggcttcggcctgagacacatgagcagcatggagcacaccgaggagggcctgagagagagactggccgacgccatggccgagagccccagcagagacgtggtgggcagcggcaccgacaccgccctggacgtggccgtgaagaccttcccccccgagagacacgtggccgtgaagtgcttcgagctgcagagagagggcagcatcgagaccctgagcaacagcagcggcagcaccagcggcagcatccccagaaacttcgacggctacagaagccccctgcccaccaacgagagccagcccctgagcctgttccccaccggcttcccctag

SEQ ID NO: 11682 - DNA, 615 bp, Artificial Sequence
  Description of Artificial Sequence: Synthetic coding sequence
atggaggccgccggcagccccgccgccaccgagaccggcaagtacatcgccagcacccagagacccgacggcacctggagaaagcagagaagagtgaaggagggctacgtgccccaggaggaggtgcccgtgtacgagaacaagtacgtgaagttcttcaagagcaagcccgagctgccccccggcctgagccccgaggccaccgcccccgtgacccccagcagacccgagggcggcgagcccggcctgagcaagaccgccaagagaaacctgaagagaaaggagaagagaagacagcagcaggagaagggcgaggccgaggccctgagcagaaccctggacaaggtgagcctggaggagaccgcccagctgcccagcgccccccagggcagcagagccgcccccaccgccgccagcgaccagcccgacagcgccgccaccaccgagaaggccaagaagatcaagaacctgaagaagaagctgagacaggtggaggagctgcagcagagaatccaggccggcgaggtgagccagcccagcaaggagcagctggagaagctggccagaagaagagccctggaggaggagctggaggacctggagctgggcctgtag

SEQ ID NO: 11683 - DNA, 663 bp, Artificial Sequence
  Description of Artificial Sequence: Synthetic coding sequence
atgagcagcggcaactaccagcagagcgaggccctgagcaagcccaccttcagcgaggagcaggccagcgccctggtggagagcgtgttcggcctgaaggtgagcaaggtgagacccctgcccagctacgacgaccagaacttccacgtgtacgtgagcaagaccaaggacggccccaccgagtacgtgctgaagatcagcaacaccaaggccagcaagaaccccgacctgatcgaggtgcagaaccacatcatcatgttcctgaaggccgccggcttccccaccgccagcgtgtgccacaccaagggcgacaacaccgccagcctggtgagcgtggacagcggcagcgagatcaagagctacctggtgagactgctgacctacctgcccggcagacccatcgccgagctgcccgtgagcccccagctgctgtacgagatcggcaagctggccgccaagctggacaagaccctgcagagattccaccaccccaagctgagcagcctgcacagagagaacttcatctggaacctgaagaacgtgcccctgctggagaagtacctgtacgccctgggccagaacagaaacagagagatcgtggagcacgtgatccacctgttcaaggaggaggtgatgaccaagctgagccacttcagagagtag

SEQ ID NO: 11684 - DNA, 603 bp, Artificial Sequence
  Description of Artificial Sequence: Synthetic coding sequence
atgagcagcgacagcatggaccagcccagaaacccctgcgagaacgagcccctgacccccggctaccacggcttccccgccagagacagccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgacccagaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggctag

SEQ ID NO: 11685 - DNA, 387 bp, Artificial Sequence
  Description of Artificial Sequence: Synthetic coding sequence
atggcccccgccaagaagggcggcgagaagaagaagggcagaagcgccatcaacgaggtggtgaccagagagtacaccatcaacatccacaagagaatccacggcgtgggcttcaagaagagagcccccagagccctgaaggagatcagaaagttcgccatgaaggagatgggcacccccgacgtgagaatcgacaccagactgaacaaggccgtgtgggccaagggcatcagaaacgtgccctacagaatcagagtgagactgagcagaaagagaaacgaggacgaggacagccccaacaagctgtacaccctggtgacctacgtgcccgtgaccaccttcaagatcagcgtgctgaacagcgtgaccgtggccaagagcccctag

SEQ ID NO: 11686 - DNA, 393 bp, Artificial Sequence
  Description of Artificial Sequence: Synthetic coding sequence
atggcccccgccaagaagggcggcgagaagaagaagggcagaagcgccatcaacgaggtggtgaccagagagtacaccatcaacatccacaagagaatccacggcgtgggcttcaagaagagagcccccagagccctgaaggagatcagaaagttcgccatgaaggagatgggcacccccgacgtgagaatcgacaccagactgaacaaggccgtgtgggccaagggcatcagaaacgtgccctacagaatcagagtgagactgagcagaaagagaaacgaggacgaggacagccccaacaagctgtacaccctggtgacctacgtgcccgtgaccaccttcaagagcctgcagaacgacgacctgttcaagaccgactgccaccaccagtag

SEQ ID NO: 11687 - DNA, 1524 bp, Artificial Sequence
  Description of Artificial Sequence: Synthetic coding sequence
atgtggctgaccagctaccccagccccaacttccccgtgagcgtgctgcagaacggcgtgaagatgaccaacgaggcccccaagggcctgagagccaacatcatcagaagctacctgatggaccccatcagcgaccccgagttcttcggcagctgcaagaagcccgaggagttcaagaagctgctgtacggcctgtgcttcttccacgccctggtgcaggagagaagaaagttcggccccctgggctggaacatcccctacgagttcaacgagaccgacctgagaatcagcgtgcagcagctgcacatgttcctgaaccagtacgaggagctgccctacgaggccctgagatacatgaccggcgagtgcaactacggcggcagagtgaccgacgactgggacagaagaaccctgagaagcatcctgaacaagttcttcaaccccgagctggtggagaacagcgactacaagttcgacagcagcggcatctacttcgtgccccccagcggcgaccacaagagctacatcgagtacaccaagaccctgcccctgacccccgcccccgagatcttcggcatgaacgccaacgccgacatcaccaaggaccagagcgagacccagctgctgttcgacaacatcctgctgacccagagcagaagcgccggcgccggcgccaagagcagcgacgaggtggtgaacgaggtggccagcgacatcctgggcaagctgcccaacaacttcgacatcgaggccgccatgagaagataccccaccacctacacccagagcatgaacaccgtgctggtgcaggagatgggcagattcaacaagctgctgaagaccatcagagacagctgcgtgaacatccagaaggccatcaagggcctggccgtgatgagcaccgacctggaggaggtggtgagcagcatcctgaacgtgaagatccccgagatgtggatgggcaagagctaccccagcctgaagcccctgggcagctacgtgaacgacttcctggccagactgaagttcctgcagcagtggtacgaggtgggccccccccccgtgttctggctgagcggcttcttcttcacccaggccttcctgaccggcgcccagcagaactacgccagaaagtacaccatccccatcgacctgctgggcttcgactacgaggtgatggaggacaaggagtacaagcacccccccgaggacggcgtgttcatccacggcctgttcctggacggcgccagctggaacagaaagatcaagaagctggccgagagccaccccaagatcctgtacgacaccgtgcccgtgatgtggctgaagccctgcaagagagccgacatccccaagagacccagctacgtggcccccctgtacaagaccagcgagagaagaggcgtgctgagcaccaccggccacagcaccaacttcgtgatcgccatgaccctgcccagcgaccagcccaaggagcactggatcggcagaggcgtggccctgctgtgccagctgaacagctag

SEQ ID NO: 11688 - DNA, 1683 bp, Artificial Sequence
  Description of Artificial Sequence: Synthetic coding sequence
atggccgccagcgccaagagaaagcaggaggagaagcacctgaagatgctgagagacatgaccggcctgccccacaacagaaagtgcttcgactgcgaccagagaggccccacctacgtgaacatgaccgtgggcagcttcgtgtgcaccagctgcagcggcagcctgagaggcctgaaccccccccacagagtgaagagcatcagcatgaccaccttcacccagcaggagatcgagttcctgcagaagcacggcaacgaggtgtgcaagcagatctggctgggcctgttcgacgacagaagcagcgccatccccgacttcagagacccccagaaggtgaaggagttcctgcaggagaagtacgagaagaagagatggtacgtgccccccgagcaggccaaggtggtggccagcgtgcacgccagcatcagcggcagcagcgccagcagcaccagcagcacccccgaggtgaagcccctgaagagcctgctgggcgacagcgcccccaccctgcacctgaacaagggcacccccagccagagccccgtggtgggcagaagccagggccagcagcaggagaagaagcagttcgacctgctgagcgacctgggcagcgacatcttcgccgcccccgccccccagagcaccgccaccgccaacttcgccaacttcgcccacttcaacagccacgccgcccagaacagcgccaacgccgacttcgccaacttcgacgccttcggccagagcagcggcagcagcaacttcggcggcttccccaccgccagccacagccccttccagccccagaccaccggcggcagcgccgccagcgtgaacgccaacttcgcccacttcgacaacttccccaagagcagcagcgccgacttcggcaccttcaacaccagccagagccaccagaccgccagcgccgtgagcaaggtgagcaccaacaaggccggcctgcagaccgccgacaagtacgccgccctggccaacctggacaacatcttcagcgccggccagggcggcgaccagggcagcggcttcggcaccaccggcaaggcccccgtgggcagcgtggtgagcgtgcccagccagagcagcgccagcagcgacaagtacgccgccctggccgagctggacagcgtgttcagcagcgccgccaccagcagcaacgcctacaccagcaccagcaacgccagcagcaacgtgttcggcaccgtgcccgtggtggccagcgcccagacccagcccgccagcagcagcgtgcccgcccccttcggcgccacccccagcaccaaccccttcgtggccgccgccggccccagcgtggccagcagcaccaaccccttccagaccaacgccagaggcgccaccgccgccaccttcggcaccgccagcatgagcatgcccaccggcttcggcacccccgccccctacagcctgcccaccagcttcagcggcagcttccagcagcccgccttccccgcccaggccgccttcccccagcagaccgccttcagccagcagcccaacggcttcgccgccttcggccagaccaagcccgtggtgacccccttcggccaggtggccgccgccggcgtgagcagcaaccccttcatgaccggcgcccccaccggccagttccccaccggcagcagcagcaccaaccccttcctgtag

SEQ ID NO: 11689 - DNA, 2403 bp, Artificial Sequence; identical to SEQ ID NO: 10983
  Description of Artificial Sequence: Synthetic coding sequence

SEQ ID NO: 11690 - DNA, 144 bp, Artificial Sequence
  Description of Artificial Sequence: Synthetic coding sequence
atggacgaccagcaggccctgaacagcatcatgcaggacctggccgtgctgcacaaggccagcagacccgccctgagcctgcaggagaccagaaaggccaagagcagcagccccaagaagcagaacgacgtgagagtgaagtag

SEQ ID NO: 11691 - DNA, 1272 bp, Artificial Sequence
  Description of Artificial Sequence: Synthetic coding sequence
atggtgagcttcatgaacaaccagaagcagcagaagcccaccctgagcggccagagattcaagaccagaaagagagacgagaaggagagattcgaccccacccagttccaggactgcatcatccagggcctgaccgagaccggcaccgacctggaggccgtggccaagttcctggacgccagcggcgccaagctggactacagaagatacgccgagaccctgttcgacatcctggtggccggcggcatgctggcccccggcggcaccctggccgacgacatgatgagaaccgacgtgtgcgtgttcgccgcccaggaggacctggagaccatgcaggccttcgcccaggtgttcaacaagctgatcagaagatacaagtacctggagaagggcttcgaggacgaggtgaagaagctgctgctgttcctgaagggcttcagcgagagcgagagaaacaagctggccatgctgaccggcgtgctgctggccaacggcaccctgaacgccagcatcctgaacagcctgtacaacgagaacctggtgaaggagggcgtgagcgccgccttcgccgtgaagctgttcaagagctggatcaacgagaaggacatcaacgccgtggccgccagcctgagaaaggtgagcatggacaacagactgatggagctgttccccgccaacaagcagagcgtggagcacttcaccaagtacttcaccgaggccggcctgaaggagctgagcgagtacgtgagaaaccagcagaccatcggcgccagaaaggagctgcagaaggagctgcaggagcagatgagcagaggcgaccccttcaaggacatcatcctgtacgtgaaggaggagatgaagaagaacaacatccccgagcccgtggtgatcggcatcgtgtggagcagcgtgatgagcaccgtggagtggaacaagaaggaggagctggtggccgagcaggccatcaagcacctgaagcagtacagccccctgctggccgccttcaccacccagggccagagcgagctgaccctgctgctgaagatccaggagtactgctacgacaacatccacttcatgaaggccttccagaagatcgtggtgctgttctacaaggccgaggtgctgagcgaggagcccatcctgaagtggtacaaggacgcccacgtggccaagggcaagagcgtgttcctggagcagatgaagaagttcgtggagtggctgaagaacgccgaggaggagagcgagagcgaggccgaggagggcgactag

SEQ ID NO: 11692 - DNA, 1119 bp, Artificial Sequence; identical to SEQ ID NO: 9458
  Description of Artificial Sequence: Synthetic coding sequence

SEQ ID NO: 11693 - DNA, 912 bp, Artificial Sequence
  Description of Artificial Sequence: Synthetic coding sequence
atgatggacgtgagcggcgtgggcttccccagcaaggtgccctggaagaagatgagcgccgaggagctggagaaccagtactgccccagcagatgggtggtgagactgggcgccgaggaggccctgagaacctacagccagatcggcatcgaggccaccaccagagccagagccaccagaaagagcctgctgcacgtgccctacggcgacggcgagggcgagaaggtggacatctacttccccgacgagagcagcgaggccctgcccttcttcctgttcttccacggcggctactggcagagcggcagcaaggacgagagcgccttcatggtgcaccccctgaccgcccagggcgtggccgtggtgatcgtggcctacggcatcgcccccaagggcaccctggaccacatggtggaccaggtgaccagaagcgtggccttcgtgcagaagagataccccagcaacaagggcatctacctgtgcggccacagcgccggcgcccacctggccgccatgatgctgctggccgactggaccaagcacggcgtgacccccaacctgagaggcttcttcctggtgagcggcgtgttcgacctggagcccatcgtgtacaccagccagaacgtggccctgcagctgaccctggaggacgcccagagaaacagcccccagctgaaggtggcccaggcccagcccgtggaccccacctgcagagtgctggtggtggtgggccagttcgacagccccgagttccacagacagagctgggagttctaccagaccctgtgccagggcgagtggaaggccagcttcgaggagctgcacgacgtggaccacttcgagatcgtggagaacctgacccagaaggacaacgtgctgacccagatcatcctgaagaccatcttccagtag

SEQ ID NO: 11694 - DNA, 684 bp, Artificial Sequence
  Description of Artificial Sequence: Synthetic coding sequence
atggccctgcacgacatggaggacttcaccttcgacggcaccaagagactgagcgtgaactacgtgaagggcatcctgcagcccaccgacacctgcgacatctgggacaagatctggaacttccaggccaagcccgacgacctgctgatcagcacctaccccaaggccggcaccacctggacccaggagatcgtggagctgatccagaacgagggcgacgtggagaagagcaagagagcccccacccaccagagattccccttcctggagatgaagatccccagcctgggcagcgtgtgctggggcagctggcacgagcacgtgaagggctggtgggaggccaaggacaagcacagaatcctgtacctgttctacgaggacatgaagaagaaccccaagcacgagatccagaagctggccgagttcatcggcaagaagctggacgacaaggtgctggacaagatcgtgcactacaccagcttcgacgtgatgaagcagaaccccatggccaactacagcagcatccccgccgagatcatggaccacagcatcagccccttcatgagaaagggcgccgtgggcgactggaagaagcacttcaccgtggcccagaacgagagattcgacgaggactacaagaagaagatgaccgacaccagactgaccttccacttccagttctag

SEQ ID NO: 11695 - DNA, 366 bp, Artificial Sequence
  Description of Artificial Sequence: Synthetic coding sequence
atggcccccgccaagaagggcggcgagaagaagaagggcagaagcgccatcaacgaggtggtgaccagagagtacaccatcaacatccacaagagaatccacggcgtgggcttcaagaagagagcccccagagccctgaaggagatcagaaagttcgccatgaaggagatgggcacccccgacgtgagaatcgacaccagactgaacaaggccgtgtgggccaagggcatcagaaacgtgccctacagaatcagagtgagactgagcagaaagagaaacgaggacgaggacagccccaacaagctgtacaccctggtgacctacgtgcccgtgaccaccttcaagagcaagttcagcatcccctag

SEQ ID NO: 11696 - DNA, 267 bp, Artificial Sequence
  Description of Artificial Sequence: Synthetic coding sequence
ctgagcttcagagccgacagcgcccacgccagcatggtgaacgtgcccaagaccagaagaaccttctgcaagaagtgcggcaagcaccagccccacaaggtgacccagtacaagaagggcaaggacagcctgtacgcccagggcaagagaagatacgacagaaagcagagcggctacggcggccagaccaagcccatcttcagaaagaagctgcaccagaactgcatcgagcccaacctgccccccagagcccagcagagcccctag

SEQ ID NO: 11697 - DNA, 582 bp, Artificial Sequence
  Description of Artificial Sequence: Synthetic coding sequence
atggacagcaccctggccgtgcagcagtacatccagcagaacatcagagccgactgcagcaacatcgacaagatcctggagccccccgagggccaggacgagggcgtgtggaagtacgagcacctgagacagttctgcctggagctgaacggcctggccgtgaagctgcagagcgagtgccaccccgacacctgcacccagatgaccgccaccgagcagtggatcttcctgtgcgccgcccacaagacccccaaggagtgccccgccatcgactacaccagacacaccctggacggcgccgcctgcctgctgaacagcaacaagtacttccccagcagagtgagcatcaaggagagcagcgtggccaagctgggcagcgtgtgcagaagaatctacagaatcttcagccacgcctacttccaccacagacagatcttcgacgagtacgagaacgagaccttcctgtgccacagattcaccaagttcgtgatgaagtacaacctgatgagcaaggacaacctgatcgtgcccatcctggaggaggaggtgcagaacagcgtgagcggcgagagcgaggcctag

SEQ ID NO: 11698 - DNA, 4137 bp, Artificial Sequence
  Description of Artificial Sequence: Synthetic coding sequence
atgagcctggagagagagctgagacagctgagcaaggccaaggccaaggcccagagagccggccagagaagagaggaggccgccctgtgccaccagctgggcgagctgctggccggccacggcagatacgccgaggccctggagcagcactggcaggagctgcagctgagagagagagccgacgaccccctgggctgcgccgtggcccacagaaagatcggcgagagactggccgagatggaggactaccccgccgccctgcagcaccagcaccagtacctggagctggcccacagcctgagaaaccacaccgagctgcagagagcctgggccaccatcggcagaacccacctggacatctacgaccactgccagagcagagacgccctgctgcaggcccaggccgccttcgagaagagcctggccatcgtggacgaggagctggagggcaccctggcccagggcgagctgaacgagatgagaaccagactgtacctgaacctgggcctgaccttcgagagcctgcagcagaccgccctgtgcaacgactacttcagaaagagcatcttcctggccgagcagaaccacctgtacgaggacctgttcagagccagatacaacctgggcaccatccactggagagccggccagcacagccaggccatgagatgcctggagggcgccagagagtgcgcccacaccatgagaaagagattcatggagagcgagtgctgcgtggtgatcgcccaggtgctgcaggacctgggcgacttcctggccgccaagagagccctgaagaaggcctacagactgggcagccagaagcccgtgcagagagccgccatctgccagaacctgcagcacgtgctggccgtggtgagactgcagcagcagctggaggaggccgagggcagagacccccagggcgccatggtgatctgcgagcagctgggcgacctgttcagcaaggccggcgacttccccagagccgccgaggcctaccagaagcagctgagattcgccgagctgctggacagacccggcgccgagagagccatcatccacgtgagcctggccaccaccctgggcgacatgaaggaccaccacggcgccgtgagacactacgaggaggagctgagactgagaagcggcaacgtgctggaggaggccaagacctggctgaacatcgccctgagcagagaggaggccggcgacgcctacgagctgctggccccctgcttccagaaggccctgagctgcgcccagcaggcccagagaccccagctgcagagacaggtgctgcagcacctgcacaccgtgcagctgagactgcagccccaggaggcccccgagaccgagaccagactgagagagctgagcgtggccgaggacgaggacgaggaggaggaggccgaggaggccgccgccaccgccgagagcgaggccctggaggccggcgaggtggagctgagcgagggcgaggacgacaccgacggcctgaccccccagctggaggaggacgaggagctgcagggccacctgggcagaagaaagggcagcaagtggaacagaagaaacgacatgggcgagaccctgctgcacagagcctgcatcgagggccagctgagaagagtgcaggacctggtgagacagggccaccccctgaaccccagagactactgcggctggacccccctgcacgaggcctgcaactacggccacctggagatcgtgagattcctgctggaccacggcgccgccgtggacgaccccggcggccagggctgcgagggcatcacccccctgcacgacgccctgaactgcggccacttcgaggtggccgagctgctgctggagagaggcgccagcgtgaccctgagaaccagaaagggcctgagccccctggagaccctgcagcagtgggtgaagctgtacagaagagacctggacctggagaccagacagaaggccagagccatggagatgctgctgcaggccgccgccagcggccaggacccccacagcagccaggccttccacacccccagcagcctgctgttcgaccccgagaccagcccccccctgagcccctgccccgagccccccagcaacagcaccagactgcccgaggccagccaggcccacgtgagagtgagccccggccaggccgcccccgccatggccagacccagaagaagcagacacggccccgccagcagcagcagcagcagcgagggcgaggacagcgccggccccgccagacccagccagaagagacccagatgcagcgccaccgcccagagagtggccgcctggacccccggccccgccagcaacagagaggccgccaccgccagcaccagcagagccgcctaccaggccgccatcagaggcgtgggcagcgcccagagcagactgggccccggcccccccagaggccacagcaaggccctggccccccaggccgccctgatccccgaggaggagtgcctggccggcgactggctggagctggacatgcccctgaccagaagcagaagacccagacccagaggcaccggcgacaacagaagacccagcagcaccagcggcagcgacagcgaggagagcagacccagagccagagccaagcaggtgagactgacctgcatgcagagctgcagcgcccccgtgaacgccggccccagcagcctggccagcgagccccccggcagccccagcacccccagagtgagcgagcccagcggcgacagcagcgccgccggccagcccctgggccccgccccccccccccccatcagagtgagagtgcaggtgcaggaccacctgttcctgatccccgtgccccacagcagcgacacccacagcgtggcctggctggccgagcaggccgcccagagatactaccagacctgcggcctgctgcccagactgaccctgagaaaggagggcgccctgctggccccccaggacctgatccccgacgtgctgcagagcaacgacgaggtgctggccgaggtgaccagctgggacctgccccccctgaccgacagatacagaagagcctgccagagcctgggccagggcgagcaccagcaggtgctgcaggccgtggagctgcagggcctgggcctgagcttcagcgcctgcagcctggccctggaccaggcccagctgacccccctgctgagagccctgaagctgcacaccgccctgagagagctgagactggccggcaacagactgggcgacaagtgcgtggccgagctggtggccgccctgggcaccatgcccagcctggccctgctggacctgagcagcaaccacctgggccccgagggcctgagacagctggccatgggcctgcccggccaggccaccctgcagagcctggaggagctggacctgagcatgaaccccctgggcgacggctgcggccagagcctggccagcctgctgcacgcctgccccctgctgagcaccctgagactgcaggcctgcggcttcggccccagcttcttcctgagccaccagaccgccctgggcagcgccttccaggacgccgagcacctgaagaccctgagcctgagctacaacgccctgggcgcccccgccctggccagaaccctgcagagcctgcccgccggcaccctgctgcacctggagctgagcagcgtggccgccggcaagggcgacagcgacctgatggagcccgtgttcagatacctggccaaggagggctgcgccctggcccacctgaccctgagcgccaaccacctgggcgacaaggccgtgagagacctgtgcagatgcctgagcctgtgccccagcctgatcagcctggacctgagcgccaaccccgagatcagctgcgccagcctggaggagctgctgagcaccctgcagaagagaccccagggcctgagcttcctgggcctgagcggctgcgccgtgcagggccccctgggcctgggcctgtgggacaagatcgccgcccagctgagagagctgcagctgtgcagcagaagactgtgcgccgaggacagagacgccctgagacagctgcagcccagcagacccggccccggcgagtgcaccctggaccacggcagcaagctgttcttcagaagactgtag

SEQ ID NO: 11699 - DNA, 1218 bp, Artificial Sequence
  Description of Artificial Sequence: Synthetic coding sequence
atgaactaccagcagcagctggccaacagcgccgccatcagagccgagatccagagattcgagagcgtgcaccccaacatctacagcatctacgagctgctggagagagtggaggagcccgtgctgcagaaccagatcagagagcacgtgatcgccatcgaggacgccttcgtgaacagccaggagtggaccctgagcagaagcgtgcccgagctgaaggtgggcatcgtgggcaacctggccagcggcaagagcgccctggtgcacagatacctgaccggcacctacgtgcaggaggagagccccgagggcggcagattcaagaaggagatcgtggtggacggccagagctacctgctgctgatcagagacgagggcggcccccccgaggcccagttcgccatgtgggtggacgccgtgatcttcgtgttcagcctggaggacgagatcagcttccagaccgtgtaccactactacagcagaatggccaactacagaaacaccagcgagatccccctggtgctggtgggcacccaggacgccatcagcagcgccaaccccagagtgatcgacgacgccagagccagaaagctgagcaacgacctgaagagatgcacctactacgagacctgcgccacctacggcctgaacgtggagagagtgttccaggacgtggcccagaagatcgtggccaccagaaagaagcagcagctgagcatcggcccctgcaagagcctgcccaacagccccagccacagcagcgtgtgcagcgcccaggtgagcgccgtgcacatcagccagaccagcaacggcggcggcagcctgagcgactacagcagcagcgtgcccagcacccccagcaccagccagaaggagctgagaatcgacgtgccccccaccgccaacacccccacccccgtgagaaagcagagcaagagaagaagcaacctgttcaccagcagaaagggcagcgaccccgacaaggagaagaagggcctggagagcagagccgacagcatcggcagcggcagagccatccccatcaagcagggcctgcccttcttcgtgctggccctgaccgccagcacctacctgagacccgccggcgccagagccagacagagcagcccctggcccggccccagaggcggccagaccagcccccactgcgccgagggcccccagagcgcccagctgagcggcgccatgatgaactag

SEQ ID NO: 11700 - DNA, 1245 bp, Artificial Sequence; identical to SEQ ID NO: 9295
  Description of Artificial Sequence: Synthetic coding sequence

SEQ ID NO: 11701 - DNA, 645 bp, Artificial Sequence
  Description of Artificial Sequence: Synthetic coding sequence
atgggccccctgcccagaaccgtggagctgttctacgacgtgctgagcccctacagctggctgggcttcgagatcctgtgcagataccagaacatctggaacatcaacctgcagctgagacccagcctgatcaccggcatcatgaaggacagcggcaacaagccccccggcctgctgcccagaaagggcctgtacatggccaacgacctgaagctgctgagacaccacctgcagatccccatccacttccccaaggacttcctgagcgtgatgctggagaagggcagcctgagcgccatgagattcctgaccgccgtgaacctggagcaccccgagatgctggagaaggccagcagagagctgtggatgagagtgtggagcagagccgccgagaaggccggcatgagcgccgagcaggcccagggcctgctggagaagatcgccacccccaaggtgaagaaccagctgaaggagaccaccgaggccgcctgcagatacggcgccttcggcctgcccatcaccgtggcccacgtggacggccagacccacatgctgttcggcagcgacagaatggagctgctggcccacctgctgggcgagaagtggatgggccccatcccccccgccgtgaacgccagactgtag

SEQ ID NO: 11702 - DNA, 4206 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgtgagcgtgagccagcagcccgtgagcgcccccgtgcccatcgccgcccacgccagcgtggccggccacctgagcaccagcaccaccgtgagcagcagcggcgcccagaacagcgacagcaccaagaagaccctggtgaccctgatcgccaacaacaacgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcaccacccagggcttccccgtgagaaacgtgagacccgtgcagaacgccatgaaccaggtgggcatcgtgctgaacgtgcagcagggccagaccgtgagacccatcaccctggtgcccgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 11703 - DNA, 1398 bp, Artificial Sequence; identical to SEQ ID NO: 9463
  Description of Artificial Sequence: Synthetic coding sequence

SEQ ID NO: 11704 - DNA, 3210 bp, Artificial Sequence
  Description of Artificial Sequence: Synthetic coding sequence
atgtacctgctggacggcagcggcgagcccgccagcccccccgccgacgccatgcccagaggcaccccccccagaaagaccgtgtacagaatcagcgtgaccatggtgagaaaggagcagctggccgcccccggcagcggcggccccgaccccagacccgtgagaagacccagacccgccagaagccccgacgcccccggcagactggaggaggaggccgaggaggccgagggcgccgaggagcccgagggccccagacccagagcctgggacttcagaaccttcagaaccagaagcaccggccagctggagctgggcagactgagaccctgcgccagaggcctggagcccgccgacctggccggcagcgcccccgccgaggaggagggcagaggcagccccgccagcggcagccccgacgtggagggcgccagagccgcccccctgagaagaagcctgagcttcagacactggagcggccccgaggccccccagggcagaaccctgggcggcggcagaagacacagcagcagcggcagcctggcctgggccccctgcgacgaggccgccgccggcaccaccctggagcccgccaccgccacccagcccgccagcgagaagagaaacaccctggacgtgggcgaggtgctgagcaagaacgacgccctgagcgacctggagagatgggagagaagcaagagcaagaacagaaccctggacaacagcgacctgcagagactggagagagccagagccgccgccggcgccggcgccgccagcgagcacagactgctgagattcttcagcggcatcttcgccagaagagacggcggccccggcggcggccccagccccagaagcggcgccagcagacccagaggctacttcagcctgagaagagcccccgccgaggcccacagcagcagcgccgagagcatcgacggcagccccagaagagacgccttcgtgaacagccaggagtggaccctgagcagaagcgtgcccgagctgaaggtgggcatcgtgggcaacctggccagcggcaagagcgccctggtgcacagatacctgaccggcacctacgtgcaggaggagagccccgagggcggcagattcaagaaggagatcgtggtggacggccagagctacctgctgctgatcagagacgagggcggcccccccgaggcccagttcgccatgtgggtggacgccgtgatcttcgtgttcagcctggaggacgagatcagcttccagaccgtgtaccactactacagcagaatggccaactacagaaacaccagcgagatccccctggtgctggtgggcacccaggacgccatcagcagcgccaaccccagagtgatcgacgacgccagagccagaaagctgagcaacgacctgaagagatgcacctactacgagacctgcgccacctacggcctgaacgtggagagagtgttccaggacgtggcccagaagatcgtggccaccagaaagaagcagcagctgagcatcggcccctgcaagagcctgcccaacagccccagccacagcagcgtgtgcagcgcccaggtgagcgccgtgcacatcagccagaccagcaacggcggcggcagcctgagcgactacagcagcagcgtgcccagcacccccagcaccagccagaaggagctgagaatcgacgtgccccccaccgccaacacccccacccccgtgagaaagcagagcaagagaagaagcaacctgttcaccagcagaaagggcagcgaccccgacaaggagaagaagggcctggagagcagagccgacagcatcggcagcggcagagccatccccatcaagcagggcatgctgctgaagagaagcggcaagagcctgaacaaggagtggaagaagaagtacgtgaccctgtgcgacaacggcgtgctgacctaccaccccagcctgcacgactacatgcagaacgtgcacggcaaggagatcgacctgctgagaaccaccgtgaaggtgcccggcaagagaccccccagagccaccagcgcctgcgcccccatcagcagccccaagaccaacggcctgagcaaggacatgagcagcctgcacatcagccccaacagcgacaccggcctgggcgacagcgtgtgcagcagccccagcatcagcagcaccaccagccccaagctggaccccccccccagcccccacgccaacagaaagaagcacagaagaaagaagagcaccagcaacttcaaggccgacggcctgagcggcaccgccgaggagcaggaggagaacttcgagttcatcatcgtgagcctgaccggccagacctggcacttcgaggccaccacctacgaggagagagacgcctgggtgcaggccatcgagagccagatcctggccagcctgcagagctgcgagagcagcaagaacaagagcagactgaccagccagagcgaggccatggccctgcagagcatcagaaacatgagaggcaacagccactgcgtggactgcgagacccagaaccccaactgggccagcctgaacctgggcgccctgatgtgcatcgagtgcagcggcatccacagaaacctgggcacccacctgagcagagtgagaagcctggacctggacgactggcccgtggagctgatcaaggtgatgagcagcatcggcaacgagctggccaacagcgtgtgggaggagagcagccagggcagaaccaagcccagcgtggacagcaccagagaggagaaggagagatggatcagagccaagtacgagcagaagctgttcctggcccccctgccctgcaccgagctgagcctgggccagcacctgctgagagccaccgccgacgaggacctgagaaccgccatcctgctgctggcccacggcagcagagacgaggtgaacgagacctgcggcgagggcgacggcagaaccgccctgcacctggcctgcagaaagggcaacgtggtgctggcccagctgctgatctggtacggcgtggacgtgaccgccagagacgcccacggcaacaccgccctggcctacgccagacaggccagcagccaggagtgcatcgacgtgctgctgcagtacggctgccccgacgagagattcgtgctgatggccacccccaacctgagcagaagaaacaacaacagaaacaacagcagcggcagagtgcccaccatcatctag

SEQ ID NO: 11705 - DNA, 1260 bp, Artificial Sequence
  Description of Artificial Sequence: Synthetic coding sequence
atgaacaaccagaagcagcagaagcccaccctgagcggccagagattcaagaccagaaagagagacgagaaggagagattcgaccccacccagttccaggactgcatcatccagggcctgaccgagaccggcaccgacctggaggccgtggccaagttcctggacgccagcggcgccaagctggactacagaagatacgccgagaccctgttcgacatcctggtggccggcggcatgctggcccccggcggcaccctggccgacgacatgatgagaaccgacgtgtgcgtgttcgccgcccaggaggacctggagaccatgcaggccttcgcccaggtgttcaacaagctgatcagaagatacaagtacctggagaagggcttcgaggacgaggtgaagaagctgctgctgttcctgaagggcttcagcgagagcgagagaaacaagctggccatgctgaccggcgtgctgctggccaacggcaccctgaacgccagcatcctgaacagcctgtacaacgagaacctggtgaaggagggcgtgagcgccgccttcgccgtgaagctgttcaagagctggatcaacgagaaggacatcaacgccgtggccgccagcctgagaaaggtgagcatggacaacagactgatggagctgttccccgccaacaagcagagcgtggagcacttcaccaagtacttcaccgaggccggcctgaaggagctgagcgagtacgtgagaaaccagcagaccatcggcgccagaaaggagctgcagaaggagctgcaggagcagatgagcagaggcgaccccttcaaggacatcatcctgtacgtgaaggaggagatgaagaagaacaacatccccgagcccgtggtgatcggcatcgtgtggagcagcgtgatgagcaccgtggagtggaacaagaaggaggagctggtggccgagcaggccatcaagcacctgaagcagtacagccccctgctggccgccttcaccacccagggccagagcgagctgaccctgctgctgaagatccaggagtactgctacgacaacatccacttcatgaaggccttccagaagatcgtggtgctgttctacaaggccgaggtgctgagcgaggagcccatcctgaagtggtacaaggacgcccacgtggccaagggcaagagcgtgttcctggagcagatgaagaagttcgtggagtggctgaagaacgccgaggaggagagcgagagcgaggccgaggagggcgactag

SEQ ID NO: 11706 - DNA, 2769 bp, Artificial Sequence; identical to SEQ ID NO: 10882
  Description of Artificial Sequence: Synthetic coding sequence

SEQ ID NO: 11707 - DNA, 363 bp, Artificial Sequence
  Description of Artificial Sequence: Synthetic coding sequence
atggcccccgccaagaagggcggcgagaagaagaagggcagaagcgccatcaacgaggtggtgaccagagagtacaccatcaacatccacaagagaatccacggcgtgggcttcaagaagagagcccccagagccctgaaggagatcagaaagttcgccatgaaggagatgggcacccccgacgtgagaatcgacaccagactgaacaaggccgtgtgggccaagggcatcagaaacgtgccctacagaatcagagtgagactgagcagaaagagaaacgaggacgaggacagccccaacaagctgtacaccctggtgacctacgtgcccgtgaccaccttcaagaactgccaccaccagtag

SEQ ID NO: 11708 - DNA, 378 bp, Artificial Sequence; identical to SEQ ID NO: 9739
  Description of Artificial Sequence: Synthetic coding sequence

SEQ ID NO: 11709 - DNA, 1500 bp, Artificial Sequence
  Description of Artificial Sequence: Synthetic coding sequence
atgagcacccccagcggcatcagcacctggctgagcctgcccgtgagcacccccgccagcatcaccagcatcagagtgacccagaagagcagcggcccctgggccttcagcagctgcacctacgtgagcggccccggcgtgtgcatcagcagcctgagctgcagcagagtgggcagcagcagcttcagaggcggcctgggcggcggctacggcggcgccagcggcatgggcggcatcatcgccatcatggtgaaccagagcctgctgagccccctgaacctggaggtggaccccaacatccaggccgtgtgcacccaggagaaggagcagatcaagaccctgaacaacaagttcgccagcttcatcgacaaggtgtggttcctggagcagcagaacaaggtgctggagaccaagtggagcctgctgcagcagcagaagatggccagaagcaacatggacaacatgctggagagctacatcaacaacctgagaagacagctggagaccctgggccaggagaagctgaagctggaggccgagctgggcaacatgcagggcctgggcgaggacttcaagaacaagtacgaggacgagatcaacaagcacaccgaggtggagaacgagttcgtgctgatcaagaaggacgtggacgaggcctacatgaacaaggccgagctggagagcctgctggagggcctgaccgacgagatcaacttcctgagacagctgtacgaggaggagatcagagagctgcagagccagatcagcgacatgagcatggtgctgagcatggactacagctgcagcagagacatggacagcatcatccccgaggtgaaggtgcagtacgaggagatcgccaactgcagcagagccgaggccgagagcatgtaccagatcaagtacgaggagctgcagaccctggccggcaagtacggcgacgacctgagcagaaccaagaccgagatcagcgagatgaacagaaacatcagctggctgcaggccgagaccgagggcctgaagggccagagagccagcctggaggccgccatcaccgacgccgagcagagaggcgagctggccgtgaaggacgccaacgccaagctgagcgagctggaggccgccctgcagagagccaagcaggacatgatgggccagctgagagagtaccaggagctgatgaacgtgggcctgaccctggacatcgagatcgccacctacagaaagctgctggagggcgaggagagcagactggagagcggcatgcagaacgtgagcatccacaccaagaccaccagcagctacgccggcggcctgagcagcgcctacggcggcctgaccagccccggcatcatctacagactgggcagcagcttcggcagcgccgccggcagcagcagcttcagcagaaccagcagcaccagagccgtggtggtgagaaagatcgagacccacgacggcaagctggagagcgagagcagcgacgtgctgagcaagtag

SEQ ID NO: 11710 - DNA, 504 bp, Artificial Sequence
  Description of Artificial Sequence: Synthetic coding sequence
atgtacatgggcatgatgtgcaccgccaagaagtgcggcatcagattccagccccccgccatcatcctgatctacgagagcgagatcaagggcaagatcagacagagaatcatgcccgtgagaaacttcagcaagttcagcgactgcaccagagccgccgagcagctgaagaacaaccccagacacaagagctacctggagcaggtgagcctgagacagctggagaagctgttcagcttcctgagaggctacctgagcggccagagcctggccgagaccatggagcagatccagagagagaccaccatcgaccccgaggaggacctgaacaagctggacgacaaggagctggccaagagaaagagcatcatggacgagctgttcgagaagaaccagaagaagaaggacgaccccaacttcgtgtacgacatcgaggtggagttcccccaggacgaccagctgcagagctgcggctgggacaccgagagcgccgacgagttctag

SEQ ID NO: 11711 - DNA, 378 bp, Artificial Sequence; identical to SEQ ID NO: 9465
  Description of Artificial Sequence: Synthetic coding sequence

SEQ ID NO: 11712 - DNA, 1005 bp, Artificial Sequence
  Description of Artificial Sequence: Synthetic coding sequence
atgaccagaagcctgttcaagggcaacttctggagcgccgacatcctgagcaccatcggctacgacaacatcatccagcacctgaacaacggcagaaagaactgcaaggagttcgaggacttcctgaaggagagagccgccatcgaggagagatacggcaaggacctgctgaacctgagcagaaagaagccctgcggccagagcgagatcaacaccctgaagagagccctggaggtgttcaagcagcaggtggacaacgtggcccagtgccacatccagctggcccagagcctgagagaggaggccagaaagatggaggagttcagagagaagcagaagctgcagagaaagaagaccgagctgatcatggacgccatccacaagcagaagagcctgcagttcaagaagaccatggacgccaagaagaactacgagcagaagtgcagagacaaggacgaggccgagcaggccgtgagcagaagcgccaacctggtgaaccccaagcagcaggagaagctgttcgtgaagctggccaccagcaagaccgccgtggaggacagcgacaaggcctacatgctgcacatcggcaccctggacaaggtgagagaggagtggcagagcgagcacatcaaggcctgcgaggccttcgaggcccaggagtgcgagagaatcaacttcttcagaaacgccctgtggctgcacgtgaaccagctgagccagcagtgcgtgaccagcgacgagatgtacgagcaggtgagaaagagcctggagatgtgcagcatccagagagacatcgagtacttcgtgaaccagagaaagaccggccagatcccccccgcccccatcatgtacgagaacttctacagcagccagaagaacgccgtgcccgccggcaaggccaccggccccaacctggccagaagaggccccctgcccatccccaagagcagccccgacgaccccaactacagcctggtggacgactacagcctgctgtaccagtag

SEQ ID NO: 11713 - DNA, 597 bp, Artificial Sequence
  Description of Artificial Sequence: Synthetic coding sequence
atgaagaaggtgagactgaaggagctggagagcagactgcagcaggtggacggcttcgagaagcccaagctgctgctggagcagtaccccaccagaccccacatcgccgcctgcatgctgtacaccatccacaacacctacgacgacatcgagaacaaggtggtggccgacctgggctgcggctgcggcgtgctgagcatcggcaccgccatgctgggcgccggcctgtgcgtgggcttcgacatcgacgaggacgccctggagatcttcaacagaaacgccgaggagttcgagctgaccaacatcgacatggtgcagtgcgacgtgtgcctgctgagcaacagaatgagcaagagcttcgacaccgtgatcatgaacccccccttcggcaccaagaacaacaagggcaccgacatggccttcctgaagaccgccctggagatggccagaaccgccgtgtacagcctgcacaagagcagcaccagagagcacgtgcagaagaaggccgccgagtggaagatcaagatcgacatcatcgccgagctgagatacgacctgcccgccagctacaagttccacaagaagaagagcgtgtag

SEQ ID NO: 11714 - DNA, 1125 bp, Artificial Sequence
  Description of Artificial Sequence: Synthetic coding sequence
atgctggcccccggctgcgagctggaccccgaccaggaggtggtgagaaccagacccgaggacgtgcccgccagccccagcaccagcaccatgatcgtgagcgtgctgagaccccccagccacgccagctgcaccgcctgcggcaccgtgaccttccacatcgtggagagaatggccagcgtgatccccgccagcaacagaagcatgagaagcgacagaaacacctacgtgggcaagagattcgtgcacgtgaagaacccctacctggacctgatggacgaggacatcctgtaccacctggacctgggcaccaagacccacaacctgcccgccatgttcggcgacgtgaagttcgtgtgcgtgggcggcagccccaacagaatgaaggccttcgccctgttcatgcacaaggagctgggcttcgaggaggccgaggaggacatcaaggacatctgcgccggcaccgacagatactgcatgtacaagaccggccccgtgctggccatcagccacggcatgggcatccccagcatcagcatcatgctgcacgagctgatcaagctgctgcaccacgccagatgctgcgacgtgaccatcatcagaatcggcaccagcggcggcatcggcatcgcccccggcaccgtggtgatcaccgacatcgccgtggacagcttcttcaagcccagattcgagcaggtgatcctggacaacatcgtgaccagaagcaccgagctggacaaggagctgagcgaggagctgttcaactgcagcaaggagatccccaacttccccaccctggtgggccacaccatgtgcacctacgacttctacgagggccagggcagactggacggcgccctgtgcagcttcagcagagagaagaagctggactacctgaagagagccttcaaggccggcgtgagaaacatcgagatggagagcaccgtgttcgccgccatgtgcggcctgtgcggcctgaaggccgccgtggtgtgcgtgaccctgctggacagactggactgcgaccagatcaacctgccccacgacgtgctggtggagtaccagcagagaccccagctgctgatcagcaacttcatcagaagaagactgggcctgtgcgactag

SEQ ID NO: 11715 - DNA, 4149 bp, Artificial Sequence
  Description of Artificial Sequence: Synthetic coding sequence
atgctgagaaagctgaccatcgagcagatcaacgactggttcaccatcggcaagaccgtgaccaacgtggagctgctgggcgccccccccgccttccccgccggcgccgccagagaggaggtgcagagacaggacgtggcccccggcgccggccccgccgcccaggcccccgccctggcccaggcccccgccagacccgccgccgccttcgagagaagcctgagccagagaagcagcgaggtggagtacatcaacaagtacagacagctggaggcccaggagctggacgtgtgcagaagcgtgcagcccaccagcggccccggccccagacccagcctggccaagctgagcagcgtgacctgcatccccggcaccacctacaagtaccccgacctgcccatcagcagatacaaggaggaggtggtgagcctgatcgagagcaacagcgtggtgatcatccacggcgccaccggcagcggcaagagcacccagctgccccagtacatcctggaccactacgtgcagagaagcgcctactgcagcatcgtggtgacccagcccagaaagatcggcgccagcagcatcgccagatggatcagcaaggagagagcctggaccctgggcggcgtggtgggctaccaggtgggcctggagaagatcgccaccgaggacaccagactgatctacatgaccaccggcgtgctgctgcagaagatcgtgagcgccaagagcctgatggagttcacccacatcatcatcgacgaggtgcacgagagaaccgaggagatggacttcctgctgctggtggtgagaaagctgctgagaaccaacagcagattcgtgaaggtggtgctgatgagcgccaccatcagctgcaaggagttcgccgactacttcgccgtgcccgtgcagaacaagatgaaccccgcctacatcttcgaggtggagggcaagccccacagcgtggaggagtactacctgaacgacctggagcacatccaccacagcaagctgagcccccacctgctggaggagcccgtgatcaccaaggacatctacgaggtggccgtgagcctgatccagatgttcgacgacctggacatgaaggagagcggcaacaaggcctggagcggcgcccagttcgtgctggagagaagcagcgtgctggtgttcctgcccggcctgggcgagatcaactacatgcacgagctgctgaccagcctggtgcacaagagactgcaggtgtaccccctgcacagcagcgtggccctggaggagcagaacaacgtgttcctgagccccgtgcccggctacagaaagatcatcctgagcaccaacatcgccgagagcagcgtgaccgtgcccgacgtgaagtacgtgatcgacttctgcctgaccagaaccctggtgtgcgacgaggacaccaactaccagagcctgagactgagctgggccagcaagaccagctgcaaccagagaaagggcagagccggcagagtgagcagaggctactgctacagactggtgcacaaggacttctgggacaacagcatccccgaccacgtggtgcccgagatgctgagatgccccctgggcagcaccatcctgaaggtgaagctgctggacatgggcgagcccagagccctgctggccaccgccctgagcccccccggcctgagcgacatcgagagaaccatcctgctgctgaaggaggtgggcgccctggccgtgagcggccagagagaggacgagaacccccacgacggcgagctgaccttcctgggcagagtgctggcccagctgcccgtgaaccagcagctgggcaagctgatcgtgctgggccacgtgttcggctgcctggacgagtgcctgatcatcgccgccgccctgagcctgaagaacttcttcgccatgcccttcagacagcacctggacggctacagaaacaaggtgaacttcagcggcagcagcaagagcgactgcatcgccctggtggaggccttcaagacctggaaggcctgcagacagaccggcgagctgagataccccaaggacgagctgaactggggcagactgaactacatccagatcaagagaatcagagaggtggccgagctgtacgaggagctgaagaccagaatcagccagttcaacatgcacgtggacagcagaagacccgtgatggaccaggagtacatctacaagcagagattcatcctgcaggtggtgctggccggcgccttctaccccaactacttcaccttcggccagcccgacgaggagatggccgtgagagagctggccggcaaggaccccaagaccaccgtggtgctgaagcacatccccccctacggcttcctgtactacaagcagctgcagagcctgttcagacagtgcggccaggtgaagagcatcgtgttcgacggcgccaaggccttcgtggagttcagcagaaaccccaccgagagattcaagaccctgcccgccgtgtacatggccatcaagatgagccagctgaaggtgagcctggagctgagcgtgcacagcgccgaggagatcgagggcaaggtgcagggcatgaacgtgagcaagctgagaaacaccagagtgaacgtggacttccagaagcagaccgtggaccccatgcaggtgagcttcaacaccagcgacagaagccagaccgtgaccgacctgctgctgaccatcgacgtgaccgaggtggtggaggtgggccacttctggggctacagaatcgacgagaacaacagcgagatcctgaagaagctgaccgccgagatcaaccagctgaccctggtgcccctgcccacccacccccaccccgacctggtgtgcctggcccccttcgccgacttcgacaagcagagatacttcagagcccaggtgctgtacgtgagcggcaacagcgccgaggtgttcttcgtggactacggcaacaagagccacgtggacctgcacctgctgatggagatcccctgccagttcctggagctgcccttccaggccctggagttcaagatctgcaagatgagacccagcgccaagagcctggtgtgcggcaagcactggagcgacggcgccagccagtggttcgccagcctggtgagcggctgcaccctgctggtgaaggtgttcagcgtggtgcacagcgtgctgcacgtggacgtgtaccagtacagcggcgtgcaggacgccatcaacatcagagacgtgctgatccagcagggctacgccgagctgaccgaggagagctacgagagcaagcagagccacgaggtgctgaagggcctgttcagcaagagcgtggagaacatgaccgacggcagcgtgcccttccccatgaaggacgacgagaagtacctgatcagaatcctgctggagagcttcagcaccaacaagctgggcacccccaactgcaaggccgagctgcacggccccttcaacccctacgagctgaagtgccacagcctgaccagaatcagcaagttcagatgcgtgtggatcgagaaggagagcatcaacagcgtgatcatcagcgacgcccccgaggacctgcaccagagaatgctggtggccgccagcctgagcatcaacgccaccggcagcaccatgctgctgagagagaccagcctgatgccccacatccccggcctgcccgccctgctgagcatgctgttcgcccccgtgatcgagctgagaatcgaccagaacggcaagtactacaccggcgtgctgtgcggcctgggctggaaccccgccaccggcgccagcatcctgcccgagcacgacatggagctggccttcgacgtgcagttcagcgtggaggacgtggtggaggtgaacatcctgagagccgccatcaacaagctggtgtgcgacggccccaacggctgcaagtgcctgggccccgagagagtggcccagctgcaggacatcgccagacagaagctgctgggcctgttctgccagagcaagcccagagagaagatcgtgcccaagtggcacgagaagccctacgagtggaaccaggtggaccccaagctggtgatggagcaggccgacagagagagcagcagaggcaagaacaccttcctgtaccagctgcacaagctggtggtgctgggcacctag

SEQ ID NO: 11716 - DNA, 357 bp, Artificial Sequence
  Description of Artificial Sequence: Synthetic coding sequence
atggacgtgttcctgatgatcagaagacacaagaccaccatcttcaccgacgccaaggagagcagcaccgtgttcgagctgaagagaatcgtggagggcatcctgaagagaccccccgacgagcagagactgtacaaggacgaccagctgctggacgacggcaagaccctgggcgagtgcggcttcaccagccagaccgccagaccccaggcccccgccaccgtgggcctggccttcagagccgacgacaccttcgaggccctgtgcatcgagcccttcagcagcccccccgagctgcccgacgtgatgaagccccaggacagcggcagcagcgccaacgagcaggccgtgcagtag

SEQ ID NO: 11717 - DNA, 3228 bp, Artificial Sequence; identical to SEQ ID NO: 10451
  Description of Artificial Sequence: Synthetic coding sequence

SEQ ID NO: 11718 - DNA, 381 bp, Artificial Sequence
  Description of Artificial Sequence: Synthetic coding sequence
atgaccgccaccgagcagtggatcttcctgtgcgccgcccacaagacccccaaggagtgccccgccatcgactacaccagacacaccctggacggcgccgcctgcctgctgaacagcaacaagtacttccccagcagagtgagcatcaaggagagcagcgtggccaagctgggcagcgtgtgcagaagaatctacagaatcttcagccacgcctacttccaccacagacagatcttcgacgagtacgagaacgagaccttcctgtgccacagattcaccaagttcgtgatgaagtacaacctgatgagcaaggacaacctgatcgtgcccatcctggaggaggaggtgcagaacagcgtgagcggcgagagcgaggcctag

SEQ ID NO: 11719 - DNA, 2811 bp, Artificial Sequence; identical to SEQ ID NO: 9287
  Description of Artificial Sequence: Synthetic coding sequence

SEQ ID NO: 11720 - DNA, 1860 bp, Artificial Sequence; identical to SEQ ID NO: 10300
  Description of Artificial Sequence: Synthetic coding sequence

SEQ ID NO: 11721 - DNA, 513 bp, Artificial Sequence
  Description of Artificial Sequence: Synthetic coding sequence
atgaccagaggcaaccagagagagctggccagacagaagaacatgaagaagcagagcgacagcgtgaagggcaagagaagagacgacggcctgagcgccgccgccagaaagcagagagtgggcgtgcagcagcccaacgccgagctgagccccatccacttccacctgatcctgtgcgccctgcacccccccgccagctgccccttctgccccctggtgccccccagcgcccccagcagcctgccccccggcaccagaagaagctgcagcagaagcagaaagagacagaccagaagaagaagaaaccccagcagcttcgtggccagctgccccaccctgctgcccttcgcctgcgtgcccggcgccagccccaccaccctggccttcccccccgtggtgctgaccggccccagcaccgacggcatccccttcgccctgagcctgcagagagtgcccttcgtgctgcccagcccccaggtggccagcctgcccctgggccacagcagaggctag

SEQ ID NO: 11722 - DNA, 630 bp, Artificial Sequence; identical to SEQ ID NO: 9403
  Description of Artificial Sequence: Synthetic coding sequence

SEQ ID NO: 11723 - DNA, 1755 bp, Artificial Sequence
  Description of Artificial Sequence: Synthetic coding sequence
atggccgccagcgccaagagaaagcaggaggagaagcacctgaagatgctgagagacatgaccggcctgccccacaacagaaagtgcttcgactgcgaccagagaggccccacctacgtgaacatgaccgtgggcagcttcgtgtgcaccagctgcagcggcagcctgagaggcctgaaccccccccacagagtgaagagcatcagcatgaccaccttcacccagcaggagatcgagttcctgcagaagcacggcaacgaggtgtgcaagcagatctggctgggcctgttcgacgacagaagcagcgccatccccgacttcagagacccccagaaggtgaaggagttcctgcaggagaagtacgagaagaagagatggtacgtgccccccgagcaggccaaggtggtggccagcgtgcacgccagcatcagcggcagcagcgccagcagcaccagcagcacccccgaggtgaagcccctgaagagcctgctgggcgacagcgcccccaccctgcacctgaacaagggcacccccagccagagccccgtggtgggcagaagccagggccagcagcaggagaagaagcagttcgacctgctgagcgacctgggcagcgacatcttcgccgcccccgccccccagagcaccgccaccgccaacttcgccaacttcgcccacttcaacagccacgccgcccagaacagcgccaacgccgacttcgccaacttcgacgccttcggccagagcagcggcagcagcaacttcggcggcttccccaccgccagccacagccccttccagccccagaccaccgccttcagaatgctgagcagcagctgcagcttcggcgagttcaccagcgccttccccctgcaggccacccacagcggcagcgccgccagcgtgaacgccaacttcgcccacttcgacaacttccccaagagcagcagcgccgacttcggcaccttcaacaccagccagagccaccagaccgccagcgccgtgagcaaggtgagcaccaacaaggccggcctgcagaccgccgacaagtacgccgccctggccaacctggacaacatcttcagcgccggccagggcggcgaccagggcagcggcttcggcaccaccggcaaggcccccgtgggcagcgtggtgagcgtgcccagccagagcagcgccagcagcgacaagtacgccgccctggccgagctggacagcgtgttcagcagcgccgccaccagcagcaacgcctacaccagcaccagcaacgccagcagcaacgtgttcggcaccgtgcccgtggtggccagcgcccagacccagcccgccagcagcagcgtgcccgcccccttcggcgccacccccagcaccaaccccttcgtggccgccgccggccccagcgtggccagcagcaccaaccccttccagaccaacgccagaggcgccaccgccgccaccttcggcaccgccagcatgagcatgcccaccggcttcggcacccccgccccctacagcctgcccaccagcttcagcggcagcttccagcagcccgccttccccgcccaggccgccttcccccagcagaccgccttcagccagcagcccaacggcttcgccgccttcggccagaccaagcccgtggtgacccccttcggccaggtggccgccgccggcgtgagcagcaaccccttcatgaccggcgcccccaccggccagttccccaccggcagcagcagcaccaaccccttcctgtag

SEQ ID NO: 11724 - DNA, 795 bp, Artificial Sequence; identical to SEQ ID NO: 10335
  Description of Artificial Sequence: Synthetic coding sequence

SEQ ID NO: 11725 - DNA, 1506 bp, Artificial Sequence
  Description of Artificial Sequence: Synthetic coding sequence
atgagcagcgagcaggacaagagcgccagcaaggagaagagcaagaagcccgtgagattcctgccccagctgagcatggagaagctggccagcaaggagaagttcaaggcccccgccagagccctgccccagctgagcatggtgagcaccaagccccactggcagcaggccgcccccagcttccacctgagcgtgaagcaggacgacgagagccccgagcccttcagcgtgaagaacgagcagagccacgccgagtacatggagagattcggcaagaagggcaagctgccccaccaggtggacgacagctacgtgggccccagcaccagcaagagcaagggcaagagcccccacaaggagagagagaacttcagaagcaccctggtgaacgtgatcatgcagcaggacgccgacctggacagcgccgtgcccgacggcagcaccatccccaagcccaccgccagcgccatcgagaaggacatcctgagatactactactacatccaccacggcatcgacaccgaccacgtggcccccatggaggacagctggctggagcacgtgctggacctggtgccccagcacctgaaggtgttcaccgacagcatcgtgaccctgagcgacgagatgagagaggactacctgctgagcgtgagaaagagcatcgtggacttcgtgctgaaggaccccagagagaagggcgacgacaagaagaccgacgagctgcccgcccacagagccgagatggagatcctgcccaagccctggagaaagagcttcctggccgccagcagctacatcagagaccacctgaacgccatgaaccccaccatgctggccgtgctggacctgtggcacaccaacttcaagaagctgagactggtggacatcaaggagttccacaactgccaggacgccctggagctgagcagcttccagaacatcatcatgagacacatggacagcgccaaggagaccctgctgaagatgtggttccccgaggtgcagaacatctactaccagggcaacaagaagaagcagctgcccaccggcgacagcagcgccaagctggagagcttcttcaactgcgccgccgccctgatgaccctgcagctgcaggacctgaccctggtgagcatgcaggacttcaccgacctgatcgcccagccccccgacagcgtgagagccttcgagcaccccggcttcatcatgagactgatcctggacaacgacaccatcaagttcgagcccgagctgagcgactacatcgacatcttcctgaacgtgtacgacgtgatgatcaaggccgtgagcttcgtgcccagagtggagaccaagctgtacagcaagtggagaaacaaggccaagcccggccacttctacttcagccacatccagagaagcgtgaccttccagcacagcgaggtgagcagcccccagaacagccacttcaagatcgtgagccccttcagcgtgctgggcttcacctggagatgccagctgtag

SEQ ID NO: 11726 - DNA, 855 bp, Artificial Sequence
  Description of Artificial Sequence: Synthetic coding sequence
atgaccgacgtgcccgccaccttcacccaggccgagtgcaacggcgacaagccccccgagaacggccagcagaccatcaccaagatcagcgaggagctgaccgacgtggacagccccctgccccactacagagtggagcccagcctggagggcgccctgaccaagggcagccaggaggagagaagaaagctgcagggcaacatgctgctgaacagcagcatggaggacaagatgctgaaggagaaccccgaggagaagctgttcatcgtgcacaaggccatcaccgacctgagcctgcaggagaccagcgccgacgagatgaccttcagagagggccaccagtgggagaagatccccctgagcggcagcaaccaggagatcagaagacagaaggagagaatcaccgagcagcccctgaaggaggaggaggacgaggacagaaagaacaagggccaccaggccgccgagatcgagtggctgggcttcagaaagcccagccaggccgacatgctgcacagcaagcacgacgaggagcagaaggtgtgggacgaggagatcgacgacgacgacgacgacaactgcaacaacgacgaggacgaggtgagagtgatcgagttcaagaagaagcacgaggaggtgagccagttcaaggaggagggcgacgccagcgaggacagccccctgagcagcgccagcagccaggccgtgacccccgacgagcagcccaccctgggcaagaagagcgacatcagcagaaacgcctacagcagatacaacaccatcagctacagaaagatcagaaagggcaacaccaagcagagaatcgacgagttcgagagcatgatgcacctgtag

SEQ ID NO: 11727 - DNA, 735 bp, Artificial Sequence
  Description of Artificial Sequence: Synthetic coding sequence
atgaagaaggtgagactgaaggagctggagagcagactgcagcaggtggacggcttcgagaagcccaagctgctgctggagcagtaccccaccagaccccacatcgccgcctgcatgctgtacaccatccacaacacctacgacgacatcgagaacaaggtggtggccgacctgggctgcggctgcggcgtgctgagcatcggcaccgccatgctgggcgccggcctgtgcgtgggcttcgacatcgacgaggacgccctggagatcttcaacagaaacgccgaggagttcgagctgaccaacatcgacatggtgcagtgcgacgtgtgcctgctgagcaacagaatgagcaagagcttcgacaccgtgatcatgaacccccccttcggcaccaagaacaacaagggcaccgacatggccttcctgaagaccgccctggagatggccagaaccgccgtgtacagcctgcacaagagcagcaccagagagcacgtgcagaagaaggccgccgagtggaagatcaagatcgacatcatcgccgagctgagatacgacctgcccgccagctacaagttccacaagaagaagagcgtgagcctgctgatcctggccggcctgcacagcgtgctgaagagcttcctgggcagaatgtggtggttcatgcccgtgatccccgccaccagagaggccgaggccagagagagcctggagctgagaagacagagactgcagtag

SEQ ID NO: 11728 - DNA, 885 bp, Artificial Sequence
  Description of Artificial Sequence: Synthetic coding sequence
atgaacaaccagaagcagcagaagcccaccctgagcggccagagattcaagaccagaaagagagacgagaaggagagattcgaccccacccagttccaggactgcatcatccagggcctgaccgagaccggcaccgacctggaggccgtggccaagttcctggacgccagcggcgccaagctggactacagaagatacgccgagaccctgttcgacatcctggtggccggcggcatgctggcccccggcggcaccctggccgacgacatgatgagaaccgacgtgtgcgtgttcgccgcccaggaggacctggagaccatgcaggccttcgcccaggtgttcaacaagctgatcagaagatacaagtacctggagaagggcttcgaggacgaggtgaagaagctgctgctgttcctgaagggcttcagcgagagcgagagaaacaagctggccatgctgaccggcgtgctgctggccaacggcaccctgaacgccagcatcctgaacagcctgtacaacgagaacctggtgaaggagggcgtgagcgccgccttcgccgtgaagctgttcaagagctggatcaacgagaaggacatcaacgccgtggccgccagcctgagaaaggtgagcatggacaacagactgatggagctgttccccgccaacaagcagagcgtggagcacttcaccaagtacttcaccgaggccggcctgaaggagctgagcgagtacgtgagaaaccagcagaccatcggcgccagaaaggagctgcagaaggagctgcaggagcagatgagcagaggcgaccccttcaaggacatcatcctgtacgtgaaggaggagatgaagaagaacaacatccccgagcccgtggtgatcggctag

SEQ ID NO: 11729 - DNA, 1374 bp, Artificial Sequence; identical to SEQ ID NO: 11556
  Description of Artificial Sequence: Synthetic coding sequence

SEQ ID NO: 11730 - DNA, 1638 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggagttcgccgtgcccgactacagaagcagccacctggaggtgagccaggccagccagctgctgcagcagcagcagcagcagcagctgagaagaagacccagcctgctgagcgagttccaccccggcagcgacagaccccaggagagaagaaccagctacgagcccttccaccccggccccagccccgtggaccacgacagcctggagagcaagagacccagactggagcaggtgagcgacagccacttccagagagtgagcgccgccgtgctgcccctggtgcaccccctgcccgagggcctgagagccagcgccgacgccaagaaggaccccgccttcggcggcaagcacgaggcccccagcagccccatcagcggccagccctgcggcgacgaccagaacgccagccccagcaagctgagcaaggaggagctgatccagagcatggacagagtggacagagagatcgccaaggtggagcagcagatcctgaagctgaagaagaagcagcagcagctggaggaggaggccgccaagccccccgagcccgagaagcccgtgagccccccccccgtggagcagaagcacagaagcatcgtgcagatcatctacgacgagaacagaaagaaggccgaggaggcccacaagatcttcgagggcctgggccccaaggtggagctgcccctgtacaaccagcccagcgacaccaaggtgtaccacgagaacatcaagaccaaccaggtgatgagaaagaagctgatcctgttcttcaagagaagaaaccacgccagaaagcagagagagcagaagatctgccagagatacgaccagctgatggaggcctgggagaagaaggtggacagaatcgagaacaaccccagaagaaaggccaaggagagcaagaccagagagtactacgagaagcagttccccgagatcagaaagcagagagagcagcaggagagattccagagagtgggccagagaggcgccggcctgagcgccaccatcgccagaagcgagcacgagatcagcgagatcatcgacggcctgagcgagcaggagaacaacgagaagcagatgagacagctgagcgtgatcccccccatgatgttcgacgccgagcagagaagagtgaagttcatcaacatgaacggcctgatggaggaccccatgaaggtgtacaaggacagacagttcatgaacgtgtggaccgaccacgagaaggagatcttcaaggacaagttcatccagcaccccaagaacttcggcctgatcgccagctacctggagagaaagagcgtgcccgactgcgtgctgtactactacctgaccaagaagaacgagaactacaaggccctggtgagaagaaactacggcaagagaagaggcagaaaccagcagcagatcgccagacccagccaggaggagaaggtggaggagaaggaggaggacaaggccgagaagaccgagaagaaggaggaggagaagaaggacgaggaggagaaggacgagaaggaggacagctag

SEQ ID NO: 11731 - DNA, 480 bp, Artificial Sequence
  Description of Artificial Sequence: Synthetic coding sequence
atgacccactgctgcagcccctgctgccagcccacctgctgcagaaccacctgctggcagcccaccaccgtgaccacctgcagcagcaccccctgctgccagcccagctgctgcgtgagcagctgctgccagccctgctgccaccccacctgctgccagaacacctgctgcagaaccacctgctgccagcccatctgcgtgaccagctgctgccagcccagctgctgcagcaccccctgctgccagcccacctgctgcggcagcagctgcggccagagcagcagctgcgcccccgtgtactgcagaagaacctgctaccaccccaccagcgtgtgcctgcccggctgcctgaaccagagctgcggcagcaactgctgccagccctgctgcagacccgcctgctgcgagaccacctgctgcagaaccacctgcttccagcccacctgcgtgtacagctgctgccagcccagctgctgctag

SEQ ID NO: 11732 - DNA, 1071 bp, Artificial Sequence
  Description of Artificial Sequence: Synthetic coding sequence
atggagggccacgaccccaaggagcccgagcagctgagaaagctgttcatcggcggcctgagcttcgagaccaccgacgacagcctgagagagcacttcgagaagtggggcaccctgaccgactgcgtggtgatgagagacccccagaccaagagaagcagaggcttcggcttcgtgacctacagctgcgtggaggaggtggacgccgccatgtgcgccagaccccacaaggtggacggcagagtggtggagcccaagagagccgtgagcagagaggacagcgtgaagcccggcgcccacctgaccgtgaagaagatcttcgtgggcggcatcaaggaggacaccgaggagtacaacctgagagactacttcgagaagtacggcaagatcgagaccatcgaggtgatggaggacagacagagcggcaagaagagaggcttcgccttcgtgaccttcgacgaccacgacaccgtggacaagatcgtggtgcagaagtaccacaccatcaacggccacaactgcgaggtgaagaaggccctgagcaagcaggagatgcagagcgccggcagccagagaggcagaggcggcggcagcggcaacttcatgggcagaggcggcaacttcggcggcggcggcggcaacttcggcagaggcggcaacttcggcggcagaggcggctacggcggcggcggcggcggcagcagaggcagctacggcggcggcgacggcggctacaacggcttcggcggcgacggcggcaactacggcggcggccccggctacagcagcagaggcggctacggcggcggcggccccggctacggcaaccagggcggcggctacggcggcggcggcggctacgacggctacaacgagggcggcaacttcggcggcggcaactacggcggcggcggcaactacaacgacttcggcaactacagcggccagcagcagagcaactacggccccatgaagggcggcagcttcggcggcagaagcagcggcagcccctacggcggcggctacggcagcggcggcggcagcggcggctacggcagcagaagattctag

SEQ ID NO: 11733 - DNA, 186 bp, Artificial Sequence
  Description of Artificial Sequence: Synthetic coding sequence
atgcccttcttcggcaacaccttcagccccaagaagaccccccccagaaagagcgccagcctgagcaacctgcacagcctggacagaagcaccagagaggtggagctgggcctggagtacggcagccccaccatgaacctggccggccagagcctgaagttcgagaacggccagtggatcgcctag

SEQ ID NO: 11734 - DNA, 981 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggctag

SEQ ID NO: 11735 - DNA, 2031 bp, Artificial Sequence
  Description of Artificial Sequence: Synthetic coding sequence
atgatccccccccaggaggccagcgccagaagaagagagatcgaggacaagctgaagcaggaggaggagaccctgagcttcatcagagacagcctggagaagagcgaccagctgaccaagaacatggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtgaagctgctgttcgagagaggcaaggaggccctggagagcgagttcagaagcctgatgaccagacacagcaaggtggtgagccccgtgctgatcctggacctgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggccacgagcacgacttcagagtgaagcacctgagcgaggccctgaacgacaagcacggccccctggccggcagagacgacatgctggacgtggagaccgacgcctacatccactgcgtgagcgccttcgtgaagctggcccagagcgagtaccagctgctggccgacatcatccccgagcaccaccagaagaagaccttcgacagcctgatccaggacgccctggacggcctgatgctggagggcgagaacatcgtgagcgccgccagaaaggccatcgtgagacacgacttcagcaccgtgctgaccgtgttccccatcctgagacacctgaagcagaccaagcccgagttcgaccaggtgctgcagggcaccgccgccagcaccaagaacaagctgcccggcctgatcaccagcatggagaccatcggcgccaaggccctggaggacttcgccgacaacatcaagaacgaccccgacaaggagtacaacatgcccaaggacggcaccgtgcacgagctgaccagcaacgccatcctgttcctgcagcagctgctggacttccaggagaccgccggcgccatgctggccagccaggagaccagcagcagcgccaccagctacagcagcgagttcagcaagagactgctgagcacctacatctgcaaggtgctgggcaacctgcagctgaacctgctgagcaagagcaaggtgtacgaggaccccgccctgagcgccatcttcctgcacaacaactacaactacatcctgaagagcctggagaagagcgagctgatccagctggtggccgtgacccagaagaccgccgagagaagctacagagagcacatcgagcagcagatccagacctaccagagaagctggctgaaggtgaccgactacatcgccgagaagaacctgcccgtgttccagcccggcgtgaagctgagagacaaggagagacagatcatcaaggagagattcaagggcttcaacgacggcctggaggagctgtgcaagatccagaaggcctgggccatccccgacaccgagcagagagacagaatcagacaggcccagaagaccatcgtgaaggagacctacggcgccttcctgcagaagttcggcagcgtgcccttcaccaagaaccccgagaagtacatcaagtacggcgtggagcaggtgggcgacatgatcgacagactgttcgacaccagcgcctag

SEQ ID NO: 11736 - DNA, 459 bp, Artificial Sequence
  Description of Artificial Sequence: Synthetic coding sequence
atgaccgacgtgcccgccaccttcacccaggccgagtgcaacggcgacaagccccccgagaacggccagcagaccatcaccaagatcagcgaggagctgaccgacgtggacagccccctgccccactacagagtggagcccagcctggagggcgccctgaccaagggcagccaggaggagagaagaaagctgcagggcaacatgctgctgaacagcagcatggaggacaagatgctgaaggagaaccccgaggagaagctgttcatcgtgcacaaggccatcaccgacctgagcctgcaggagaccagcgccgacgagatgaccttcagagagggccaccagtgggagaagatccccctgagcggcagcaaccaggagatcagaagacagaaggagagaatcaccgagcagcccctgaaggaggaggaggacgaggacagaaagaacaagggccactag

SEQ ID NO: 11737 - DNA, 768 bp, Artificial Sequence
  Description of Artificial Sequence: Synthetic coding sequence
atgtggcccttccccagcagaagcctgttccccccccccacccaggcctggctgcagaccgtgagcagcgaccccgaggcccagggctggggcgcctggaacgagaccaaggagatcctgggccccgagggcggcgagggcaaggaggagaaggaggaggaggaggacgccgaggaggaccaggacggcgacgccggcttcctgctgagcctgctggagcaggagaacctggccgagtgccccctgcccgaccaggagctggaggccatcaagatgaaggtgtgcgccatggagcaggccgagggcacccccagaccccccggcgtgcagcagcaggccgaggaggaggagggcaccgccgccggccagctgctgagccccgagaccgtgggctgccccctgagcggcacccccgaggagaaggtggaggccgaccacagaagcgtgtacgtgggcaacgtggactacggcggcagcgccgaggagctggaggcccacttcagcagatgcggcgaggtgcacagagtgaccatcctgtgcgacaagttcagcggccaccccaagggctgctgcagaaaggagcccaccagcctgggcagcgccccccagaccgccggcgccttcgaggacacccaggcccccggcggccaccccagccccaccgccgccagcagagccggccccggcagcgaccacaagggcagaaccggccccgtggagaacagccaccacggcttccacagaatcaagggcaagaccagattctag

SEQ ID NO: 11738 - DNA, 3561 bp, Artificial Sequence
  Description of Artificial Sequence: Synthetic coding sequence
atggagaaggccaccgtgcccgtggccgccgccaccgccgccgagggcgagggcagcccccccgccgtggccgccgtggccggcccccccgccgccgccgaggtgggcggcggcgtgggcggcagcagcagagccagaagcgccagcagccccagaggcatggtgagagtgtgcgacctgctgctgaagaagaagcccccccagcagcagcaccacaaggccaagagaaacagaacctgcagaccccccagcagcagcgagagcagcagcgacagcgacaacagcggcggcggcggcggcggcggcggcggcggcggcggcggcggcggcaccagcagcaacaacagcgaggaggaggaggacgacgacgacgaggaggaggaggtgagcgaggtggagagcttcatcctggaccaggacgacctggagaaccccatgctggagaccgccagcaagctgctgctgagcggcaccgccgacggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgagagccgagagcaccgccaacgccggccagagcgacaacagaagcctggccgaggcctgcagcgagggcgacgtgaacgccgtgagaaagctgctgatcgagggcagaagcgtgaacgagcacaccgaggagggcgagagcctgctgtgcctggcctgcagcgccggctactacgagctggcccaggtgctgctggccatgcacgccaacgtggaggacagaggcatcaagggcgacatcacccccctgatggccgccgccaacggcggccacgtgaagatcgtgaagctgctgctggcccacaaggccgacgtgaacgcccagagcagcaccggcaacaccgccctgacctacgcctgcgccggcggctacgtggacgtggtgaaggtgctgctggagagcggcgccagcatcgaggaccacaacgagaacggccacacccccctgatggaggccggcagcgccggccacgtggaggtggccagactgctgctggagaacggcgccggcatcaacacccacagcaacgagttcaaggagagcgccctgaccctggcctgctacaagggccacctggagatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccagcctggaggaggtgaacgacgagggctacacccccctgatggaggccgccagagagggccacgaggagatggtggccctgctgctgggccagggcgccaacatcaacgcccagaccgaggagacccaggagaccgccctgaccctggcctgctgcggcggcttcctggaggtggccgacttcctgatcaaggccggcgccgacatcgagctgggctgcagcacccccctgatggaggccgcccaggagggccacctggagctggtgaagtacctgctggccgccggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacgtgtgcaccgtgcagttcctgatcagcaagggcgccaacgtgaacagaaccaccgccaacaacgaccacaccgtgctgagcctggcctgcgccggcggccacctggccgtggtggagctgctgctggcccacggcgccgaccccacccacagactgaaggacggcagcaccatgctgatcgaggccgccaagggcggccacaccagcgtggtgtgctacctgctggactaccccaacaacctgctgagcgcccccccccccgacgtgacccagctgaccccccccagccacgacctgaacagagcccccagagtgcccgtgcaggccctgcccatggtggtgcccccccaggagcccgacaagccccccgccaacgtggccaccaccctgcccatcagaaacaaggccgccagcaagcagaagagcagcagccacctgcccgccaacagccaggacgtgcagggctacatcaccaaccagagccccgagagcatcgtggaggaggcccagggcaagctgaccgagctggagcagagaatcaaggaggccatcgagaagaacgcccagctgcagagcctggagctggcccacgccgaccagctgaccaaggagaagatcgaggagctgaacaagaccagagaggagcagatccagaagaagcagaagatcctggaggagctgcagaaggtggagagagagctgcagctgaagacccagcagcagctgaagaagcagtacctggaggtgaaggcccagagaatccagctgcagcagcagcagcagcagagctgccagcacctgggcctgctgacccccgtgggcgtgggcgagcagctgagcgagggcgactacgccagactgcagcaggtggaccccgtgctgctgaaggacgagccccagcagaccgccgcccagatgggcttcgcccccatccagcccctggccatgccccaggccctgcccctggccgccggccccctgccccccggcagcatcgccaacctgaccgagctgcagggcgtgatcgtgggccagcccgtgctgggccaggcccagctggccggcctgggccagggcatcctgaccgagacccagcagggcctgatggtggccagccccgcccagaccctgaacgacaccctggacgacatcatggccgccgtgagcggcagagccagcgccatgagcaacacccccacccacagcatcgccgccagcatcagccagccccagacccccacccccagccccatcatcagccccagcgccatgctgcccatctaccccgccatcgacatcgacgcccagaccgagagcaaccacgacaccgccctgaccctggcctgcgccggcggccacgaggagctggtgcagaccctgctggagagaggcgccagcatcgagcacagagacaagaagggcttcacccccctgatcctggccgccaccgccggccacgtgggcgtggtggagatcctgctggacaacggcgccgacatcgaggcccagagcgagagaaccaaggacacccccctgagcctggcctgcagcggcggcagacaggaggtggtggagctgctgctggccagaggcgccaacaagagcaccggcatgttcctgatcacccacctgtag

SEQ ID NO: 11739 - DNA, 2682 bp, Artificial Sequence
  Description of Artificial Sequence: Synthetic coding sequence
atggccgccaccgtggagggccccgagctggaggccgccgccgccgccggcgacgccagcgaggacagcgacgccggcagcagagccctgcccttcctgggcggcaacagactgagcctggacctgtaccccggcggctgccagcagctgctgcacctgtgcgtgcagcagcccctgcagctgctgcaggtggagttcctgagactgagcacccacgaggacccccagctgctggaggccaccctggcccagctgccccagagcctgagctgcctgagaagcctggtgctgaagggcggccagagaagagacaccctgggcgcctgcctgagaggcgccctgaccaacctgcccgccggcctgagcggcctggcccacctggcccacctggacctgagcttcaacagcctggagaccctgcccgcctgcgtgctgcagatgagaggcctgggcgccctgctgctgagccacaactgcctgagcgagctgcccgaggccctgggcgccctgcccgccctgaccttcctgaccgtgacccacaacagactgcagaccctgccccccgccctgggcgccctgagcaccctgcagagactggacctgagccagaacctgctggacaccctgccccccgagatcggcggcctgggcagcctgctggagctgaacctggccagcaacagactgcagagcctgcccgccagcctggccggcctgagaagcctgagactgctggtgctgcacagcaacctgctggccagcgtgcccgccgacctggccagactgcccctgctgaccagactggacctgagagacaaccagctgagagacctgccccccgagctgctggacgcccccttcgtgagactgcagggcaaccccctgggcgaggccagccccgacgcccccagcagccccgtggccgccctgatccccgagatgcccagactgttcctgaccagcgacctggacagcttccccgtgaccccccagggctgcagcgtgaccctggcctgcggcgtgagactgcagttccccgccggcgccaccgccacccccatcaccatcagatacagactgctgctgcccgagcccggcctggtgcccctgggcccccacgacgccctgctgagccacgtgctggagctgcagccccacggcgtggccttccagcaggacgtgggcctgtggctgctgttcacccccccccaggccagaagatgcagagaggtggtggtgagaaccagaaacgacaacagctggggcgacctggagacctacctggaggaggaggccccccagagactgtgggcccactgccaggtgccccacttcagctggttcctggtggtgagcagacccgtgagcaacgcctgcctggtgccccccgagggcaccctgctgtgcagcagcggccaccccggcgtgaaggtgatcttcccccccggcgccaccgaggagcccagaagagtgagcatgcaggtggtgagaatggccggcagagagctgcaggccctgctgggcgagcccgaggccgccgtgagccccctgctgtgcctgagccagagcggcccccccagcttcctgcagcccgtgaccgtgcagctgcccctgcccagcggcatcaccggcctgagcctggacagaagcagactgcacctgctgtactgggccccccccgccgccacctgggacgacatcaccgcccaggtggtgctggagctgacccacctgtacgccagattccaggtgacccacttcagctggtactggctgtggtacaccaccaagaactgcgtgggcggcctggccagaaaggcctgggagagactgagactgcacagagtgaacctgatcgccctgcagagaagaagagaccccgagcaggtgctgctgcagtgcctgcccagaaacaaggtggacgccaccctgagaagactgctggagagatacagaggccccgagcccagcgacaccgtggagatgttcgagggcgaggagttcttcgccgccttcgagagaggcatcgacgtggacgccgacagacccgactgcgtggagggcagaatctgcttcgtgttctacagccacctgaagaacgtgaaggaggtgagcttctacagaggcgccgtgcccgtgagagtgcccgaggaggccgaggccgccagacagagaaagggcgccgacgccctgtggatggccaccctgcccatcaagctgcccagactgagaggcagcgagggccccagaagaggcgccggcctgagcctggcccccctgaacctgggcgacgccgagaccggcttcctgacccagagcaacctgctgagcgtggccggcagactgggcctggactggcccgccgtggccctgcacctgggcgtgagctacagagaggtgcagagaatcagacacgagttcagagacgacctggacgagcagatcagacacatgctgttcagctgggccgagagacaggccggccagcccggcgccgtgggcctgctggtgcaggccctggagcagagcgacagacaggacgtggccgaggaggtgagagccgtgctggagctgggcagaagaaagtaccaggacagcatcagaagaatgggcctggcccccaaggaccccgccctgcccggcagcagcgccccccagccccccgagcccgcccaggcctag

SEQ ID NO: 11740 - DNA, 1482 bp, Artificial Sequence
  Description of Artificial Sequence: Synthetic coding sequence
atggacttcctgctgggcaaccccttcagcagccccgtgggccagagaatcgagaaggccaccgacggcagcctgcagagcgaggactgggccctgaacatggagatctgcgacatcatcaacgagaccgaggagggccccaaggacgccctgagagccgtgaagaagagaatcgtgggcaacaagaacttccacgaggtgatgctggccctgaccgtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacaccccccagagaaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggcatgaacctgggcagcagcagcgtgagagccggcctgcagagcctggaggccagcggcagactggaggacgagttcgacatgttcgccctgaccagaggcagcagcctggccgaccagagaaaggaggtgaagtacgaggccccccaggccaccgacggcctggccggcgccctggacgccagacagcagagcaccggcgccatccccgtgacccaggcctgcctgatggaggacatcgagcagtggctgagcaccgacgtgggcaacgacgccgaggagcccaagggcgtgaccagcgagggcaagttcgacaagttcctggaggagagagccaaggccgccgacagactgcccaacctgagcagccccagcgccgagggcccccccggcccccccagcggccccgcccccagaaagaagacccaggagaaggacgacgacatgctgttcgccctgtag

SEQ ID NO: 11741 - DNA, 663 bp, Artificial Sequence
  Description of Artificial Sequence: Synthetic coding sequence
atgaacagccagccccagaccagaagcccccccagcagaaccgtgcccatccactgcaccgacaactggaagagaagaaaggtgctggagcagacccccgtgtacagaagcctggccggcagaggctggatcaagtactgcatcttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagtag

SEQ ID NO: 11742 - DNA, 414 bp, Artificial Sequence
  Description of Artificial Sequence: Synthetic coding sequence
atgagcctgttcggcaccaccagcggcttcggcaccagcggcaccagcatgttcggcagcgccaccaccgacaaccacaaccccatgaaggacatcgaggtgaccagcagccccgacgacagcatcggctgcctgagcttcagcccccccaccctgcccggcaacttcctgatcgccggcagctgggccaacgacgtgagatgctgggaggtgcaggacagcggccagaccatccccaaggcccagcagatgcacaccggccccgtgctggacgtgtgctggagcgacgacggcagcaaggtgttcaccgccagctgcgacaagaccgccaagatgtgggacctgagcagcaaccaggccatccagatcgcccagcacgacgcccccgtgaagaccatccactggatcaagtag

SEQ ID NO: 11743 - DNA, 7809 bp, Artificial Sequence
  Description of Artificial Sequence: Synthetic coding sequence
atgaagagaaaggtggtgaacacccacaagctgagactgagccccaacgaggaggccttcatcctgaaggaggactacgagagaagaagaaagctgagactgctgcaggtgagagagcaggagagagacatcgccctgcagatcagagaggacatcaagcagagaagaaaccagcagttcaccagactggccgaggagctgagagccgagtgggaggagagccagacccagaagatccagaacctggagaagctgtacctggccagcctgagaagcatgggcgagggccacagacaggccaaggagaacgagcccgacctggacgccctggcccagagagccgccgagagaaagagaaaggccgacctgagacacaaggaggccctgaaggtgcagaagaaccagaaggagatcctgctgaagcagaagacctggcacatcaaggccagaaaggaggccctgctggtggagaaggagagaagcgccaagatcaccagcctgcccccccccccccccaccctgttcgagaacatcgaggtgaagagaatcagcgccgtgaagaccaacagcagcacctaccaccacctgcacaccttcgtgaacagagagaccgacaccaagagacccgacgccagactggccgccgaggaggaggccaagagactggaggagctgcagaagcaggccgcccaggagagaatggagagattcgagaaggcccacgtgagaggcttccaggccatgaagaagatccacctggcccagaaccaggagaagctgatgaaggagctgaagcagctgcagcaggaggacctggccagaagaagacagaccgtggcccagatgcccccccagctggtggagctgccctacaagagaagcgagatgaaggaggactggcagagagagctggagttcgccttcgaggacatgtacaacgccgacagaaaggtgaagggcaacctgatcctgcacctggagcccgagcccctgcccaccgtgaccaaccagatccaggacgaggagctggacctgagcatggagcaggagaacctgggcgccgccgaggacctgcccgtgaccgaggccgagatctgcagcagcgagaccgacgtgcccctggtgatgaagacccagcagatccccagcaaggtgctgttcaagaagctgctgaacaagatcagaagccagaagagcctgtggaccatcaagagcatgagcgaggacgagagcgagatgatcaccaccgtgagcgagatcgagagcaaggcccccaccgtggagagcggcaccatcgccagcaaggagagaaccctgagcagcggccaggagcaggtggtggagagcgacaccctgaccatcgagagcggccccctggccagcgaggacaagcccctgagctgcggcaccaacagcggcaaggagcaggagatcaacgagaccctgcccatcaccaccgtggcccagagcagcgtgctgctgcacccccaggaggccgccgccagaatcagaatgagcgccagacagaagcagatcatggagatcgaggagcagaagcagaagcagctggagctgctggagcagatcgagcagcagaagctgagactggagaccgactgcttcagagcccagctggaggaggagaagagaaagaagacccagcccaccggcgtgggcatcgcccccgccagctgccccgtgatcagcgacgaggacagccacagacagatgatcagaaactaccagcaccagctgctgcagcagaacagactgcacagacagagcgtggagaccgccagaaagcagctgctggagtaccagaccatgctgaagggcagatgccccagcgtgagcgcccccagcctgatcaccgacagcgtgatcagcgtgcccagctggaagagcgagagacccaccgccatcagcgagcactgggaccagggccagagactgaagctgagccccaacaagtaccagcccatccagcccatccagaccagcaagctggagcaggaccacttccaggtggccagacagaaccacttcccccagagacaggtggagaccaccgagaccctgagagccagcgacatcctgaccaaccaggccctggagagccaggagcacctgagacagttcagccagaccgagacccagcagagagactacaagctggtgcccaaggacagcgagaccctgagcagagccctgagccacgacagacagctgatcagccaggacgccagaaagatcagcgagaccttcggcgccaccaccttccagagcctggagagccagcagctgttcagcgagaacagcgagaacatcagctaccacctgaccgagcccagcagcttcgtgcccctggtgccccagcacagcttcagcagcctgcccgtgaaggtggagagcggcaagatccaggagcccttcagcgccatgagcaagagcaccgtgagcaccagccacagcatcatcagccagatgcacgacagacccctgctgcccagcgagaacatcaccgcccagcagggcaacatgaaggccctgcaggagcagctggacctgcagaagaaggtgctgcaggccacccaggaggcccaggagcagctgctgctgtgcaagcagaaggaggtggagcagcagaccggcctgagcgtgttcctgcccctggtgacccccgacagcagcgccctgctgcccagcgccaaggccgacctgggcagaatccaggagagcagccccaccaagaacaacatcgccgtgagcagcgaccaccacgtgatcagccagctgcaggacaagagactgagcctgagccagcccatcctgagccagcagaacaacttcaagttcctgcaggagcagctgaacatccagaaggacagcctgcaggccagaagagaggcccaggaggtgctgtacgtgcacaagcagagcgagctggacagaagagtgtgcagcgagcaggccgagcccagcttccccttccaggtggcccagcacaccttcaccagcctgcccagcgccgacaccaagagcggcaagatccaggagcagcacagcagcaagagcgagaagggcctggtgagctgccagagcgacatccccatcagccaggacggcagcctgagcttcctgcagcagttcctgcccctgcacgacagcctgaagctgctgcaggagcagctgaccaagcagagagacaccctgcaggccagacacgaggcccaggtggagctgctgctgcacagacagagagacctgggcgacagcaagagcggcctggtgagcagcagcagcagccccgtggtggtgcagcacagcgtggccagccaggccagcgccaaggccgagcccagaagaatccaggagctgtacctgagcgagaaggagaacgtgggccccagctgccacctgatcatccccaccttccaggacaagagcctgagcttcccccagcacagcctggcccagcaggagaacctgaccatcctgcaggagcagagccagatccagagagtgatcctgggcgccaaggagggcacccaggagttcgtgcacaccgagagcgagctggagaagagaatcagcagcgagcagaccggcaccagcagcagcctgagccaggtggacgagagcgagagattccaggagtgcatcagcatcaagagcgacagcaccatccccctgagccaccccaagatccccagatgccaggagagactgctgagagtgagccagcacatgctgcccctgcaggacaacctggaggagcaccaggcctggctggacaccgagaaggaggccttccacttcagccagaagacccaggagaacaccagcagcgagcagaccggcagcagcagcttcatcccccagctggtgcagctgagcttcaccagcctggccagcgccgagagcggcaccatcctggagcccctgttcaccgagagcgagagcaagatcttcagcagccacctgcagatcccccagctgcaggacagactgctgagaatcagccagctgatccagccccagcaggacaacctgaaggccctgcaggagcagctggccacccagagagaggccatcatcctggccagacaggaggccagagaggagctgctgctgcaccagagcgagtgggagggcagaatcagccccgagcaggtggacaccagcagcctgcccctggtgccccagcacagcttcgccagcctgcccctgaacgagagcgagagaaaccaggagccctgcagcatcaacagcgacaacatcgtgagcagcggccacagcgagatccccaccctgcccgacggcctgctgggcctgagccacctggtgctgccccagcaggacaacctgatcgccctggaggagcacctgcacgcccagaccgacttcctgcccagcatcgagaagacccagaaggagctggtgctgagcaagccctgcaagttcgaggagaaggtgagcagcgagcacttcatccagagccaccacggcgacctgcaggccctgcagcagcagctggacacccagaagaaggccatcagaagcatccaggaggtgcaggaggagctgctgctgcagagactgagcgagctggagaagagagtgagcagcgagcaggtgtgcagcagcagcttcgtgagccaggtgcccgtggccgacagcgagagaacccagaagagcttccccaccaagagcaacgacaccctgcccagcagccacagagagatccccagactgcaggacagactgctgagcctgagcaagcccatcctgccccagcaggacaacatgaccgcccagctggacgcccagagagaggtgatgtacagctacgagaagccccaggaggagctgagcctgaacaagcagagaaagctgaacaagagcgagagcgccgagcacaccatccccagcctgttcctgcccaaggagaccgagcacagcttcatccccctgcccttcgccgaggccaagcccaagagcacctgcgagctgtacagcagccagaacgagcacgccgccccccccagcaaccccgtgatccccggcttccaggacagactgctgagcttcagccagagcgtgctgacccagcaggacaacctgggcctgcagaagcagctggacctgcagagagaggtgctgcactacagccagaaggcccaggagaagctgctggtgcagagacagaccgccctgcagcagcagatccagaagcacgaggagaccctgaaggacttcttcaaggacagccagatcagcaagcccaccgtggagaacgacctgaagacccagaagatgggccagctgagagactggttccccaacacccaggacctggccggcaacgaccaggagaacatcagacacgccgacagaaacaacagcgacgacaaccacctggccagcgaggacaccagcgccaagcagagcggcgagcacctggagaaggacctgggcagaagaagcagcaagccccccgtggccaaggtgaagtgcggcctggacctgaaccagcacgagctgagcgccatccaggaggtggagagccccgccatcggcagaaccagcatcctgggcaagcccggcatctacgaggacagagaccccctgagagtgagcatcagcagagagcagagcttcttcggcagccccctggcccacgaccccttcagctgcctgcagctggtgggccaggagaacgtgtgcggcgacgactacgacgaggccgtgaagctgaaggagagcgtggtggagaaccacgccgtgctgagctacgccgtggaggaggagcacgcctacctgggccccaccgtgaagcccgacgacaaggccaagaccctgagctacgagcccctgagcagcgccaccgtgagcaccggcagcctgctgagctacgagaacaccgacctgagcctgaccgaccccgagagcttcagcgagcacatggacgacagcaagcaggagagcaccaccagcaaggaggaggagaccaacatcatcagcagcatcgtgcccagcacccaggacatctaccagagacagaacagcagcgacgtgcacaagagcctgctgcccgccgtggacgagaccacctgcggccacacccacttccagcagatgatcgacaagtacatcaacgaggccaacctgatccccgagaagaccgacctgcaggagctggagcacatcttccccaacctgcaccaccagctgttcaagcccctggagccccaccccgacttcgacctgagcagcagcagcagcggcatcagccccgacaacagagacttctaccagagaagcgacagcagcagcgagagccactgcgccaccggcctgagcaagagcaccgtgtacttcaccgccctgagaagaaccagcatgcacagcagcctgaacaccagccccaaccagcagcccgacaccaacctggcccacgtgggcgcccacagcttcgccaccgagaacatcatcggcggcagcgagcagtgcttcgagcagctgcagcccgagtacagcagccaggaggagagccagcacgccgacctgcccagcatcttcagcatcgaggccagagacagcagccagggcatgaagaaccagaactaccccagcgaggagcacaccgagatcctgcagaacaagaagaagatcgtgcacttccagctgagcatcggcaacctgagcagcgtgtacagcagcagcgacgaggccaacgtgttcgaccagctgaacgtgcagcacagcaccccctgcggcagcaacagcagcgagtgcagcaccaagcaccagctggagagcagaaaggagagcatgggcttcgaggagctgagcaagagaggcgtggtgaccatgctgcagagccagggcctgatcgaggacaacaagaacgagacctgcagagtgctggacatcaacccccaggtggaggagaccgacagcagactgtgcgtgagaaccgtggagatgggcaccagcatccaggccccctacagcctgaccacccagaacgagaagtacttcgagaacagcgccgagaccgacatccccaagatcaccaagaagctgagccagctgggcgagagcgagctgttcgccagcagcggcagcttcagcctgcagagcagcatccccgtgtgggagaccgagaccggccacggcatcatggaggagcccgagctgaccctgatcagcaccaccgacaccagcatcgccgagatggacttcgccaacctgaccctggaggagaagagcgagaacgaggccaagtgcttcttccaggtgagcgagttcctgcccctggtgagcgccaccgaggccagcgactaccccgccgtgagcgagctgagcatcgagaagcccagaaccgccagcaccgccgagacccccagaagactgacccccgtgcccggcagcctgcaggaggccttcatcaagagaaagaagagcttcatggagagaagccaccagagacagaaggagatcagaaacaagatccacgtgagcgagaacagccagatcaagaccgtgaaggagaagcccagcatcagcagcagcgtgagcagactgaagggcgtgaacaaggtgagagccagcttccccgaggacagaaagaccacccaggccctgagacaccagagaggcctgagactgtacaaccagctggccgaggtgaagcagcagaaggaggagaagaccaagcaggaggcctacgcccagaacagagccagagccaaggagttccacaagaagaccctggagaagctgagagccaagaacacctgctag

SEQ ID NO: 11744 - DNA, 1602 bp, Artificial Sequence
  Description of Artificial Sequence: Synthetic coding sequence
agcgcccccagcgtgggcaacgacatgggcaacgacgacgccatcggcggcaacgtgagcaagtacatcgtgctgcccaccggctactgcggccagcccaagaagggccacctgatcttcgacgcctgcttcgagagcggcaacctgggcagagtggaccaggtgagcgagttcgagtacgacctgttcatcagacccgacacctgcaaccccagattcagagtgtggttcaacttcaccgtggagaacgtgaaggagagccagagagtgatcttcaacatcgtgaacttcagcaagaccaagagcctgtacagagacggcatggcccccatggtgaagagcaccagcagacccaagtggcagagactgccccccaagaacgtgtactactacagatgccccgaccacagaaagaactacgtgatgagcttcgccttctgcttcgacagagaggaggacatctaccagttcgcctactgctacccctacacctacaccagattccagcactacctggacagcctgcagaagagaaacatggactacttcttcagagagcagctgggccagagcgtgcagcagagaaagctggacctgctgaccatcaccagccccgacaacctgagagagggcgccgagcagaaggtggtgttcatcaccggcagagtgcaccccggcgagacccccagcagcttcgtgtgccagggcatcatcgacttcctggtgagccagcaccccatcgcctgcgtgctgagagagtacctggtgttcaagatcgcccccatgctgaaccccgacggcgtgtacctgggcaactacagatgcagcctgatgggcttcgacctgaacagacactggctggaccccagcccctgggtgcaccccaccctgcacggcgtgaagcagctgatcgtgcagatgtacaacgaccccaagaccagcctggagttctacatcgacatccacgcccacagcaccatgatgaacggcttcatgtacggcaacatcttcgaggacgaggagagattccagagacaggccatcttccccaagctgctgtgccagaacgccgaggacttcagctacagcagcaccagcttcaacagagacgccgtgaaggccggcaccggcagaagattcctgggcggcctgctggaccacaccagctactgctacaccctggaggtgagcttctacagctacatcatcagcggcaccaccgccgccgtgccctacaccgaggaggcctacatgaagctgggcagaaacgtggccagaaccttcctggactactacagactgaaccccgtggtggagaaggtggccatccccatgcccagactgagaaacaaggagatcgaggtgcagagaagaaaggagaagagccccccctacaagcaccccctgctgagaggccccgccagcaactaccccaacagcaagggcgacaagaagagcagcgtgaaccacaaggaccccagcacccccttcaagaccagaagccccggcagaagctacggcgacagaagcatgcacttcctgctgggcaacgagatcaaccacagcagcctggccagcaaggacctgtggatcaacgcctag

SEQ ID NO: 11745 - DNA, 1509 bp, Artificial Sequence
  Description of Artificial Sequence: Synthetic coding sequence
atgcccgagatcagagtgacccccctgggcgcctgccccgtgctgagctggaacctggtgctgccccccggcagaggcagcagagcccccagcagcaccgacaccagaaccggcttccacgtgctgccccacggcgtggacgacgagctggagatcaaggcctactacgccggccacgtgctgggcgccgccatgttccagatcaaggtgggcagcgagagcgtggtgtacaccggcgactacaacatgacccccgacagacacctgggcgccgcctggatcgacaagtgcagacccaacctgctgatcaccgagagcacctacgccaccaccatcagagacagcaagagatgcagagagagagacttcctgaagaaggtgcacgagaccgtggagagaggcggcaaggtgctgatccccgtgttcgccctgggcagagcccaggagctgtgcatcctgctggagaccttctgggagagaatgaacctgaaggtgcccatctacttcagcaccggcctgaccgagaaggccaaccactactacaagctgttcatcccctggaccaaccagaagatcagaaagaccttcgtgcagagaaacatgttcgagttcaagcacatcaaggccttcgacagagccttcgccgacaaccccggccccatggtggtgttcgccacccccggcatgctgcacgccggccagagcctgcagatcttcagaaagtgggccggcaacgagaagaacatggtgatcatgcccggctactgcgtgcagggcaccgtgggccacaagatcctgagcggccagagaaagctggagatggagggcagacaggtgctggaggtgaagatgcaggtggagtacatgagcttcagcgcccacgccgacgccaagggcatcatgcagctggtgggccaggccgagcccgagagcgtgctgctggtgcacggcgaggccaagaagatggagttcctgaagcagaagatcgagcaggagctgagagtgaactgctacatgcccgccaacggcgagaccgtgaccctgcccaccagccccagcatccccgtgggcatcagcctgggcctgctgaagagagagatggcccagggcctgctgcccgaggccaagaagcccagactgctgcacggcaccctgatcatgaaggacagcaacttcagactggtgagcagcgagcaggccctgaaggagctgggcctggccgagcaccagctgagattcacctgcagagtgcacctgcacgacaccagaaaggagcaggagaccgccctgagagtgtacagccacctgaagagcgtgctgaaggaccactgcgtgcagcacctgcccgacggcagcgtgaccgtggagagcgtgctgctgcaggccgccgcccccagcgaggaccccggcaccaaggtgctgctggtgagctggacctaccaggacgaggagctgggcagcttcctgaccagcctgctgaagaagggcctgccccaggcccccagctag

SEQ ID NO: 11746 - DNA, 1371 bp, Artificial Sequence
  Description of Artificial Sequence: Synthetic coding sequence
atggccgacagcctggagagcacccccctgcccagccccgaggacagactggccaagctgcaccccagcaaggagctgctggagtactaccagaagaagatggccgagtgcgaggccgagaacgaggacctgctgaagaagctggagctgtacaaggaggcctgcgagggccagcacaagctggagtgcgacctgcagcagagagaggaggagatcgccgagctgcagaaggccctgagcgacatgcaggtgtgcctgttccaggagagagagcacgtgctgagactgtacagcgagaacgacagactgagaatcagagagctggaggacaagaagaagatccagaacctgctggccctggtgggcaccgacgccggcgaggtgacctacttctgcaaggagcccccccacaaggtgaccatcctgcagaagaccatccaggccgtgggcgagtgcgagcagagcgagagcagcgccttcaaggccgaccccaagatcagcaagagaagacccagcagagagagaaaggagagcagcgagcactaccagagagacatccagaccctgatcctgcaggtggaggccctgcaggcccagctgggcgagcagaccaagctgagcagagagcagatcgagggcctgatcgaggacagaagaatccacctggaggagatccaggtgcagcaccagagaaaccagaacaagatcaaggagctgaccaagaacctgcaccacacccaggagctgctgtacgagagcaccaaggacttcctgcagctgagaagcgagaaccagaacaaggagaagagctggatgctggagaaggacaacctgatgagcaagatcaagcagtacagagtgcagtgcaagaagaaggaggacaagatcggcaaggtgctgcccgtgatgcacgagagccaccacgcccagagcgagtacatcaagagcctgaaggacaagctggtgcaggagaagaagctgagcaacatgtaccaggagcagtgcatcagcctggaggaggagctggccagaatcagagaggaggagggcatgagaagagagatcttcaaggacagaaccaacaagatgggcaagagactgcagatcatgaccaagagatacgaggccctggagagaagaagaatcctggaggtggagggcttcaagaccgacatcaaggtgctgagacagaagctgaaggacctggagcagatgctgtacaaggccaccgtgaacgccagagccaaccaggacctggccctgctgtgcgaggtgagagacagcaacagaagagcccacaagatccagggcgagctgaagaacctgaagagcaaggtgttcggcctggagaacgagctgagactgtgctag

SEQ ID NO: 11747 - DNA, 270 bp, Artificial Sequence; identical to SEQ ID NO: 11466
  Description of Artificial Sequence: Synthetic coding sequence

SEQ ID NO: 11748 - DNA, 453 bp, Artificial Sequence
  Description of Artificial Sequence: Synthetic coding sequence
atgcaccccgaggacagcgtggtgagcagcaaggtgctgggctgcagccacttccccgtggccagcagacccgccggcagccacgacccccagcccggccacagaggcagagtgctgggccccgccagagcccccggctgggtgagatacgccgagagagtgctgggcagacccatcaccgcccacctgtgcaccgccaagagcccccagcaggtgatgggcagcctggtgaaggactacttcgccagacagcagaacctgagccccgagaagatcttccacgtgatcgtggccccctgctacgacaagaagctggaggccctgcaggagagcctgccccccgccctgcacggcagcagaggcgccgactgcgtgctgaccagcggcgagatcgcccagatcatggagcagggcgacctgagcgtgagagacgccgccgtggacaccctgtag

SEQ ID NO: 11749 - DNA, 534 bp, Artificial Sequence
  Description of Artificial Sequence: Synthetic coding sequence
atgggctgctgcggctgcagcagaggctgcggcagcggctgcggcggctgcggcagcagctgcggcggctgcggcagcggctgcggcggctgcggcagcggcagaggcggctgcggcagcggctgcggcggctgcagcagcagctgcggcggctgcggcagcagatgctacgtgcccgtgtgctgctgcaagcccgtgtgcagctgggtgcccgcctgcagctgcaccagctgcggcagctgcggcggcagcaagggcggctgcggcagctgcggcggcagcaagggcggctgcggcagctgcggcggcagcaagggcggctgcggcagctgcggctgcagccagagcagctgctgcaagccctgctgctgcagcagcggctgcggcagcagctgctgccagagcagctgctgcaagccctgctgctgccagagcagctgctgcgtgcccgtgtgctgccagagcagctgctgcaagccctgctgctgccagagcaactgctgcgtgcccgtgtgctgccagtgcaagatctag

SEQ ID NO: 11750 - DNA, 294 bp, Artificial Sequence
  Description of Artificial Sequence: Synthetic coding sequence
atgcccgccgagctgtggctgaccagctacggcgtgagagaggtggaccaggtgaagagactgaccggccccggcctgagcgagggccccgagcccagcatcagcgtgatggtgaccggcggcccctggcccaccagactgagcagaacctgcctgcactacctgggcgagttcggcgaggaccagatctacgaggcccaccagcagggcagaggcgccctggaggccctgctgtgcggcggcccccagggcgcctgcagcgagaaggtgagcgccaccagagaggagctgtag

SEQ ID NO: 11751 - DNA, 264 bp, Artificial Sequence
  Description of Artificial Sequence: Synthetic coding sequence
atggagaaccagctggccaagagcaccgaggagagaaccttccagtaccaggacagcctgcccagcctgcccgtgcccagcctggaggagagcctgaagaagtacctggagagcgtgaagcccttcgccaaccaggaggagtacaagaagaccgaggagatcgtgcagaagttccagagcggcatcggcgagaagctgcaccagaagctgctggagagagccaagggcaagagaaactgggtgttcgtggtgatcatcgagtag

SEQ ID NO: 11752 - DNA, 1881 bp, Artificial Sequence; identical to SEQ ID NO: 10843
  Description of Artificial Sequence: Synthetic coding sequence

SEQ ID NO: 11753 - DNA, 2940 bp, Artificial Sequence
  Description of Artificial Sequence: Synthetic coding sequence
atgctgtgctggggcaacgccagcttcggccagctgggcctgggcggcatcgacgaggagatcgtgctggagcccagaaagagcgacttcttcatcaacaagagagtgagagacgtgggctgcggcctgagacacaccgtgttcgtgctggacgacggcaccgtgtacacctgcggctgcaacgacctgggccagctgggccacgagaagagcagaaagaagcccgagcaggtggtggccctggacgcccagaacatcgtggccgtgagctgcggcgaggcccacaccctggccctgaacgacaagggccaggtgtacgcctggggcctggacagcgacggccagctgggcctggtgggcagcgaggagtgcatcagagtgcccagaaacatcaagagcctgagcgacatccagatcgtgcaggtggcctgcggctactaccacagcctggccctgagcaaggccagcgaggtgttctgctggggccagaacaagtacggccagctgggcctgggcaccgactgcaagaagcagaccagcccccagctgctgaagagcctgctgggcatccccttcatgcaggtggccgccggcggcgcccacagcttcgtgctgaccctgagcggcgccatcttcggctggggcagaaacaagttcggccagctgggcctgaacgacgagaacgacagatacgtgcccaacctgctgaagagcctgagaagccagaagatcgtgtacatctgctgcggcgaggaccacaccgccgccctgaccaaggagggcggcgtgttcaccttcggcgccggcggctacggccagctgggccacaacagcaccagccacgagatcaaccccagaaaggtgttcgagctgatgggcagcatcgtgaccgagatcgcctgcggcagacagcacaccagcgccttcgtgcccagcagcggcagaatctacagcttcggcctgggcggcaacggccagctgggcaccggcagcaccagcaacagaaagagccccttcaccgtgaagggcaactggtacccctacaacggccagtgcctgcccgacatcgacagcgaggagtacttctgcgtgaagagaatcttcagcggcggcgaccagagcttcagccactacagcagcccccagaactgcggcccccccgacgacttcagatgccccaaccccaccaagcagatctggaccgtgaacgaggccctgatccagaagtggctgagctaccccagcggcagattccccgtggagatcgccaacgagatcgacggcaccttcagcagcagcggctgcctgaacggcagcttcctggccgtgagcaacgacgaccactacagaaccggcaccagattcagcggcgtggacatgaacgccgccagactgctgttccacaagctgatccagcccgaccacccccagatcagccagcaggtggccgccagcctggagaagaacctgatccccaagctgaccagcagcctgcccgacgtggaggccctgagattctacctgaccctgcccgagtgccccctgatgagcgacagcaacaacttcaccaccatcgccatccccttcggcaccgccctggtgaacctggagaaggcccccctgaaggtgctggagaactggtggagcgtgctggagccccccctgttcctgaagatcgtggagctgttcaaggaggtggtggtgcacctgctgaagctgtacaagatcggcatcccccccagcgagagaagaatcttcaacagcttcctgcacaccgccctgaaggtgctggagatcctgcacagagtgaacgagaagatgggccagatcatccagtacgacaagttctacatccacgaggtgcaggagctgatcgacatcagaaacgactacatcaactgggtgcagcagcaggcctacggcatggacgtgaaccacggcctgaccgagctggccgacatccccgtgaccatctgcacctaccccttcgtgttcgacgcccaggccaagaccaccctgctgcagaccgacgccgtgctgcagatgcagatggccatcgaccaggcccacagacagaacgtgagcagcctgttcctgcccgtgatcgagagcgtgaacccctgcctgatcctggtggtgagaagagagaacatcgtgggcgacgccatggaggtgctgagaaagaccaagaacatcgactacaagaagcccctgaaggtgatcttcgtgggcgaggacgccgtggacgccggcggcgtgagaaaggagttcttcctgctgatcatgagagagctgctggaccccaagtacggcatgttcagatactacgaggacagcagactgatctggttcagcgacaagatcaccgtggagaacttcggcgccaccgaggtgaaggagctggtgctgaacggcgccgacaccgccgtgaacaagcagaacagacaggagttcgtggacgcctacgtggactacatcttcaacaagagcgtggccagcctgttcgacgccttccacgccggcttccacaaggtgtgcggcggcaaggtgctgctgctgttccagcccaacgagctgcaggccatggtgatcggcaacaccaactacgactggaaggagctggagaagaacaccgagtacaagggcgagtactgggccgagcaccccaccatcaagatcttctgggaggtgttccacgagctgcccctggagaagaagaagcagttcctgctgttcctgaccggcagcgacagaatccccatcctgggcatgaagagcctgaagctggtgatccagagcaccggcggcggcgaggagtacctgcccgtgagccacacctgcttcaacctgctggacctgcccaagtacaccgagaaggagaccctgagaagcaagctgatccaggccatcgaccacaacgagggcttcagcctgatctag

SEQ ID NO: 11754 - DNA, 1020 bp, Artificial Sequence
  Description of Artificial Sequence: Synthetic coding sequence
atgaagatcttcgtgggcaacgtggacggcgccgacaccacccccgaggagctggccgccctgttcgccccctacggcaccgtgatgagctgcgccgtgatgaagcagttcgccttcgtgcacatgagagagaacgccggcgccctgagagccatcgaggccctgcacggccacgagctgagacccggcagagccctggtggtggagatgagcagacccagacccctgaacacctggaagatcttcgtgggcaacgtgagcgccgcctgcaccagccaggagctgagaagcctgttcgagagaagaggcagagtgatcgagtgcgacgtggtgaagggcaagagaatgcacgtgcagctgagcaccagcagactgagaaccgcccccggcatgggcgaccagagcggctgctacagatgcggcaaggagggccactggagcaaggagtgccccatcgacagaagcggcagagtggccgacctgaccgagcagtacaacgagcagtacggcgccgtgagaaccccctacaccatgagctacggcgacagcctgtactacaacaacgcctacggcgccctggacgcctactacaagagatgcagagccgccagaagctacgaggccgtggccgccgccgccgccagcgtgtacaactacgccgagcagaccctgagccagctgccccaggtgcagaacaccgccatggccagccacctgaccagcaccagcctggacccctacgacagacacctgctgcccaccagcggcgccgccgccaccgccgccgccgccgccgccgccgccgccgccgtgaccgccgccagcaccagctactacggcagagacagaagccccctgagaagagccaccgcccccgtgcccaccgtgggcgagggctacggctacggccacgagagcgagctgagccaggccagcgccgccgccagaaacagcctgtacgacatggccagatacgagagagagcagtacgccgacagagccagatacagcgccttctag

SEQ ID NO: 11755 - DNA, 390 bp, Artificial Sequence; identical to SEQ ID NO: 10956
  Description of Artificial Sequence: Synthetic coding sequence

SEQ ID NO: 11756 - DNA, 1695 bp, Artificial Sequence
  Description of Artificial Sequence: Synthetic coding sequence
atgagctaccccgccgacgactacgagagcgaggccgcctacgacccctacgcctaccccagcgactacgacatgcacaccggcgaccccaagcaggacctggcctacgagagacagtacgagcagcagacctaccaggtgatccccgaggtgatcaagaacttcatccagtacttccacaagaccgtgagcgacctgatcgaccagaaggtgtacgagctgcaggccagcagagtgagcagcgacgtgatcgaccagaaggtgtacgagatccaggacatctacgagaacagctggaccaagctgaccgagagattcttcaagaacaccccctggcccgaggccgaggccatcgccccccaggtgggcaacgacgccgtgttcctgatcctgtacaaggagctgtactacagacacatctacgccaaggtgagcggcggccccagcctggagcagagattcgagagctactacaactactgcaacctgttcaactacatcctgaacgccgacggccccgcccccctggagctgcccaaccagtggctgtgggacatcatcgacgagttcatctaccagttccagagcttcagccagtacagatgcaagaccgccaagaagagcgaggaggagatcgacttcctgagaagcaaccccaagatctggaacgtgcacagcgtgctgaacgtgctgcacagcctggtggacaagagcaacatcaacagacagctggaggtgtacaccagcggcggcgaccccgagagcgtggccggcgagtacggcagacacagcctgtacaagatgctgggctacttcagcctggtgggcctgctgagactgcacagcctgctgggcgactactaccaggccatcaaggtgctggagaacatcgagctgaacaagaagagcatgtacagcagagtgcccgagtgccaggtgaccacctactactacgtgggcttcgcctacctgatgatgagaagataccaggacgccatcagagtgttcgccaacatcctgctgtacatccagagaaccaagagcatgttccagagaaccacctacaagtacgagatgatcaacaagcagaacgagcagatgcacgccctgctggccatcgccctgaccatgtaccccatgagaatcgacgagagcatccacctgcagctgagagagaagtacggcgacaagatgctgagaatgcagaagggcgacccccaggtgtacgaggagctgttcagctacagctgccccaagttcctgagccccgtggtgcccaactacgacaacgtgcaccccaactaccacaaggagcccttcctgcagcagctgaaggtgttcagcgacgaggtgcagcagcaggcccagctgagcaccatcagaagcttcctgaagctgtacaccaccatgcccgtggccaagctggccggcttcctggacctgaccgagcaggagttcagaatccagctgctggtgttcaagcacaagatgaagaacctggtgtggaccagcggcatcagcgccctggacggcgagttccagagcgccagcgaggtggacttctacatcgacaaggacatgatccacatcgccgacaccaaggtggccagaagatacggcgacttcttcatcagacagatccacaagttcgaggagctgaacagaaccctgaagaagatgggccagagaccctag

SEQ ID NO: 11757 - DNA, 789 bp, Artificial Sequence; identical to SEQ ID NO: 10456
  Description of Artificial Sequence: Synthetic coding sequence

SEQ ID NO: 11758 - DNA, 1626 bp, Artificial Sequence; identical to SEQ ID NO: 10173
  Description of Artificial Sequence: Synthetic coding sequence

SEQ ID NO: 11759 - DNA, 303 bp, Artificial Sequence
  Description of Artificial Sequence: Synthetic coding sequence
atgagcaccatcggcagcttcgagggcttccaggccgtgagcctgaagcaggagggcgacgaccagcccagcgagaccgaccacctgagcatggaggaggaggaccccatgcccagacagatcagcagacagagcagcgtgaccgagagcaccctgtaccccaacccctaccaccagccctacatcagcagaaagtacttcgccaccagacccggcgccatcgagaccgccatggaggacctgaagggccacgtggccgagaccagcggcgagaccatccagggcttctggctgctgacctag

SEQ ID NO: 11760 - DNA, 1425 bp, Artificial Sequence
  Description of Artificial Sequence: Synthetic coding sequence
atggagagaagcggccagagagtgaccacctgggactgcgaccagggcaagcacagcgacagcgactacagagaggacggcatggacctgggcagcgacgccggcagcagcagcagcagcagcagagccagcagccagagcaacagcaccaaggtgaccccctgcagcgagtgcaagagcagcagcagccccggcggcagcctggacctggtgagcgccctggaggactacgaggagcccttccccgtgtaccagaagaaggtgatcgacgagtgggcccccgaggaggacggcgaggaggaggaggaggaggacgagagagaccagagaggctacagagacgacagaagccccgccagagagcccggcgacgtgagcgccagaaccagaagcggcggcggcggcggcagaagcgccaccaccgccatgcccccccccgtgcccaacggcaacctgcaccagcacgacccccaggacctgagacacaacggcaacgtggtggtggccggcagacccagctgcagcagaggccccagaagagccatccagaagccccagcccgccggcggcagaagaagcggcagaggccccgccgccggcggcctgtgcctgcagccccccgacggcggcacctgcgtgcccgaggagccccccgtgccccccatggactgggaggccctggagaagcacctggccggcctgcagttcagagagcaggaggcccagaagaacgagagagagagcatcagacagaagctggccctgggcagcttcttcgacgacggccccggcatctacaccagctgcagcaagagcggcaagcccagcctgagcagcagactgcagagcggcatgaacctgcagatctgcttcgtgaacgacagcggcagcgacaaggacagcgacgccgacgacagcaagaccgagaccagcctggacacccccctgagccccatgagcaagcagagcagcagctacagcgacagagacaccaccgaggaggagagcgagagcctggacgacatggacttcctgaccagacagaagaagctgcaggccgaggccaagatggccctggccatggccaagcccatggccaagatgcaggtggaggtggagaagcagaacagaaagaagagccccgtggccgacctgctgccccacatgccccacatcagcgagtgcctgatgaagagaagcctgaagcccaccgacctgagagacatgaccatcggccagctgcaggtgatcgtgaacgacctgcacagccagatcgagagcctgaacgaggagctggtgcagctgctgctgatcagagacgagctgcacaccgagcaggacgccatgctggtggacatcgaggacctgaccagacacgccgagagccagcagaagcacatggccgagaagatgcccgccaagtag

SEQ ID NO: 11761 - DNA, 690 bp, Artificial Sequence
  Description of Artificial Sequence: Synthetic coding sequence
atgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggcatgaacctgggcagcagcagcgtgagagccggcctgcagagcctggaggccagcggcagactggaggacgagttcgacatgttcgccctgaccagaggcagcagcctggccgaccagagaaaggaggtgaagtacgaggccccccaggccaccgacggcctggccggcgccctggacgccagacagcagagcaccggcgccatccccgtgacccaggcctgcctgatggaggacatcgagcagtggctgagcaccgacgtgggcaacgacgccgaggagcccaagggcgtgaccagcgaggagttcgacaagttcctggaggagagagccaaggccgccgacagactgcccaacctgagcagccccagcgccgagggcccccccggcccccccagcggccccgcccccagaaagaagacccaggagaaggacgacgacatgctgttcgccctgtag

SEQ ID NO: 11762 - DNA, 1650 bp, Artificial Sequence
  Description of Artificial Sequence: Synthetic coding sequence
atgagcagagtggccaagtacagaagacaggtgagcgaggaccccgacatcgacagcctgctggagaccctgagccccgaggagatggaggagctggagaaggagctggacgtggtggaccccgacggcagcgtgcccgtgggcctgagacagagaaaccagaccgagaagcagagcaccggcgtgtacaacagagaggccatgctgaacttctgcgagaaggagaccaagaagctgatgcagagagagatgagcatggacgagagcaagcaggtggagaccaagaccgacgccaaggaggagaagatcatcagaggcatcgacaagggcagagtgagagccgccgtggacaagaaggaggccggcaaggacggcagaggcgaggagagagccgtggccaccaagaaggaggaggagaagaagggcagcgacagaaacaccggcctgagcagagacaaggacaagaagagagaggagatgaaggaggtggccaagaaggaggacgacgagaaggtgaagggcgagagaagaaacaccgacaccagaaaggagggcgagaagatgaagagagccggcggcaacaccgacatgaagaaggaggacgagaaggtgaagagaggcaccggcaacaccgacaccaagaaggacgacgagaaggtgaagaagaacgagcccctgcacgagaaggaggccaaggacgacagcaagaccaagacccccgagaagcagacccccagcggccccaccaagcccagcgagggccccgccaaggtggaggaggaggccgcccccagcatcttcgacgagcccctggagagagtgaagaacaacgaccccgagatgaccgaggtgaacgtgaacaacagcgactgcatcaccaacgagatcctggtgagattcaccgaggccctggagttcaacaccgtggtgaagctgttcgccctggccaacaccagagccgacgaccacgtggccttcgccatcgccatcatgctgaaggccaacaagaccatcaccagcctgaacctggacagcaaccacatcaccggcaagggcatcctggccatcttcagagccctgctgcagaacaacaccctgaccgagctgagattccacaaccagagacacatctgcggcggcaagaccgagatggagatcgccaagctgctgaaggagaacaccaccctgctgaagctgggctaccacttcgagctggccggccccagaatgaccgtgaccaacctgctgagcagaaacatggacaagcagagacagaagagactgcaggagcagagacaggcccaggaggccaagggcgagaagaaggacctgctggaggtgcccaaggccggcgccgtggccaagggcagccccaagcccagcccccagcccagccccaagcccagccccaagaacagccccaagaagggcggcgcccccgccgcccccccccccccccccccccccctggccccccccctgatcatggagaacctgaagaacagcctgagccccgccacccagagaaagatgggcgacaaggtgctgcccgcccaggagaagaacagcagagaccagctgctggccgccatcagaagcagcaacctgaagcagctgaagaaggtggaggtgcccaagctgctgcagtag

SEQ ID NO: 11763 - DNA, 231 bp, Artificial Sequence
  Description of Artificial Sequence: Synthetic coding sequence
atgagcgccagctgcgacggctgcgtgggcagcagaccccccgtgcacctggccagcggctacagcctggccgacctgctggtgctggagatgggcatgggcacccagtgctggaccgaggaccagagaagatggagcagcctgtggccctggagccacctgagcagcgaccccagcctgcccaacgtgcaggtgaccagactgaccctgctgagcgagcaggccccctag

SEQ ID NO: 11764 - DNA, 1416 bp, Artificial Sequence
  Description of Artificial Sequence: Synthetic coding sequence
atggccaacagcttcgccgccagaatcttcaccaccctgagcgacctgcagaccaacatggccaacctgaaggtgatcggcatcgtgatcggcaagaccgacgtgaagggcttccccgacagaaagaacatcggcagcgagagatacaccttcagcttcaccatcagagacagccccgcccacttcgtgaacgccgccagctggggcaacgaggactacatcaagagcctgagcgacagcttcagagtgggcgactgcgtgatcatcgagaaccccctgatccagagaaaggagatcgagagagaggagaagttcagccccgccacccccagcaactgcaagctgctgctgagcgagaaccacagcaccgtgaaggtgtgcagcagctacgaggtggacaccaagctgctgagcctgatccacctgcccgtgaaggagagccacgactactacagcctgggcgacatcgtggccaacggccacagcctgaacggcagaatcatcaacgtgctggccgccgtgaagagcgtgggcgagcccaagtacttcaccaccagcgacagaagaaagggccagagatgcgaggtgagactgtacgacgagaccgagagcagcttcgccatgacctgctgggacaacgagagcatcctgctggcccagagctggatgcccagagagaccgtgatcttcgccagcgacgtgagaatcaacttcgacaagttcagaaactgcatgaccgccaccgtgatcagcaagaccatcatcaccaccaaccccgacatccccgaggccaacatcctgctgaacttcatcagagagaacaaggagaccaacgtgctggacgacgagatcgacagctacttcaaggagagcatcaacctgagcaccatcgtggacgtgtacaccgtggagcagctgaagggcaaggccctgaagaacgagggcaaggccgaccccagctacggcatcctgtacgcctacatcagcaccctgaacatcgacgacgagaccaccaaggtggtgagaaacagatgcagcagctgcggctacatcgtgaacgaggccagcaacatgtgcaccacctgcaacaagaacagcctggacttcaagagcgtgttcctgagcttccacgtgctgatcgacctgaccgaccacaccggcaccctgcacagctgcagcctgaccggcagcgtggccgaggagaccctgggctgcaccgtgcacgagttcctggccatgaccgacgagcagaagaccgccctgaagtggcagttcctgctggagagaagcaagatctacctgaagttcgtgctgagccacagagccagaagcggcctgaagatcagcgtgctgagctgcaagctggccgaccccaccgaggccagcagaaacctgagcggccagaagcacgtgtag

SEQ ID NO: 11765 - DNA, 747 bp, Artificial Sequence
  Description of Artificial Sequence: Synthetic coding sequence
atggccaccagcgcccccctgagaagcctggaggaggaggtgacctgcagcatctgcctggactacctgagagaccccgtgaccatcgactgcggccacgtgttctgcagaagctgcaccaccgacgtgagacccatcagcggcagcagacccgtgtgccccctgtgcaagaagcccttcaagaaggagaacatcagacccgtgtggcagctggccagcctggtggagaacatcgagagactgaaggtggacaagggcagacagcccggcgaggtgaccagagagcagcaggacgccaagctgtgcgagagacacagagagaagctgcactactactgcgaggacgacggcaagctgctgtgcgtgatgtgcagagagagcagagagcacagaccccacaccgccgtgctgatggagaaggccgcccagccccacagagagaagatcctgaaccacctgagcaccctgagaagagacagagacaagatccagggcttccaggccaagggcgaggccgacatcctggccgccctgaagaagctgcaggaccagagacagtacatcgtggccgagttcgagcagggccaccagttcctgagagagagagaggagcacctgctggagcagctggccaagctggagcaggagctgaccgagggcagagagaagttcaagagcagaggcgtgggcgagctggccagactggccctggtgatcagcgagctggagggcaaggcccagcagtag

SEQ ID NO: 11766 - DNA, 2646 bp, Artificial Sequence
  Description of Artificial Sequence: Synthetic coding sequence
atgttctggaagttcgacctgcacaccagcagccacctggacaccctgctggagagagaggacctgagcctgcccgagctgctggacgaggaggacgtgctgcaggagtgcaaggtggtgaacagaaagctgctggacttcctgctgcagcccccccacctgcaggccatggtggcctgggtgacccaggagccccccgacagcggcgaggagagactgagatacaagtaccccagcgtggcctgcgagatcctgaccagcgacgtgccccagatcaacgacgccctgggcgccgacgagagcctgctgaacagactgtacggcttcctgcagagcaccggcagcctgaaccccctgctggccagcttcttcagcaaggtgatgggcatcctgatcaacagaaagaccgaccagctggtgagcttcctgagaaagaaggacgacttcgtggacctgctgctgcagcacatcggcaccagcgccatcatggacctgctgctgagactgctgacctgcgtggagagaccccagctgagacaggacgtggtgaactggctgaacgaggagaagatcgtgcagagactgatcgagcagatccaccccagcaaggacgagaaccagcacagcaacgccagccagagcctgtgcgacatcatcagactgagcagagagcagatgatccaggtgcaggacagccccgagcccgaccagctgctggccaccctggagaagcaggagaccatcgagcagctgctgagcaacatgttcgagggcgagcagagccagagcgtgatcgtgagcggcatccaggtgctgctgaccctgctggagcccagaagacccagaagcgagagcgtgaccgtgaacagcttcttcagcagcgtggacggccagctggagctgctggcccagggcgccctggagagcaccgtgagcagcgtgggcgccctgcacgccctgagacccagactgagctgcttccaccagctgctgctggagccccccaagctggagcccctgcagatgacctggggcatgctggccccccccctgggcaacaccagactgcacgtggtgaagctgctggccagcgccctgagcgccaacgacgccgccctgacccacgagctgctggccctggacgtgcccaacaccatgctggacctgttcttccactacgtgttcaacaacttcctgcacgcccaggtggagggctgcgtgagcaccatgctgagcctgggccccccccccgacagcagccccgagacccccatccagaaccccgtggtgaagcacctgctgcagcagtgcagactggtggagagaatcctgaccagctgggaggagaacgacagagtgcagtgcgccggcggccccagaaagggctacatgggccacctgaccagagtggccggcgccctggtgcagaacaccgagaagggccccaacgccgagcagctgagacagctgctgaaggagctgcccagcgagcagcaggagcagtgggaggccttcgtgagcggccccctggccgagaccaacaagaagaacatggtggacctggtgaacacccaccacctgcacagcagcagcgacgacgaggacgacagactgaaggagttcaacttccccgaggaggccgtgctgcagcaggccttcatggacttccagatgcagagaatgaccagcgccttcatcgaccacttcggcttcaacgacgaggagttcggcgagcaggaggagagcgtgaacgcccccttcgacaagaccgccaacatcaccttcagcctgaacgccgacgacgagaaccccaacgccaacctgctggagatctgctacaaggacagaatccagcagttcgacgacgacgaggaggaggaggacgaggaggaggcccagggcagcggcgagagcgacggcgaggacggcgcctggcagggcagccagctggccagaggcgccagactgggccagccccccggcgtgagaagcggcggcagcaccgacagcgaggacgaggaggaggaggacgaggaggaggaggaggacgaggagggcatcggctgcgccgccagaggcggcgccacccccctgagctaccccagccccggcccccagccccccggccccagctggaccgccaccttcgaccccgtgcccaccgacgcccccaccagccccagagtgagcggcgaggaggagctgcacaccggcccccccgccccccagggccccctgagcgtgccccagggcctgcccacccagagcctggccagcccccccgccagagacgccctgcagctgagaagccaggaccccaccccccccagcgccccccaggaggccaccgagggcagcaaggtgaccgagcccagcgccccctgccaggccctggtgagcatcggcgacctgcaggccaccttccacggcatcagaagcgcccccagcagcagcgacagcgccaccagagaccccagcaccagcgtgcccgccagcggcgcccaccagcccccccagaccaccgagggcgagaagagccccgagcccctgggcctgccccagagccagagcgcccaggccctgacccccccccccatccccaacggcagcgcccccgagggccccgccagccccggcagccagtag

SEQ ID NO: 11767 - DNA, 354 bp, Artificial Sequence
  Description of Artificial Sequence: Synthetic coding sequence
atgaagttccagtacaaggaggtgcaccccttcgagtacagaaagaaggagggcgagaagatcagaaagaagtaccccgacagagtgcccctgatcgtggagaaggcccccaaggccagagtgcccgacctggacagaagaaagtacctggtgcccagcgacctgaccgacggccagttctacctgctgatcagaaagagaatccacctgagacccgaggacgccctgttcttcttcgtgaacaacaccatcccccccaccagcgccaccatgggccagctgtacgaggacagccacgaggaggacgacttcctgtacgtggcctacagcaacgagagcgtgtacggcaagtag

SEQ ID NO: 11768 - DNA, 1089 bp, Artificial Sequence
  Description of Artificial Sequence: Synthetic coding sequence
atgagagagatcgtgcacctgcaggccggccagtgcggcaaccagatcggcgccaagttctgggaggtgatcagcgacgagcacggcatcgaccccaccggcacctaccacggcgacagcgacctgcagctggagagaatcaacgtgtactacaacgaggccaccggcggcaactacgtgcccagagccgtgctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacgccgtgctggacgtggtgagaaaggaggccgagagctgcgactgcctgcagggcttccagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacgccaagaacatgatggccgcctgcgaccccagacacggcagatacctgaccgtggccgccgtgttcagaggcagaatgagcatgaaggaggtggacgagcagatgctgagcgtgcagagcaagaacagcagctacttcgtggagtggatccccaacaacgtgaagaccgccgtgtgcgacatcccccccagaggcctgaagatggccgccaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggagggcgagttcgaggaggaggccgaggaggaggtggcctag

SEQ ID NO: 11769 - DNA, 654 bp, Artificial Sequence
  Description of Artificial Sequence: Synthetic coding sequence
atggaggagaccatgaagctggccaccatggaggacaccgtggagtactgcctgttcctgatccccgacgagagcagagacagcgacaagcacaaggagatcctgcagaagtacatcgagagaatcatcaccagattcgcccccatgctggtgccctacatctggcagaaccagcccttcaacctgaagtacaagcccggcaagggcggcgtgcccgcccacatgttcggcgtgaccaagttcggcgacaacatcgaggacgagtggttcatcgtgtacgtgatcaagcagatcaccaaggagttccccgagctggtggccagcaccaacagagtgttcttctgccacggcgagctgtgcatcatccccgcccccagaaagagcggcgccgagagctggctgcccaccaccccccccaccatcccccaggccctgaacatcatcaccgcccacagcgagaagatcctggccagcgagagcatcagagccgccgtgaacagaagaatcagaggctaccccgagaagatccaggccagcctgcacagagcccactgcttcctgcccgccggcatcgtggccgtgctgaagcagagacccagactggtggccgccgccgtgcaggccttctacctgagagaccccatcgacctgtag

SEQ ID NO: 11770 - DNA, 1188 bp, Artificial Sequence; identical to SEQ ID NO: 11022
  Description of Artificial Sequence: Synthetic coding sequence

SEQ ID NO: 11771 - DNA, 102 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccactag

SEQ ID NO: 11772 - DNA, 1242 bp, Artificial Sequence
  Description of Artificial Sequence: Synthetic coding sequence
atgttcgccagcgacctgctgagagccctggactgctgccccggcgccggcagcagcggcctgctgccccagctgggccccagacagctgctggccttcaccgtgaactgcctgggcaaccacagatacctgggcttcttcgaggacctggagcagagacacaaggcccaggtgctggtggaggacatcagcgacatcctggaggagcacgccgagaagcacttccacccctacatcgcctactgcagcaacgaggtgtaccagcagagaaccctgcagaagctgatcagcagcaacgccgccttcagagaggccctgagagagatcgagagaagacccgcctgcggcggcctgcccatgctgagcttcctgatcctgcccatgcagagagtgaccagactgcccctgctgatggacaccctgtgcctgaagacccagggccacagcgagagatacaaggccgccagcagagccctgaaggccatcagcaagctggtgagacagtgcaacgagggcgcccacagaatggagagaatggagcagatgtacaccctgcacacccagctggacttcagcaaggtgaagagcctgcccctgatcagcgccagcagatggctgctgaagagaggcgagctgttcctggtggaggagaccggcctgttcagaaagatcgccagcagacccacctgctacctgttcctgttcaacgacgtgctggtggtgaccaagaagaagagcgaggagagctacatggtgcaggactacgcccagatgaaccacatccaggtggagaagatcgagcccagcgagctgcccctgcccggcggcggcaacagaagcagcagcgtgccccaccccttccaggtgaccctgctgagaaacagcgagggcagacaggagcagctgctgctgagcagcgacagcgccagcgacagagccagatggatcgtggccctgacccacagcgagagacagtggcagggcctgagcagcaagggcgacctgccccaggtggagatcaccaaggccttcttcgccaagcaggccgacgaggtgaccctgcagcaggccgacgtggtgctggtgctgcagcaggaggacggctggctgtacggcgagagactgagagacggcgagaccggctggttccccgaggacttcgccagattcatcaccagcagagtggccgtggagggcaacgtgagaagaatggagagactgagagtggagaccgacgtgtag

SEQ ID NO: 11773 - DNA, 1890 bp, Artificial Sequence
  Description of Artificial Sequence: Synthetic coding sequence
atggaggagagccccctgagcagagcccccagcagaggcggcgtgaacttcctgaacgtggccagaacctacatccccaacaccaaggtggagtgccactacaccctgccccccggcaccatgcccagcgccagcgactggatcggcatcttcaaggtggaggccgcctgcgtgagagactaccacaccttcgtgtggagcagcgtgcccgagagcaccaccgacggcagccccatccacaccagcgtgcagttccaggcctgcaaccagctggacgagagccagcaggagagaaacgacctgatgcagctgaagctgcagctggagggccaggtgaccgagctgagaagcagagtgcaggagctggagagagccctggccaccgccagacaggagcacaccgagctgatggagcagtacaagggcatcagcagaagccacggcgagatcaccgaggagagagacatcctgagcagacagcagggcgaccacgtggccagaatcctggagctggaggacgacatccagaccatcagcgagaaggtgctgaccaaggaggtggagctggacagactgagagacaccgtgaaggccctgaccagagagcaggagaagctgctgggccagctgaaggaggtgcaggccgacaaggagcagagcgaggccgagctgcaggtggcccagcaggagaaccaccacctgaacctggacctgaaggaggccaagagctggcaggaggagcagagcgcccaggcccagagactgaaggacaaggtggcccagatgaaggacaccctgggccaggcccagcagagagtggccgagctggagcccctgaaggagcagctgagaggcgcccaggagctggccgccagcagccagcagaaggccaccctgctgggcgaggagctggccagcgccgccgccgccagagacagaaccatcgccgagctgcacagaagcagactggaggtggccgaggtgaacggcagactggccgagctgggcctgcacctgaaggaggagaagtgccagtggagcaaggagagagccggcctgctgcagagcgtggaggccgagaaggacaagatcctgaagctgagcgccgagatcctgagactggagaaggccgtgcaggaggagagaacccagaaccaggtgttcaagaccgagctggccagagagaaggacagcagcctggtgcagctgagcgagagcaagagagagctgaccgagctgagaagcgccctgagagtgctgcagaaggagaaggagcagctgcaggaggagaagcaggagctgctggagtacatgagaaagctggaggccagactggagaaggtggccgacgagaagtggaacgaggacgccaccaccgaggacgaggaggccgccgtgggcctgagctgccccgccgccctgaccgacagcgaggacgagagccccgaggacatgagactgcccccctacggcctgtgcgagagaggcgaccccggcagcagccccgccggccccagagaggccagccccctggtggtgatcagccagcccgcccccatcagcccccacctgagcggccccgccgaggacagcagcagcgacagcgaggccgaggacgagaagagcgtgctgatggccgccgtgcagagcggcggcgaggaggccaacctgctgctgcccgagctgggcagcgccttctacgacatggccagcggcttcaccgtgggcaccctgagcgagaccagcaccggcggccccgccacccccacctggaaggagtgccccatctgcaaggagagattccccgccgagagcgacaaggacgccctggaggaccacatggacggccacttcttcttcagcacccaggaccccttcaccttcgagtag

SEQ ID NO: 11774 - DNA, 2451 bp, Artificial Sequence
  Description of Artificial Sequence: Synthetic coding sequence
atgcccctgagcagccccaacgccgccgccaccgccagcgacatggacaagaacagcggcagcaacagcagcagcgccagcagcggcagcagcaagggccagcagccccccagaagcgccagcgccggccccgccggcgagagcaagcccaagagcgacggcaagaacagcagcggcagcaagagatacaacagaaagagagagctgagctaccccaagaacgagagcttcaacaaccagagcagaagaagcagcagccagaagagcaagaccttcaacaagatgcccccccagagaggcggcggcagcagcaagctgttcagcagcagcttcaacggcggcagaagagacgaggtggccgaggcccagagagccgagttcagccccgcccagttcagcggccccaagaagatcaacctgaaccacctgctgaacttcaccttcgagcccagaggccagaccggccacttcgagggcagcggccacggcagctggggcaagagaaacaagtggggccacaagcccttcaacaaggagctgttcctgcaggccaactgccagttcgtggtgagcgaggaccaggactacaccgcccacttcgccgaccccgacaccctggtgaactgggacttcgtggagcaggtgagaatctgcagccacgaggtgcccagctgccccatctgcctgtacccccccaccgccgccaagatcaccagatgcggccacatcttctgctgggcctgcatcctgcactacctgagcctgagcgagaagacctggagcaagtgccccatctgctacagcagcgtgcacaagaaggacctgaagagcgtggtggccaccgagagccaccagtacgtggtgggcgacaccatcaccatgcagctgatgaagagagagaagggcgtgctggtggccctgcccaagagcaagtggatgaacgtggaccaccccatccacctgggcgacgagcagcacagccagtacagcaagctgctgctggccagcaaggagcaggtgctgcacagagtggtgctggaggagaaggtggccctggagcagcagctggccgaggagaagcacacccccgagagctgcttcatcgaggccgccatccaggagctgaagaccagagaggaggccctgagcggcctggccggcagcagaagagaggtgaccggcgtggtggccgccctggagcagctggtgctgatggcccccctggccaaggagagcgtgttccagcccagaaagagcctgctgcagcagggcgtgctggagtacctgagcgccttcgacgaggagaccaccgaggtgtgcagcctggacacccccagcagacccctggccctgcccctggtggaggaggaggaggccgtgagcgagcccgagcccgagggcctgcccgaggcctgcgacgacctggagctggccgacgacaacctgaaggagggcaccatctgcaccgagagcagccagcaggagcccatcaccaagagcggcttcaccagactgagcagcagcccctgctactacttctaccaggccgaggacggccagcacatgttcctgcaccccgtgaacgtgagatgcctggtgagagagtacggcagcctggagagaagccccgagaagatcagcgccaccgtggtggagatcgccggctacagcatgagcgaggacgtgagacagagacacagatacctgagccacctgcccctgacctgcgagttcagcatctgcgagctggccctgcagccccccgtggtgagcaaggagaccctggagatgttcagcgacgacatcgagaagagaaagagacagagacagaagaaggccagagaggagagaagaagagagagaagaatcgagatcgaggagaacaagaagcagggcaagtaccccgaggtgcacatccccctggagaacctgcagcagttccccgccttcaacagctacacctgcagcagcgacagcgccctgggccccaccagcaccgagggccacggcgccctgagcatcagccccctgagcagaagccccggcagccacgccgacttcctgctgacccccctgagccccaccgccagccagggcagccccagcttctgcgtgggcagcctggaggaggacagccccttccccagcttcgcccagatgctgagagtgggcaaggccaaggccgacgtgtggcccaagaccgcccccaagaaggacgagaacagcctggtgccccccgcccccgtggacagcgacggcgagagcgacaacagcgacagagtgcccgtgcccagcttccagaacagcttcagccaggccatcgaggccgccttcatgaagctggacacccccgccaccagcgaccccctgagcgaggagaagggcggcaagaagagaaagaagcagaagcagaagctgctgttcagcaccagcgtggtgcacaccaagtag

SEQ ID NO: 11775 - DNA, 429 bp, Artificial Sequence
  Description of Artificial Sequence: Synthetic coding sequence
atggccagccccggcaaggacaactacagaatgaagagctacaagaacaaggccctgaacccccaggagatgagaagaagaagagaggaggagggcatccagctgagaaagcagaagagagaggagcagctgttcaagagaagaaacgtgtacctgcccagaaacgacgagagcatgctggagagccccatccaggaccccgacatcagcagcaccgtgcccatccccgaggaggaggtggtgaccaccgacatggtgcagatgatcttcagcaacaacgccgaccagcagctgaccgccacccagaagttcagaaagctgctgagcaaggagcccaacccccccatcgaccaggtgatccagaagcccggcgtggtgcagagattcgtgaagttcctggagagaaacgagaactgcaccctgcagtag

SEQ ID NO: 11776 - DNA, 297 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagagcctggacgaggaggagaagctggagctgcagagaagactggaggcccagaaccaggagagaagaaagagcaagagcggcgccggcaagggcaagctgaccagaagcctggccgtgtgcgaggagagcagcgccagacccggcggcgagagcctgcaggaccaggagagcatccacctgcagctgagcagcttcagctag

SEQ ID NO: 11777 - DNA, 1917 bp, Artificial Sequence
  Description of Artificial Sequence: Synthetic coding sequence
atggagaacctgcagaccaacttcagcctggtgcagggcagcaccaagaagctgaacggcatgggcgacgacggcagcccccccgccaagaagatgatcaccgacatccacgccaacggcaagaccatcaacaaggtgcccaccgtgaagaaggagcacctggacgactacggcgaggcccccgtggagaccgacggcgagcacgtgaagagaacctgcaccagcgtgcccgagaccctgcacctgaaccccagcctgaagcacaccctggcccagttccacctgagcagccagagcagcctgggcggccccgccgccttcagcgccagacacagccaggagagcatgagccccaccgtgttcctgcccctgcccagcccccaggtgctgcccggccccctgctgatccccagcgacagcagcaccgagctgacccagaccgtgctggagggcgagagcatcagctgcttccaggtgggcggcgagaagagactgtgcctgccccaggtgctgaacagcgtgctgagagagttcaccctgcagcagatcaacaccgtgtgcgacgagctgtacatctactgcagcagatgcaccagcgaccagctgcacatcctgaaggtgctgggcatcctgcccttcaacgcccccagctgcggcctgatcaccctgaccgacgcccagagactgtgcaacgccctgctgagacccagaaccttcccccagaacggcagcgtgctgcccgccaagagcagcctggcccagctgaaggagaccggcagcgccttcgaggtggagcacgagtgcctgggcaagtgccagggcctgttcgccccccagttctacgtgcagcccgacgccccctgcatccagtgcctggagtgctgcggcatgttcgccccccagaccttcgtgatgcacagccacagaagccccgacaagagaacctgccactggggcttcgagagcgccaagtggcactgctacctgcacgtgaaccagaagtacctgggcacccccgaggagaagaagctgaagatcatcctggaggagatgaaggagaagttcagcatgagaagcggcaagagaaaccagagcaagaccgacgcccccagcggcatggagctgcagagctggtaccccgtgatcaagcaggagggcgaccacgtgagccagacccacagcttcctgcaccccagctactacctgtacatgtgcgacaaggtggtggcccccaacgtgagcctgaccagcgccgtgagccagagcaaggagctgaccaagaccgaggccaacgccagcatcagcaacaacagcaccagcaagagaaagagcgagagcgccacctgcaacctggtgagagacatcaacaaggtgggcatcggcctggtggccgccgccagcagccccctgctggtgaaggacgtgatctgcgaggacgacaagggcaagatcatggaggaggtgatgagaacctacctgaagcagcaggagaagctgaacctgatcctgcagaagaagcagcagctgcagatggaggtgaagatgctgagcagcagcaagagcatgaaggagctgaccgaggagcagcagaacctgcagaaggagctggagagcctgcagaacgagcacgcccagagaatggaggagttctacgtggagcagaaggacctggagaagaagctggagcagatcatgaagcagaagtgcacctgcgacagcaacctggagaaggacaaggaggccgagtacgccggccagctggccgagctgagacagagactggaccacgccgaggccgacagacaggagctgcaggacgagctgagacaggagagagaggccagacagaagctggagatgatgatcaaggagctgaagctgcagatcctgaagagcagcaagaccgccaaggagtag

SEQ ID NO: 11778 - DNA, 1530 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtggacatcagaaccctggccgacagcgtgtgcagatacgacctgaacgacatggacgccgcctggctggagctgaccaacgaggagttcaaggagatgggcatgcccgagctggacgagtacaccatggagagagtgctggaggagttcgagcagagatgctacgacaacatgaaccacgccatcgagaccgaggagggcctgggcatcgagtacgacgaggacgtggtgtgcgacgtgtgccagagccccgacggcgaggacggcaacgagatggtgttctgcgacaagtgcaacatctgcgtgcaccaggcctgctacggcatcctgaaggtgcccgagggcagctggctgtgcagaacctgcgccctgggcgtgcagcccaagtgcctgctgtgccccaagaagggcggcgccatgaagcccaccagaagcggcaccaagtgggtgcacgtgagctgcgccctgtggatccccgaggtgagcatcggcagccccgagaagatggagcccatcaccaaggtgagccacatccccagcagcagatgggccctggtgtgcagcctgtgcaacgagaagttcggcgccagcatccagtgcagcgtgaagaactgcagaaccgccttccacgtgacctgcgccttcgacagaggcctggagatgaagaccatcctggccgagaacgacgaggtgaagttcaagagctactgccccaagcacagcagccacagaaagcccgaggagagcctgggcaagggcgccgcccaggagaacggcgcccccgagtgcagccccagaaaccccctggagcccttcgccagcctggagcagaacagagaggaggcccacagagtgagcgtgagaaagcagaagctgcagcagctggaggacgagttctacaccttcgtgaacctgctggacgtggccagagccctgagactgcccgaggaggtggtggacttcctgtaccagtactggaagctgaagagaaaggtgaacttcaacaagcccctgatcacccccaagaaggacgaggaggacaacctggccaagagagagcaggacgtgctgttcagaagactgcagctgttcacccacctgagacaggacctggagagagtgatgatcgacaccgacaccctgtag

SEQ ID NO: 11779 - DNA, 354 bp, Artificial Sequence
  Description of Artificial Sequence: Synthetic coding sequence
atggccttcagcggcagagccagaccctgcatcatccccgagaacgaggagatccccagagccgccctgaacaccgtgcacgaggccaacggcaccgaggacgagagagccgtgagcaagctgcagagaagacacagcgacgtgaaggtgtacaaggagttctgcgacttctacgccaagttcaacatggccaacgccctggccagcgccacctgcgagagatgcaagggcggcttcgcccccgccgagaccatcgtgaacagcaacggcgagctgtaccacgagcagtgcttcgtgtgcgcccagtgcttccagcagttccccgagggcctgttctacgaggagagaacctag

SEQ ID NO: 11780 - DNA, 1110 bp, Artificial Sequence
  Description of Artificial Sequence: Synthetic coding sequence
atgaaggacacccaggacatccaggaggccagcaaggccatgcagaacaaggtgcacgagcaggaggacaagaacgagaagcagaagcagagagaggacaagctgggcgtgtacagcctggtgcacttcagccccaagatgctgggcagcgtggccaccaccctgcccctgagcagcagcaacagcagcggcatgcccctgggctactacctgagcagcccccagatcagcagagtgaccatcagcaccaccggccagctgaccagcaaggccaccgtgggcagctgcagcagagtggagaacagcctggacgccagccccttcagcgtgcccaagaagcaggacgagagccccatgatcggcgacggcgaggactacttcctgagcctgttcggcgacagcaagaagctgaccgcccacagcaactacacccagaagaccctgaagtacttcagcatgatcctggaggaggtgggccagttcaccagcagcagcctgggcgacgtggagatcgccgaggtgaacgtgaagggcctgttcgtgaagctgatcaacagcagcctggacaaggagatggccatcggcgaccacatcctgcagcagaacgtgaacggccagaccatcagcctgtacagattcctgcccaacatcgtgatgcaggccaacagcaccgtgaccgccatcgcctggtacacccccatccactggaagcaggcctgggagaagctggacgccgacgtggagttcaacagatgcagcgtggtgagccccaccttcagaaagagagtgttccagtggaccgccagcaccgccaccatcaccaaggagaagcaggaccagcccaagaaggacatcagcaactaccaggtggagcaggcccaggtgctgctgaagagagagaaggagatcccccccaccgtgttccccaacagaagcccctggtgccagaacccctacgtgagcgcccacccctactgccccctgatcgagccccacaacaccagcaccgccggcggcagactggacagacagcccagaaccagaagcaccagacccaacagagccagcggcagcaagaagaagaagaccagcgagagccagaagcagtag

SEQ ID NO: 11781 - DNA, 681 bp, Artificial Sequence
  Description of Artificial Sequence: Synthetic coding sequence
atggaccagagcagagtgctgctgtgggtgaaggccgagcccttcatcgtgggcgccctgcaggtgcccccccccagcaagttcagcctgcactacctgagaaagatcagcacctacgtgcagatcagagccaccgagggcgcctaccccagactgtactggagcacctggagacacatcgcctgcggcaagctgcagctggccaaggacctggcctggctgtacttcgagatcttcgacagcctgagcatgaagacccccgaggagagactggagtggagcgaggtgctgagcaactgcatgagcgaggaggaggtggagaagcagagaaaccagctgagcgtggacaccctgcagttcctgctgttcctgtacatccagcagctgaacaaggtgagcctgagaaccagcctgatcggcgaggagtggcccagccccagaaacaagagccagagccccgacctgaccgagaagagcaactgccacaacaagaactggaacgactacagccaccaggccttcgtgtacgaccacctgagcgacctgctggagctgctgctggaccccaagcagctgaccgccagcttccacagcacccacagcagcctggtgagcagagaggccgtggtggccctgagcttcctgatcgagggcaccatcagcagagccagaaagatctag

SEQ ID NO: 11782 - DNA, 747 bp, Artificial Sequence
  Description of Artificial Sequence: Synthetic coding sequence
atgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgacctgctgctggccagcggcctgcccgacctgaacggcgtgggccccagaggcctgctggtggacaacatgctgtggagcagactggtggtgagcttcgccagccacggccagggcctggcccccctggtggcccacgtggccagcgtggtgtggacctggtggctgctgcaccccaccgtggccagcgtggtgtggacctggtggctgctgcaccccacccagggcaacagcgtgctgctgcaccccaccgactgctgggagagagccagcggcaccttcctgtggggcatcatcctgttctgcctgagctag

SEQ ID NO: 11783 - DNA, 1869 bp, Artificial Sequence; identical to SEQ ID NO: 9991
  Description of Artificial Sequence: Synthetic coding sequence

SEQ ID NO: 11784 - DNA, 4008 bp, Artificial Sequence
  Description of Artificial Sequence: Synthetic coding sequence
atggaggagatccccgtgaaggtggccgtgagaatcagacccctgctgtgcaaggaggccctgcacaaccaccaggtgtgcgtgagagtgatccccaacagccagcaggtgatcatcggcagagacagagtgttcaccttcgacttcgtgttcggcaagaacagcacccaggacgaggtgtacaacacctgcatcaagcccctggtgctgagcctgatcgagggctacaacgccaccgtgttcgcctacggccagaccggcagcggcaagacctacaccatcggcggcggccacatcgccagcgtggtggagggccagaagggcatcatccccagagccatccaggagatcttccagagcatcagcgagcaccccagcatcgacttcaacgtgaaggtgagctacatcgaggtgtacaaggaggacctgagagacctgctggagctggagaccagcatgaaggacctgcacatcagagaggacgagaagggcaacaccgtgatcgtgggcgccaaggagtgccacgtggagagcgccggcgaggtgatgagcctgctggagatgggcaacgccgccagacacaccggcaccacccagatgaacgagcacagcagcagaagccacgccatcttcaccatcagcatctgccaggtgcacaagaacatggaggccgccgaggacggcagctggtacagccccagacacatcgtgagcaagttccacttcgtggacctggccggcagcgagagagtgaccaagaccggcaacaccggcgagagattcaaggagagcatccagatcaacagcggcctgctggccctgggcaacgtgatcagcgccctgggcgaccccagaagaaagagcagccacatcccctacagagacgccaagatcaccagactgctgaaggacagcctgggcggcagcgccaagaccgtgatgatcacctgcgtgagccccagcagcagcaacttcgacgagagcctgaacagcctgaagtacgccaacagagccagaaacatcagaaacaagcccaccgtgaacttcagccccgagagcgacagaatcgacgagatggagttcgagatcaagctgctgagagaggccctgcagagccagcaggccggcgtgagccagaccacccagatcaacagagagggcagccccgacaccaacagaatccacagcctggaggagcaggtggcccagctgcagggcgagtgcctgggctaccagtgctgcgtggaggaggccttcaccttcctggtggacctgaaggacaccgtgagactgaacgagaagcagcagcacaagctgcaggagtggttcaacatgatccaggaggtgagaaaggccgtgctgaccagcttcagaggcatcggcggcaccgccagcctggaggagggcccccagcacgtgaccgtgctgcagctgaagagagagctgaagaagtgccagtgcgtgctggccgccgacgaggtggtgttcaaccagaaggagctggaggtgaaggagctgaagaaccaggtgcagatgatggtgcaggagaacaagggccacgccgtgagcctgaaggaggcccagaaggtgaacagactgcagaacgagaagatcatcgagcagcagctgctggtggaccagctgagcgaggagctgaccaagctgaacctgagcgtgaccagcagcgccaaggagaactgcggcgacggccccgacgccagaatccccgagagaagaccctacaccgtgcccttcgacacccacctgggccactacatctacatccccagcagacaggacagcagaaaggtgcacaccagcccccccatgtacagcctggacagaatcttcgccggcttcagaaccagaagccagatgctgctgggccacatcgaggagcaggacaaggtgctgcactgccagttcagcgacaacagcgacgacgaggagagcgagggccaggagaagagcggcaccagatgcagaagcagaagctggatccagaagcccgacagcgtgtgcagcctggtggagctgagcgacacccaggacgagacccagaagagcgacctggagaacgaggacctgaagatcgactgcctgcaggagagccaggagctgaacctgcagaagctgaagaacagcgagagaatcctgaccgaggccaagcagaagatgagagagctgaccatcaacatcaagatgaaggaggacctgatcaaggagctgatcaagaccggcaacgacgccaagagcgtgagcaagcagtacagcctgaaggtgaccaagctggagcacgacgccgagcaggccaaggtggagctgatcgagacccagaagcagctgcaggagctggagaacaaggacctgagcgacgtggccatgaaggtgaagctgcagaaggagttcagaaagaagatggacgccgccaagctgagagtgcaggagatccagctgaagaccggccaggaggagggcctgaagcccaaggccgaggacctggacgcctgcaacctgaagagaagaaagggcagcttcggcagcatcgaccacctgcagaagctggacgagcagaagaagtggctggacgaggaggtggagaaggtgctgaaccagagacaggagctggaggagctggaggccgacctgaagaagagagaggccatcgtgagcaagaaggaggccctgctgcaggagaagagccacctggagaacaagaagctgagaagcagccaggccctgaacaccgacagcctgaagatcagcaccagactgaacctgctggagcaggagctgagcgagaagaacgtgcagctgcagaccagcaccgccgaggagaagaccaagatcagcgagcaggtggaggtgctgcagaaggagaaggaccagctgcagaagagaagacacaacgtggacgagaagctgaagaacggcagagtgctgagccccgaggaggagcacgtgctgttccagctggaggagggcatcgaggccctggaggccgccatcgagtacagaaacgagagcatccagaacagacagaagagcctgagagccagcttccacaacctgagcagaggcgaggccaacgtgctggagaagctggcctgcctgagccccgtggagatcagaaccatcctgttcagatacttcaacaaggtggtgaacctgagagaggccgagagaaagcagcagctgtacaacgaggagatgaagatgaaggtgctggagagagacaacatggtgagagagctggagagcgccctggaccacctgaagctgcagtgcgacagaagactgaccctgcagcagaaggagcacgagcagaagatgcagctgctgctgcaccacttcaaggagcaggacggcgagggcatcatggagaccttcaagacctacgaggacaagatccagcagctggagaaggacctgtacttctacaagaagaccagcagagaccacaagaagaagctgaaggagctggtgggcgaggccatcagaagacagctggcccccagcgagtaccaggaggccggcgacggcgtgctgaagcccgagggcggcggcatgctgagcgaggagctgaagtgggccagcagacccgagagcatgaagctgagcggcagagagagagagatggacagcagcgccagcagcctgagaacccagcccaacccccagaagctgtgggaggacatccccgagctgccccccatccacagcagcctggccccccccagcggccacatgctgggcaacgagaacaagaccgagaccgacgacaaccagttcaccaagagccacagcagactgagcagccagatccaggtggtgggcaacgtgggcagactgcacggcgtgacccccgtgaagctgtgcagaaaggagctgagacagatcagcgccctggagctgagcctgagaagaagcagcctgggcgtgggcatcggcagcatggccgccgacagcatcgaggtgagcagaaagcccagagacctgaagacctag

SEQ ID NO: 11785 - DNA, 2745 bp, Artificial Sequence
  Description of Artificial Sequence: Synthetic coding sequence
atggaggagagaatcaccaccctggagaagagatacctggccgcccagagagaggccaccagcatccacgacctgaacgacaagctggagaacgagctggccaacaaggagagcctgcacagacagtgcgaggagaaggccagacacctgcaggagctgctggaggtggccgagcagaagctgcagcagaccatgagaaaggccgagaccctgcccgaggtggaggccgagctggcccagagaatcgccgccctgaccaaggccgaggagagacacggcaacatcgaggagcacctgagacagctggagggccagctggaggagaagaaccaggagctggccagagtgagacagagagagaagatgaacgaggaccacaacaagagactgagcgacaccgtggacagactgctgagcgagagcaacgagagactgcagctgcacctgaaggagagaatggccgccctggaggagaagaacaccctgatccaggagctggagagcagccagagacagatcgaggagcagcaccaccacaagggcagactgagcgaggagatcgagaagctgagacaggaggtggaccagctgaagggcagaggcggccccttcgtggacggcgtgcacagcagaagccacatgggcagcgccgccgacgtgagattcagcctgggcaccaccacccacgccccccccggcgtgcacagaagatacagcgccctgagagaggagagcgccaaggactgggagaccagccccctgcccggcatgctggcccccgccgccggccccgccttcgacagcgaccccgagatcagcgacgtggacgaggacgagcccggcggcctggtgggcagcgccgacgtggtgagccccagcggccacagcgacgcccagaccctggccatgatgctgcaggagcagctggacgccatcaacgaggagatcagaatgatccaggaggagaaggagagcaccgagctgagagccgaggagatcgagaccagagtgaccagcggcagcatggaggccctgaacctgaagcagctgagaaagagaggcagcatccccaccagcctgaccgccctgagcctggccagcgccagcccccccctgagcggcagaagcacccccaagctgaccagcagaagcgccgcccaggacctggacagaatgggcgtgatgaccctgcccagcgacctgagaaagcacagaagaaagctgctgagccccgtgagcagagaggagaacagagaggacaaggccaccatcaagtgcgagaccagcccccccagcagccccagaaccctgagactggagaagctgggccaccccgccctgagccaggaggagggcaagagcgccctggaggaccagggcagcaaccccagcagcagcaacagcagccaggacagcctgcacaagggcgccaagagaaagggcatcaagagcagcatcggcagactgttcggcaagaaggagaagggcagactgatccagctgagcagagacggcgccaccggccacgtgctgctgaccgacagcgagttcagcatgcaggagcccatggtgcccgccaagctgggcacccaggccgagaaggacagaagactgaagaagaagcaccagctgctggaggacgccagaagaaagggcatgcccttcgcccagtgggacggccccaccgtggtgagctggctggagctgtgggtgggcatgcccgcctggtacgtggccgcctgcagagccaacgtgaagagcggcgccatcatgagcgccctgagcgacaccgagatccagagagagatcggcatcagcaacgccctgcacagactgaagctgagactggccatccaggagatggtgagcctgaccagccccagcgccccccccaccagcagaaccagcagcggcaacgtgtgggtgacccacgaggagatggagaccctggagaccagcaccaagaccgacagcgaggagggcagctgggcccagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagaagagaagagaggagagccagcacgagatcaaggacgtgctggtgtggaccaacgaccaggtggtgcactgggtgcagagcatcggcctgagagactacgccggcaacctgcacgagagcggcgtgcacggcgccctgctggccctggacgagaacttcgaccacaacaccctggccctgatcctgcagatccccacccagaacacccaggccagacaggtgatggagagagagttcaacaacctgctggccctgggcaccgacagaaagctggacgacggcgacgacaaggtgttcagaagagcccccagctggagaaagagattcagacccagagagcaccacggcagaggcggcatgctgagcgccagcgccgagaccctgcccgccggcttcagagtgagcaccctgggcaccctgcagcccccccccgccccccccaagaagatcatgcccgaggcccacagccactacctgtacggccacatgctgagcgccttcagagactag

SEQ ID NO: 11786 - DNA, 1494 bp, Artificial Sequence
  Description of Artificial Sequence: Synthetic coding sequence
gacgtgggcggcgacagaccctgggacagcggcaacacccagctgccccccagaaaccccgtgaaggccaacgccatgttcggcgccggcgacgaggacgacaccgacttcctgagccccagcggcggcgccagactggccagcctgttcggcctggaccaggccgccgccggccacggcaacgagttcttccagtacaccgcccccaagcagcccaagaagggccagggcaccgccgccaccggcaaccaggccacccccaagaccgcccccgccaccatgagcacccccaccatcctggtggccaccgccgtgcacgcctacagatacaccaacggccagtacgtgaagcagggcaagttcggcgccgccgtgctgggcaaccacaccgccagagagtacagaatcctgctgtacatcagccagcagcagcccgtgaccgtggccagaatccacgtgaacttcgagctgatggtgagacccaacaactacagcaccttctacgacgaccagagacagaactggagcatcatgttcgagagcgagaaggccgccgtggagttcaacaagcaggtgtgcatcgccaagtgcaacagcaccagcagcctggacgccgtgctgagccaggacctgatcgtggccgacggccccgccgtggaggtgggcgacagcctggaggtggcctacaccggctggctgttccagaaccacgtgctgggccaggtgttcgacagcaccgccaacaaggacaagctgctgagactgaagctgggcagcggcaaggtgatcaagggctgggaggacggcatgctgggcatgaagaagggcggcaagagactgctgatcgtgccccccgcctgcgccgtgggcagcgagggcgtgatcggctggacccaggccaccgacagcatcctggtgttcgaggtggaggtgagaagagtgaagttcgccagagacagcggcagcgacggccacagcgtgagcagcagagacagcgccgcccccagccccatccccggcgccgacaacctgagcgccgaccccgtggtgagcccccccaccagcatccccttcaagagcggcgagcccgccctgagaaccaagagcaacagcctgagcgagcagctggccatcaacaccagccccgacgccgtgaaggccaagctgatcagcagaatggccaagatgggccagcccatgctgcccatcctgcccccccagctggacagcaacgacagcgagatcgaggacgtgaacaccctgcagggcggcggccagcccgtggtgacccccagcgtgcagcccagcctgcaccccgcccaccccgccctgccccagatgaccagccaggccccccagcccagcgtgaccggcctgcaggcccccagcgccgccctgatgcaggtgagcagcctggacagccacagcgccgtgagcggcaacgcccagagcttccaggtgaccttctacaacagaatcaactacatcctgtag

SEQ ID NO: 11787 - DNA, 462 bp, Artificial Sequence
  Description of Artificial Sequence: Synthetic coding sequence
atgaacctggccgagatctgcgacaacgccaagaagggcagagagtacgccctgctgggcaactacgacagcagcatggtgtactaccagggcgtgatgcagcagatccagagacactgccagagcgtgagagaccccgccatcaagggcaagtggcagcaggtgagacaggagctgctggaggagtacgagcaggtgaagagcatcgtgagcaccctggagagcttcaagatcgacaagccccccgacttccccgtgagctgccaggacgagcccttcagagaccccgccgtgtggcccccccccgtgcccgccgagcacagagcccccccccagatcagaagacccaacagagaggtgagacccctgagaaaggagatggccggcgtgggcgccagaggccccgtgggcagagcccaccccatcagcaagagcgagaagcccagcaccagcagagactag

SEQ ID NO: 11788 - DNA, 627 bp, Artificial Sequence
  Description of Artificial Sequence: Synthetic coding sequence
atgttccaggtgcccgacagcgagggcggcagagccggcagcagagccatgaagccccccggcggcgagagcagcaacctgttcggcagccccgaggaggccacccccagcagcagacccaacagaatggccagcaacatcttcggccccaccgaggagccccagaacatccccaagagaaccaacccccccggcggcaagggcagcggcatcttcgacgagagcacccccgtgcagaccagacagcacctgaacccccccggcggcaagaccagcgacatcttcggcagccccgtgaccgccaccagcagactggcccaccccaacaagcccaccagaaacagcagagacagagtggccatgttcagcttccccttcgcccagatgagcggcgtgggcagaggcctggtgctgtgcgagcccggctgcagcgccagccccggcagacacgacagctgcctggagaccagagccttccagatggccggcagatgcctgtgcggcgacgagatgggccacccctggcccagcctgatgtgcagccccggcctgagaggcaccggcagaggcgtgagagtgggcagatggggcagagcctggagcctggaccagcagcccgccagctag

SEQ ID NO: 11789 - DNA, 591 bp, Artificial Sequence
  Description of Artificial Sequence: Synthetic coding sequence
atgcccttcagcaaggagaagtacatcctggacagcagccccgagaagctgcacaaggagctggaggaggagctgaagctgagcagcaccgacctgagaagccacgcctggtaccacggcagaatccccagagaggtgagcgagaccctggtgcagagaaacggcgacttcctgatcagagacagcctgaccagcctgggcgactacgtgctgacctgcagatggagaaaccaggccctgcacttcaagatcaacaaggtggtggtgaaggccggcgagagctacacccacatccagtacctgttcgagcaggagagcttcgaccacgtgcccgccctggtgagataccacgtgggcagcagaaaggccgtgagcgagcagagcggcgccatcatctactgccccgtgaacagaaccttccccctgagatacctggaggccagctacggcctgggccagggcagcagcaagcccgccagccccgtgagccccagcggccccaagggcagccacatgaagagaagaagcgtgaccatgaccgacggcctgaccgccgacaaggtgaccagaagcgacggctgccccacctag

SEQ ID NO: 11790 - DNA, 1986 bp, Artificial Sequence
  Description of Artificial Sequence: Synthetic coding sequence
atgcaggccaacggcgccggcggcggcggcggcggcggcggcggcggcggcggcggcggcggcggcggcggcggccagggccagacccccgagctggcctgcctgagcgcccagaacggcgagagcagccccagcagcagcagcagcgccggcgacctggcccacgccaacggcctgctgcccagcgcccccagcgccgccagcaacaacagcaacagcctgaacgtgaacaacggcgtgcccggcggcgccgccgccgccagcagcgccaccgtggccgccgccagcgccaccaccgccgccagcagcagcctggccacccccgagctgggcagcagcctgaagaagaagaagagactgagccagagcgacgaggacgtgatcagactgatcggccagcacctgaacggcctgggcctgaaccagaccgtggacctgctgatgcaggagagcggctgcagactggagcaccccagcgccaccaagttcagaaaccacgtgatggagggcgactgggacaaggccgagaacgacctgaacgagctgaagcccctggtgcacagcccccacgccatcgtggtgagaggcgccctggagatcagccagaccctgctgggcatcatcgtgagaatgaagttcctgctgctgcagcagaagtacctggagtacctggaggacggcaaggtgctggaggccctgcaggtgctgagatgcgagctgacccccctgaagtacaacaccgagagaatccacgtgctgagcggctacctgatgtgcagccacgccgaggacctgagagccaaggccgagtgggagggcaagggcaccgccagcagaagcaagctgctggacaagctgcagacctacctgccccccagcgtgatgctgccccccagaagactgcagaccctgctgagacaggccgtggagctgcagagagacagatgcctgtaccacaacaccaagctggacaacaacctggacagcgtgagcctgctgatcgaccacgtgtgcagcagaagacagttcccctgctacacccagcagatcctgaccgagcactgcaacgaggtgtggttctgcaagttcagcaacgacggcaccaagctggccaccggcagcaaggacaccaccgtgatcatctggcaggtggaccccgacacccacctgctgaagctgctgaagaccctggagggccacgcctacggcgtgagctacatcgcctggagccccgacgacaactacctggtggcctgcggccccgacgactgcagcgagctgtggctgtggaacgtgcagaccggcgagctgagaaccaagatgagccagagccacgaggacagcctgaccagcgtggcctggaaccccgacggcaagagattcgtgaccggcggccagagaggccagttctaccagtgcgacctggacggcaacctgctggacagctgggagggcgtgagagtgcagtgcctgtggtgcctgagcgacggcaagaccgtgctggccagcgacacccaccagagaatcagaggctacaacttcgaggacctgaccgacagaaacatcgtgcaggaggaccaccccatcatgagcttcaccatcagcaagaacggcagactggccctgctgaacgtggccacccagggcgtgcacctgtgggacctgcaggacagagtgctggtgagaaagtaccagggcgtgacccagggcttctacaccatccacagctgcttcggcggccacaacgaggacttcatcgccagcggcagcgaggaccacaaggtgtacatctggcacaagagaagcgagctgcccatcgccgagctgaccggccacaccagaaccgtgaactgcgtgagctggaacccccagatccccagcatgatggccagcgccagcgacgacggcaccgtgagaatctggggccccgcccccttcatcgaccaccagaacatcgaggaggagtgcagcagcatggacagctag

SEQ ID NO: 11791 - DNA, 1113 bp, Artificial Sequence
  Description of Artificial Sequence: Synthetic coding sequence
atggagaagaagaagatggtgacccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcagcctgcccctggtgcccggcttcccctaccccaccgccgccaccaccgccgccgccttcagaggcgcccacctgagaggcagaggcagaaccgtgtacggcgccgtgagagccgtgccccccaccgccatccccgcctaccccggcgtggacatgcagcccaccgacatgcacagcctgctgctgcagccccagccccccctgctgcagcccctgcagcccctgaccgtgaccgtgatggccggctgcacccagcccacccccaccatgcccctgcccctgcccctggccatggagctggccctgtggagagtgtacaccgaggtggccaccgccgacctgccccccaccgaggtgacctag

SEQ ID NO: 11792 - DNA, 348 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctag

SEQ ID NO: 11793 - DNA, 3039 bp, Artificial Sequence
  Description of Artificial Sequence: Synthetic coding sequence
atgctgctgaagagcatcttcatcgtgtacatcttcttctacagcatcagcgagctgagcctggacagcaccctgcacgccgtgaacctgcactgcaacaacatcagcaagatcgaggccatcgaccacatctggaacctgcagcacctggacctgagcagcaaccagatcagcagaatcgagggcctgaacaccctgaccaagctgtgcaccctgaacctgagctgcaacctgatcaccaaggtggagggcctggaggagctgatcaacctgaccagactgaacgtgagctacaaccacatcgacgacctgagcggcctgatccccctgcacggcatcaagcacaagctgagatacatcgacctgcacagcaacagaatcgacagcatccaccacctgctgcagtgcatggtgggcctgcacttcctgaccaacctgatcctggagaaggacggcgacgacaaccccgtgtgcagactgcccggctacagagccgtgatcctgcagaccctgccccagctgagaatcctggactgcaagaacatcttcggcgagcccgtgaacctgaccgagatcaacagcagccagctgcagtgcctggagggcctgctggacaacctggtgagcagcgacagccccctgaacatcagcgaggacgagatcatcgacagaatgcccgtgatcaccgcccccatcgacgagctggtgcccctggagcagttcgccagcacccccagcgacgccgtgctgaccagcttcatgagcgtgtgccagagcagcgagcccgagaagaacaaccacgagaacgacctgcagaacgagatcaagctgcagaagctggacgaccagatcctgcagctgctgaacgagaccagcaacagcatcgacaacgtgctggagaaggaccccagacccaagagagacaccgacatcaccagcgagagcgactacggcaacagaaaggagtgcaacagaaaggtgcccagaagaagcaagatcccctacgacgccaagaccatccagaccatcaagcaccacaacaagaactacaacagcttcgtgagctgcaacagaaagatgaagcccccctacctgaaggagctgtacgtgagcagcagcctggccaactgccccatgctgcaggagagcgagaagcccaagaccgagatcatcaaggtggaccagagccacagcgaggacaacacctaccagagcctggtggagcagctggaccaggagagagagaagagatggagagccgagcaggccgagaacaagctgatggactacatcgacgagctgcacaagcacgccaacgagaaggaggacatccacagcctggccctgctgaccaccgacagactgaaggagatcatcttcagagagagaaacagcaagggccagctggaggtgatggtgcacaagctgcagaacgagatcaagaagctgaccgtggagctgatgaaggccaaggaccagcaggaggaccacctgaagcacctgagaaccctggagaagaccctggagaagatggagagacagaagagacagcagcaggccgcccagatcagactgatccaggaggtggagctgaaggccagcgccgccgacagagagatctacctgctgagaaccagcctgcacagagagagagagcaggcccagcagctgcaccagctgctggccctgaaggagcaggagcacagaaaggagctggagaccagagagttcttcaccgacgccgacttccaggacgccctggccaaggagatcgccaaggaggagaagaagcacgagcagatgatcaaggagtaccaggagaagatcgacgtgctgagccagcagtacatggacctggagaacgagttcagaatcgccctgaccgtggaggccagaagattccaggacgtgaaggacggcttcgagaacgtggccaccgagctggccaagagcaagcacgccctgatctgggcccagagaaaggagaacgagagcagcagcctgatcaaggacctgacctgcatggtgaaggagcagaagaccaagctggccgaggtgagcaagctgaagcaggagaccgccgccaacctgcagaaccagatcaacaccctggagatcctgatcgaggacgacaagcagaagagcatccagatcgagctgctgaagcacgagaaggtgcagctgatcagcgagctggccgccaaggagagcctgatcttcggcctgagaaccgagagaaaggtgtggggccacgagctggcccagcagggcagcagcctggcccagaacagaggcaagctggaggcccagatcgagagcctgagcagagagaacgagtgcctgagaaagaccaacgagagcgacagcgacgccctgagaatcaagtgcaagatcatcgacgaccagaccgagaccatcagaaagctgaaggactgcctgcaggagaaggacgagcacatcaagagactgcaggagaagatcaccgagatcgagaagtgcacccaggagcagctggacgagaagagcagccagctggacgaggtgctggagaagctggagagacacaacgagagaaaggagaagctgaagcagcagctgaagggcaaggaggtggagctggaggagatcagaaaggcctacagcaccctgaacagaaagtggcacgacaagggcgagctgctgtgccacctggagacccaggtgaaggaggtgaaggagaagttcgagaacaaggagaagaagctgaaggccgagagagacaagagcatcgagctgcagaagaacgccatggagaagctgcacagcatggacgacgccttcaagagacaggtggacgccatcgtggaggcccaccaggccgagatcgcccagctggccaacgagaagcagaagtgcatcgacagcgccaacctgaaggtgcaccagatcgagaaggagatgagagagctgctggaggagacctgcaagaacaagaagaccatggaggccaagatcaagcagctggccttcgccctgaacgagatccagcaggacatgtag

SEQ ID NO: 11794 - DNA, 4665 bp, Artificial Sequence
  Description of Artificial Sequence: Synthetic coding sequence
atgagcgccaccagctggttcctggtgagcagcagcggcgccagacacagactgcccagagagctgatcttcgtgggcagagaggagtgcgagctgatgctgcagagcagaagcgtggacaagcagcacgccgtgatcaactacgaccaggacagagacgagcactgggtgaaggacctgggcagcctgaacggcaccttcgtgaacgacatgagaatccccgaccagaagtacgtgaccctgaagctgaacgacgtgatcagattcggctacgacagcaacatgtacgtgctggagagagtgcagcacagagtgcccgaggaggccctgaagcacgagaagtacaccagccagctgcaggtgagcgtgaagggcctggcccccaagagaagcgaggccctgcccgagcacaccccctactgcgaggccagcaaccccagacccgagaagggcgacagaagacccggcaccgaggccgccagctacagaacccccctgtacggccagcccagctggtggggcgaggacgacggcagcaccctgcccgacgcccagagacagggcgagccctaccccgagagacccaagggccccgtgcagcaggacggcgagctgcacggcttcagagcccccgccgagccccagggctgcagcttcagaagagagcccagctacttcgagatccccaccaaggagaccccccagcccagccagccccccgaggtgcccgcccacgagatgcccaccaaggacgccgaggccggcggcggcggcgccgcccccgtggtgcagagccacgccagcttcaccatcgagttcgacgactgcagccccggcaagatgaagatcaaggaccacatcaccaagttcagcctgagacagagaagaccccccggcaaggaggccacccccggcgagatggtgagcgccgagaccaaggtggccgactggctggtgcagaacgaccccagcctgctgcacagagtgggccccggcgacgacagacacagcaccaagagcgacctgcccgtgcacaccagaaccctgaagggccacaagcacgaggacggcacccagagcgacagcgaggaccccctggccaaggccgccagcgccgccggcgtgcccctggaggccagcggcgagcaggtgagactgcagagacagatcaagagagacccccaggagctgctgcacaaccagcaggccttcgtgatcgagttcttcgacgaggacacccccagaaagaagagaagccagagcttcacccacagccccagcggcgaccccaaggccgacaagagaagaggccccacccccgccgacagagacagacccagcgtgcccgcccccgtgcaggccggcggcagaagcagcggcccccagagagccggcagcctgaagagagagaagaccgaggagagactgggcagccccagccccgccagcagaacccccgccagacccttcggcagcgtgggcagaagaagcagactggcccaggacttcatggcccagtgcctgagagagagcagccccgccgccagacccagccccgagaaggtgccccccgtgctgcccgcccccctgaccccccacggcaccagccccgtgggcccccccacccccccccccgcccccaccgacccccagctgaccaaggccagaaagcaggaggaggacgacagcctgagcgacgccggcacctacaccatcgagaccgaggcccaggacaccgaggtggaggaggccagaaagatgatcgaccaggtgttcggcgtgctggagagccccgagctgagcagagccagcagcgccaccttcagacccgtgatcagaggcgacagagacgagagcgacgacggcggcgtggcccagagaatggccctgctgcaggagttcgccagcagacccctgggcgccgccccccaggccgagcaccagggcctgcccgtgcccggcagccccggcggccagaagtgggtgagcagatgggccagcctggccgacagctacagcgaccccggcctgaccgaggacggcctgggcagaagaggcggcgagcccgagggcagcctgcccgtgagaatgagaagaagactgccccagctgcccagcgagagagccgacagccccgccggccccgagagcagcagaagaagcggccccggcccccccgagctggacagcgagcagcccagcagactgttcggccaggaggagctggaccccgacagcctgagcgacgccagcggcagcgacggcggcagaggccccgagcccggcgtggagccccaggacagcagaagaagaagcccccaggagggccccacctggagcagaggcagaagaagccccagagcccccggcgagcccacccccgccagcttcttcatcggcgaccagaacggcgacgccgtgctgagcagaaagcccctggccgcccccggcgacggcgagggcctgggccagaccgcccagcccagcccccccgccagagacggcgtgtacgtgagcgccaacggcagaatggtgatccagctgagacccggcagaagccccgagcccgacggccccgcccccgccttcctgagacaggagagcttcaccaaggagcccgccagcggcccccccgcccccggcaagcccccccacatcagcagccaccccctgctgcaggacctggccgccaccagagccgccagaatggacttccacagccaggacacccacctgatcctgaaggagaccgagaccgccctggccgccctggaggccagactgctgagcaacagcgtggacgccgagtgcgagggcggcagcacccccagaccccccgaggacgccctgagcggcgacagcgacgtggacaccgccagcaccgtgagcctgagaagcggcaagagcggccccagccccaccaccccccagcccctgagagcccagaaggagatgagccccagcccccccgccgcccaggaccccggcggcaccgccctggtgagcgccagagagcagagcagcgagagacagcaccaccccctgggccccaccgacatgggcagaggcgagcccgtgagaagaagcgccatcagaagaggccacagacccagaggcagcctggactggcccagcgaggagagaggccccgtgctggcccacctgcccagcagcgacgtgatggccagcaaccacgagacccccgaggccaccggcgccggcagactgggcagcagaagaaagcccgccgcccccccccccagccccgccgccagagaggagcagagcagaagcagcgccagcagccagaagggcccccaggccctgaccagaagcaacagcctgagcacccccagacccaccagagccagcagactgagaagagccagactgggcgacgccagcgacaccgaggccgccgacggcgagagaggcagcctgggcaaccccgagcccgtgggcagacccgccgccgagcaggccaagaagctgagcagactggacatcctggccatgcccagaaagagagccggcagcttcaccggcaccagcgaccccgaggccgcccccgccagaaccagcttcagcggcagaagcgtggagctgtgctgcgccagcagaaagcccaccatggccgaggccagagccgtgagcagaaaggccgccaacaccgccaccaccaccggccccagacagcccttcagcagagccagaagcggcagcgccagatacaccagcaccacccagacccccagagccggcagcagcagcagagccagaagcagagcccccggccccagagacaccgacgacgacgaggaggagcccgacccctacggcttcatcgtgcagaccgccgagatcgccgagatcgccagactgagccagaccctggtgaaggacgtggccatcctggcccaggagatccacgacgtggccggcgacggcgacaccctgggcagcagcgagcccgcccacagcgccagcctgagcaacatgcccagcacccccgccagcaccatcagcgccagagaggagctggtgcagagaatccccgaggccagcctgaacttccagaaggtgccccccggcagcctgaacagcagagacttcgaccagaacatgaacgacagctgcgaggacgccctggccaacaagaccagacccagaaacagagaggaggtgatcttcgacaacctgatgctgaaccccgtgagccagctgagccaggccatcagagagaacaccgagcacctggccgagaagatgaagatcctgttccagaacaccggcagagcctgggaggacctggaggccagaatcaacgccgagaacgaggtgcccatcctgaagaccagcaacaaggagatcagcagcatcctgaaggagctgagaagagtgcagaagcagctggaggtgatcaacgccatcgtggaccccagcggcagcctggacctgctgaccggcaacagaagcctggccagcagcgcccagcccggcctgggcaagggcagagtggccgcccagagcccccccagccccgccagcgccgaggccctgctgcccgccctgcccctgagaaacttcccccagagagccagctgcggcccccccagcctgcccgaccccaccttcctgcccgacgccgagagattcctgatctag

SEQ ID NO: 11795 - DNA, 696 bp, Artificial Sequence
  Description of Artificial Sequence: Synthetic coding sequence
atcatcctgctgctggtgcccagcgaggagaccgacgagaacgacctgatcctggaggtgaccgccggcgtgggcggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccggcgtggtgagcgagtgccagcaggagagaagccagctgaagaacaaggagctggccatgaccaagctgagagccaagctgtacagcatgcacctggaggaggagatcaacaagagacagaacgccagaaagatccagatcggcagcaagggcagaagcgagaagatcagaacctacaacttcccccagaacagagtgaccgaccacagaatcaacaagaccctgcacgacctggagaccttcatgcagggcgactacctgctggacgagctggtgcagagcctgaaggagtacgccgactacgagagcctggtggagatcatcagccagaaggtgtag

SEQ ID NO: 11796 - DNA, 483 bp, Artificial Sequence; identical to SEQ ID NO: 10977
  Description of Artificial Sequence: Synthetic coding sequence

SEQ ID NO: 11797 - DNA, 423 bp, Artificial Sequence
  Description of Artificial Sequence: Synthetic coding sequence
atgcagttcggcgagctgctggccgccgtgagaaaggcccaggccaacgtgatgctgttcctggaggagaaggagcaggccgccctgagccaggccaacggcatcaaggcccacctggagtacagaagcgccgagatggagaagagcaagcaggagctggagaccatggccgccatcagcaacaccgtgcagttcctggagatgtgcatgaccagcagaagcaccagaacccagcacaccagcatcagcggctgcagaagaagaaccgccagaagccccacccccagacccggcagcatccccaccagaaccagccccgccggcagctgcaccggcggcagatgctgccccagcagagtgtgcacctgcaccggcaccatcctgagatggagaagcagcggccaggcccccatgctggcctag

SEQ ID NO: 11798 - DNA, 819 bp, Artificial Sequence
  Description of Artificial Sequence: Synthetic coding sequence
atggccagcagcaacaccgtgctgatgagactggtggccagcgcctacagcatcgcccagaaggccggcatgatcgtgagaagagtgatcgccgagggcgacctgggcatcgtggagaagacctgcgccaccgacctgcagaccaaggccgacagactggcccagatgagcatctgcagcagcctggccagaaagttccccaagctgaccatcatcggcgaggagctggtggtgtgggtggaccccctggacggcaccaaggagtacaccgagggcctgctggacaacgtgaccgtgctgatcggcatcgcctacgagggcaaggccatcgccggcgtgatcaaccagccctactacaactacgaggccggccccgacgccgtgctgggcagaaccatctggggcgtgctgggcctgggcgccttcggcttccagctgaaggaggtgcccgccggcaagcacatcatcaccaccaccagaagccacagcaacaagctggtgaccgactgcgtggccgccatgaaccccgacgccgtgctgagagtgggcggcgccggcaacaagatcatccagctgatcgagggcaaggccagcgcctacgtgttcgccagccccggctgcaagaagtgggacacctgcgcccccgaggtgatcctgcacgccgtgggcggcaagctgaccgacatccacggcaacgtgctgcagtaccacaaggacgtgaagcacatgaacagcgccggcgtgctggccaccctgagaaactacgactactacgccagcagagtgcccgagagcatcaagaacgccctggtgccctag

SEQ ID NO: 11799 - DNA, 606 bp, Artificial Sequence
  Description of Artificial Sequence: Synthetic coding sequence
atggagagcaaccacaagagcggcgacggcctgagcggcacccagaaggaggccgccctgagagccctggtgcagagaaccggctacagcctggtgcaggagaacggccagagaaagtacggcggccccccccccggctgggacgccgccccccccgagagaggctgcgagatcttcatcggcaagctgcccagagacctgttcgaggacgagctgatccccctgtgcgagaagatcggcaagatctacgagatgagaatgatgatggacttcaacggcaacaacagaggctacgccttcgtgaccttcagcaacaaggtggaggccaagaacgccatcaagcagctgaacaactacgagatcagaaacggcagactgctgggcgtgtgcgccagcgtggacaactgcagactgttcgtgggcggcatccccaagaccaagaagagagaggagatcctgagcgagatgaagaaggtgaccgagggcgtggtggacgtgatcgtgtaccccagcgccgccgacaagaccaagaacagaggcttcgccttcgtggagtacgagagccacagagccgccgccatggccagaagaaagctgctgccctag

SEQ ID NO: 11800 - DNA, 1905 bp, Artificial Sequence
  Description of Artificial Sequence: Synthetic coding sequence
atggccctgagcaagagagagctggacgagctgaagccctggatcgagaagaccgtgaagagagtgctgggcttcagcgagcccaccgtggtgaccgccgccctgaactgcgtgggcaagggcatggacaagaagaaggccgccgaccacctgaagcccttcctggacgacagcaccctgagattcgtggacaagctgttcgaggccgtggaggagggcagaagcagcagacacagcaagagcagcagcgacagaagcagaaagagagagctgaagatcaagcagatgatggaggccgccaccagacagatcgaggagagaaagaagcagctgagcttcatcagcccccccaccccccagcccaagacccccagcagcagccagcccgagagactgcccatcggcaacaccatccagcccagccaggccgccaccttcatgaacgacgccatcgagaaggccagaaaggccgccgagctgcaggccagaatccaggcccagctggccctgaagcccggcctgatcggcaacgccaacatggtgggcctggccaacctgcacgccatgggcatcgccccccccaaggtggagctgaaggaccagaccaagcccacccccctgatcctggacgagcagggcagaaccgtggacgccaccggcaaggagatcgagctgacccacagaatgcccaccctgaaggccaacatcagagccgtgaagagagagcagttcaagcagcagctgaaggagaagcccagcgaggacatggagagcaacaccttcttcgaccccagagtgagcatcgcccccagccagagacagagaagaaccttcaagttccacgacaagggcaagttcgagaagatcgcccagagactgagaaccaaggcccagctggagaagctgcaggccgagatcagccaggccgccagaaagaccggcatccacaccagcaccagactggccctgatcgcccccaagaaggagctgaaggagggcgacatccccgagatcgagtggtgggacagctacatcatccccaacggcttcgacctgaccgaggagaaccccaagagagaggactacttcggcatcaccaacctggtggagcaccccgcccagctgaacccccccgtggacaacgacacccccgtgaccctgggcgtgtacctgaccaagaaggagcagaagaagctgagaagacagaccagaagagaggcccagaaggagctgcaggagaaggtgagactgggcctgatgcccccccccgagcccaaggtgagaatcagcaacctgatgagagtgctgggcaccgaggccgtgcaggaccccaccaaggtggaggcccacgtgagagcccagatggccaagagacagaaggcccacgaggaggccaacgccgccagaaagctgaccgccgagcagagaaaggtgaagaagatcaagaagctgaaggaggacatcagccagggcgtgcacatcagcgtgtacagagtgagaaacctgagcaaccccgccaagaagttcaagatcgaggccaacgccggccagctgtacctgaccggcgtggtggtgctgcacaaggacgtgaacgtggtggtggtggagggcggccccaaggcccagaagaagttcaagagactgatgctgcacagaatcaagtgggacgagcagaccagcaacaccaagggcgacgacgacgaggagagcgacgaggaggccgtgaagaagaccaacaagtgcgtgctggtgtgggagggcaccgccaaggacagaagcttcggcgagatgaagttcaagcagtgccccaccgagaacatggccagagagcacttcaagaagcacggcgccgagcactactgggacctggccctgagcgagagcgtgctggagagcaccgactag

SEQ ID NO: 11801 - DNA, 3192 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 11802 - DNA, 2118 bp, Artificial Sequence
  Description of Artificial Sequence: Synthetic coding sequence
atgatcgacagcgtgaagctgagaagagacagcgccgccgacttcttcagccactacgagtacctgtgcgccctgcagaacagcgtgcccctgcccgccgtgagagcctgcctgagagagggcgtgctggacttcaacgccgacagactgagaggcgtggactgggcccccctgctgagcaccctgaagatcaacaaggacctgcccctggtgagcatcaagagcttcttccagccctggctgggcgacaccggcagcgacatgaacaagttctgcagaagcagagtgcccgccatcagatacaaggacgtgaccttccagctgtgcaaggccctgaagggctgcctgagcatcagcagcgtgctgaagaacctggagctgaacggcctgatcctgagagagagagacctgaccatcctggccaagggcctgaacaagagcgccagcctggtgcacctgagcctggccaactgccccatcggcgacggcggcctggagatcatctgccagggcatcaagagcagcatcaccctgaagaccgtgaacttcaccggctgcaacctgacctggcagggcgccgaccacatggccaagatcctgaagtaccagaccatgagaagacacgaggagacctgggccgagagcctgagatacagaagacccgacctggactgcatggccggcctgagaagaatcaccctgaactgcaacaccctgatcggcgacctgggcgcctgcgccttcgccgacagcctgagcgaggacctgtggctgagagccctggacctgcagcagtgcggcctgaccaacgagggcgccaaggccctgctggaggccctggagaccaacaccaccctggtggtgctggacatcagaaagaaccccctgatcgaccacagcatgatgaaggccgtgatcaagaaggtgctgcagaacggcagaagcgccaagagcgagtaccagtggatcaccagccccagcgtgaaggagcccagcaagaccgccaagcagaagagaagaaccatcatcctgggcagcggccacaagggcaaggccaccatcagaatcggcctggccaccaagaagcccgtgagcagcggcagaaagcacagcctgggcaaggagtactacgcccccgcccccctgccccccggcgtgagcggcttcctgccctggagaaccgccgagagagccaagagacacagaggcttccccctgatcaagaccagagacatctgcaaccagctgcagcagcccggcttccccgtgaccgtgaccgtggagagccccagcagcagcgaggtggaggaggtggacgacagcagcgagagcgtgcacgaggtgcccgagaagaccagcatcgagcaggaggccctgcaggagaagctggaggagtgcctgaagcagctgaaggaggagagagtgatcagactgaaggtggacaagagagtgagcgagctggagcacgagaacgcccagctgagaaacatcaacttcagcctgagcgaggccctgcacgcccagagcctgaccaacatgatcctggacgacgagggcgtgctgggcagcatcgagaacagcttccagaagttccacgccttcctggacctgctgaaggacgccggcctgggccagctggccaccatggccggcatcgaccagagcgacttccagctgctgggccacccccagatgaccagcaccgtgagcaacccccccaaggaggagaagaaggccctggaggacgagaagcccgagcccaagcagaacgccctgggccagatgcagaacatccaggtgagcatctgcatgcagagcgcctacaacgagggcaccctgatgaagttccagaagatcaccggcgacgccagaatccccctgcccctggacagcttccccgtgcccgtgagcacccccgagggcctgggcaccagcagcaacaacctgggcgtgcccgccaccgagcagagacaggagagcttcgagggcttcatcgccagaatgtgcagccccagccccgacgccaccagcggcaccggcagccagagaaaggaggaggagctgagcagaaacagcagaagcagcagcgagaagaagaccaagaccggcagccactag

SEQ ID NO: 11803 - DNA, 1287 bp, Artificial Sequence
  Description of Artificial Sequence: Synthetic coding sequence
atggcctggcagagcagaaagggcggccacttcagagaggtggccatgcagtggaaggtgaccctgaccagcagatggggcctgctgagacactgccaggtgctggccggcctgctgcacctgggcaacatccagttcgccgccagcgaggacgaggcccagccctgccagcccatggacgacgccaagtacagcgtgagaaccgccgccagcctgctgggcctgcccgaggacgtgctgctggagatggtgcagatcagaaccatcagagccggcagacagcagcaggtgttcagaaagccctgcgccagagccgagtgcgacaccagaagagactgcctggccaagctgatctacgccagactgttcgactggctggtgagcgtgatcaacagcagcatctgcgccgacaccgacagctggaccaccttcatcggcctgctggacgtgtacggcttcgagagcttccccgacaacagcctggagcagctgtgcatcaactacgccaacgagaagctgcagcagcacttcgtggcccactacctgagagcccagcaggaggagtacgccgtggagggcctggagtggagcttcatcaactaccaggacaaccagccctgcctggacctgatcgagggcagccccatcagcatctgcagcctgatcaacgaggagtgcagactgaacagacccagcagcgccgcccagctgcagaccagaatcgagaccgccctggccggcagcccctgcctgggccacaacaagctgagcagagagcccagcttcatcgtggtgcactacgccggccccgtgagataccacaccgccggcctggtggagaagaacaaggaccccatcccccccgagctggacggcgtggaggagaagcacttcagccaggccccctgcagcctgagcaccagccccctgcagaccagactgctggaggccatcatcagactgtggcccctgggcctggtgctggccaacaccgccatgggcgtgggcagcttccagagaaagctggtggtgtgggcctgcctgcagctgcccagaggcagccccagcagctacaccgtgcagaccgcccaggaccaggccggcgtgaccagcatcagagccctgccccagggcagcatcaagttccactgcagaaagagccccctgagatacgccgacatctgccccgagcccagcccctacagcatcaccggcttcaaccagatcctgctggagagacacagactgatccacgtgaccagcagcgccttcaccggcctgggctag

SEQ ID NO: 11804 - DNA, 927 bp, Artificial Sequence; identical to SEQ ID NO: 9731
  Description of Artificial Sequence: Synthetic coding sequence

SEQ ID NO: 11805 - DNA, 429 bp, Artificial Sequence
  Description of Artificial Sequence: Synthetic coding sequence
atgagcctgcacggcaagagaaaggagatctacaagtacgaggccccctggaccgtgtacgccatgaactggagcgtgagacccgacaagagattcagactggccctgggcagcttcgtggaggagtacaacaacaaggtggtgatcctggacgtgagagtgccctgcacccccgtggccagactgaacaaccacagagcctgcgtgaacggcatcgcctgggccccccacagcagctgccacatctgcaccgccgccgacgaccaccaggccctgatctgggacatccagcagatgcccagagccatcgaggaccccatcctggcctacaccgccgagggcgagatcaacaacgtgcagtgggccagcacccagcccgactggatcgccatctgctacaacaactgcctggagatcctgagagtgtag

SEQ ID NO: 11806 - DNA, 1233 bp, Artificial Sequence
  Description of Artificial Sequence: Synthetic coding sequence
atggccgcccccagccccagcggcggcggcggcagcggcggcggcagcggcagcggcacccccggccccgtgggcagccccgcccccggccaccccgccgtgagcagcatgcagggcttccagatcaacttctgcgagaaggcccagagcaagagaaaggccctgaagctgaacttcgccaacccccccttcaagagcaccgccagattcaccctgaaccccaaccccaccggcgtgcagaacccccacatcgagagactgagaacccacagcatcgagagcagcggcaagctgaagatcagccccgagcagcactgggacttcaccgccgaggacctgaaggacctgggcgagatcggcagaggcgcctacggcagcgtgaacaagatggtgcacaagcccagcggccagatcatggccgtgaagagaatcagaagcaccgtggacgagaaggagcagaagcagctgctgatggacctggacgtggtgatgagaagcagcgactgcccctacatcgtgcagttctacggcgccctgttcagagagggcgactgctggatctgcatggagctgatgagcaccagcttcgacaagttctacaagtacgtgtacagcgtgctggacgacgtgatccccgaggagatcctgggcaagatcaccctggccaccgtgaaggccctgaaccacctgaaggagaacctgaagatcatccacagagacatcaagcccagcaacatcctgctggacagaagcggcaacatcaagctgtgcgacttcggcatcagcggccagctggtggacagcatcgccaagaccagagacgccggctgcagaccctacatggcccccgagagaatcgaccccagcgccagcagacagggctacgacgtgagaagcgacgtgtggagcctgggcatcaccctgtacgagctggccaccggcagattcccctaccccaagtggaacagcgtgttcgaccagctgacccaggtggtgaagggcgaccccccccagctgagcaacagcgaggagagagagttcagccccagcttcatcaacttcgtgaacctgtgcctgaccaaggacgagagcaagagacccaagtacaaggagctgctgaagcaccccttcatcctgatgtacgaggagagagccgtggaggtggcctgctacgtgtgcaagatcctggaccagatgcccgccacccccagcagccccatgtacgtggactag

SEQ ID NO: 11807 - DNA, 687 bp, Artificial Sequence
  Description of Artificial Sequence: Synthetic coding sequence
atgcagctggccgtggtgagcgaggagcaggaccagaacctgaacagactgatctgctggatcctgatgcagttcatctacatcagcagcgactacgtgttcgacggcaccaaccccccctacagagaggaggacatccccgcccccctgaacctgtacggcaagaccaagctggacggcgagaaggccgtgctggagaacaacctgggcgccgccgtgctgagaatccccatcctgtacggcgaggtggagaagctggaggagagcgccgtgaccgtgatgttcgacaaggtgcagttcagcaacaagagcgccaacatggaccactggcagcagagattccccacccacgtgaaggacgtggccaccgtgtgcagacagctggccgagaagagaatgctggaccccagcatcaagggcaccttccactggagcggcaacgagcagatgaccaagtacgagatggcctgcgccatcgccgacgccttcaacctgcccagcagccacctgagacccatcaccgacagccccgtgctgggcgcccagagacccagaaacgcccagctggactgcagcaagctggagaccctgggcatcggccagagaacccccttcagaatcggcatcaaggagagcctgtggcccttcctgatcgacaagagatggagacagaccgtgttccactag

SEQ ID NO: 11808 - DNA, 1101 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagcagccccttccaggtgaccgccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 11809 - DNA, 306 bp, Artificial Sequence
  Description of Artificial Sequence: Synthetic coding sequence
atggccagcgccggcacccagcactacagcatcggcctgagacagaagaacagcttcaagcagagcggccccagcggcaccgtgcccgccaccccccccgagaagcccagcgagggcagagtgtggccccaggcccaccagcaggtgaagcccatctggaagctggagaagaagcaggtggagaccctgagcgccggcctgggccccggcctgctgggcgtgcccccccagcccgcctacttcttctgccccagcaccctgtgcagcagcggcaccaccgccgtgatcgccggccacagcagctag

SEQ ID NO: 11810 - DNA, 2121 bp, Artificial Sequence
  Description of Artificial Sequence: Synthetic coding sequence
atgatcgacagcgtgaagctgagaagagacagcgccgccgacttcttcagccactacgagtacctgtgcgccctgcagaacagcgtgcccctgcccgccgtgagagcctgcctgagagagggcgtgctggacttcaacgccgacagactgagaggcgtggactgggcccccctgctgagcaccctgaagatcaacaaggacctgcccctggtgagcatcaagagcttcttccagccctggctgggcgacaccggcagcgacatgaacaagttctgcagaagcagagtgcccgccatcagatacaaggacgtgaccttccagctgtgcaaggccctgaagggctgcctgagcatcagcagcgtgctgaagaacctggagctgaacggcctgatcctgagagagagagacctgaccatcctggccaagggcctgaacaagagcgccagcctggtgcacctgagcctggccaactgccccatcggcgacggcggcctggagatcatctgccagggcatcaagagcagcatcaccctgaagaccgtgaacttcaccggctgcaacctgacctggcagggcgccgaccacatggccaagatcctgaagtaccagaccatgagaagacacgaggagacctgggccgagagcctgagatacagaagacccgacctggactgcatggccggcctgagaagaatcaccctgaactgcaacaccctgatcggcgacctgggcgcctgcgccttcgccgacagcctgagcgaggacctgtggctgagagccctggacctgcagcagtgcggcctgaccaacgagggcgccaaggccctgctggaggccctggagaccaacaccaccctggtggtgctggacatcagaaagaaccccctgatcgaccacagcatgatgaaggccgtgatcaagaaggtgctgcagaacggcagaagcgccaagagcgagtaccagtggatcaccagccccagcgtgaaggagcccagcaagaccgccaagcagaagagaagaaccatcatcctgggcagcggccacaagggcaaggccaccatcagaatcgtgggcctggccaccaagaagcccgtgagcagcggcagaaagcacagcctgggcaaggagtactacgcccccgcccccctgccccccggcgtgagcggcttcctgccctggagaaccgccgagagagccaagagacacagaggcttccccctgatcaagaccagagacatctgcaaccagctgcagcagcccggcttccccgtgaccgtgaccgtggagagccccagcagcagcgaggtggaggaggtggacgacagcagcgagagcgtgcacgaggtgcccgagaagaccagcatcgagcaggaggccctgcaggagaagctggaggagtgcctgaagcagctgaaggaggagagagtgatcagactgaaggtggacaagagagtgagcgagctggagcacgagaacgcccagctgagaaacatcaacttcagcctgagcgaggccctgcacgcccagagcctgaccaacatgatcctggacgacgagggcgtgctgggcagcatcgagaacagcttccagaagttccacgccttcctggacctgctgaaggacgccggcctgggccagctggccaccatggccggcatcgaccagagcgacttccagctgctgggccacccccagatgaccagcaccgtgagcaacccccccaaggaggagaagaaggccctggaggacgagaagcccgagcccaagcagaacgccctgggccagatgcagaacatccagttccagaagatcaccggcgacgccagaatccccctgcccctggacagcttccccgtgcccgtgagcacccccgagggcctgggcaccagcagcaacaacctgggcgtgcccgccaccgagcagagacaggagagcttcgagggcttcatcgccagaatgtgcagccccagccccgacgccaccagcggcaccggcagccagagaaaggaggaggagctgagcagaaacagcagaagcagcagcgagaagaagaccaagaccggcgagtacaccaagaagcacagcgacaagcagcaccccggcaaggacctgcacagctag

SEQ ID NO: 11811 - DNA, 1932 bp, Artificial Sequence
  Description of Artificial Sequence: Synthetic coding sequence
atggcctgccagcagagcagataccacagcttcagcagcgccagcagactgcagcccagacccagcggcgtgaccatcgacgagagcttcctgaccgaggacaagagcacccagaacagaaagctgctgcagaagagaagaaccctggagctgcccgccgcccccctgagccactgccaggcccccgtgctgggcggcaccggcaagctgcccacccagggcgccccccccgccggccccggccacagattccaccccggcaccaaggccgccgcccaccagagagagaagatcagagccctggagcccctgaaggccaagctggtgaccgtgaacgaggactgcaacgagagaatcctggccatgagagccgaggagaagtacgagatcagcctgctgaagaaggagaagatgaacctgctgaagctgatcgacaagaagaacgaggagaagatcagcctgcagagcgaggtgaccaagctgagaaagaacctggccgaggagtacctgcactacctgagcgagagagacgcctgcaagatcctgatcgccgacctgaacgagctgagataccagagagaggacatgagcctggcccagagccccggcatctggggcgaggaccccgtgaagctgaccctggccctgaagatgaccagacaggacctgaccagaacccagatggagctgaacaacatgaaggccaacttcggcgacgtggtgcccagaagagacttcgagatgcaggagaagaccaacaaggacctgcaggagcagctggacaccctgagagccagctacgaggaggtgagaaaggagcacgagatcctgatgcagctgcacatgagcaccctgaaggagagagaccagttcttcagcgagctgcaggagatccagagaaccagcacccccagacccgactggaccaagtgcaaggacgtggtggccggcggccccgagagatggcagatgctggccgagggcaagaacagcgaccagctggtggacgtgctgctggaggagatcggcagcggcctgctgagagagaaggacttcttccccggcctgggctacggcgaggccatccccgccttcctgagattcgacggcctggtggagaacaagaagcccagcaagaaggacgtggtgaacctgctgaaggacgcctggaaggagagactggccgaggagcagaaggagaccttccccgacttcttcttcaacttcctggagcacagattcggccccagcgacgccatggcctgggcctacaccatcttcgagaacatcaagatcttccacagcaacgaggtgatgagccagttctacgccgtgctgatgggcaagagaagcgagaacgtgtacgtgacccagaaggagaccgtggcccagctgctgaaggagatgaccaacgccgacagccagaacgagggcctgctgaccatggagcagttcaacaccgtgctgaagagcaccttccccctgaagaccgaggagcagatccaggagctgatggaggccggcggctggcaccccagcagcagcaacgccgacctgctgaactacagaagcctgttcatggaggacgaggagggccagagcgagcccttcgtgcagaagctgtgggagcagtacatggacgagaaggacgagtacctgcagcagctgaagcaggagctgggcatcgagctgcacgaggaggtgaccctgcccaagctgagaggcggcctgatgaccatcgaccccagcctggacaagcagaccgtgaacacctacatgagccaggccttccagctgcccgagagcgagatgcccgaggagggcgacgagaaggaggaggccgtggtggagatcctgcagaccgccctggagagactgcaggtgatcgacatcagaagagtgggccccagagagcccgagcccgccagctag

SEQ ID NO: 11812 - DNA, 474 bp, Artificial Sequence
  Description of Artificial Sequence: Synthetic coding sequence
atggccaccagcgcccccctgagaagcctggaggaggaggtgacctgcagcatctgcctggactacctgagagaccccgtgaccatcgactgcggccacgtgttctgcagaagctgcaccaccgacgtgagacccatcagcggcagcagacccgtgtgccccctgtgcaagaagcccttcaagaaggagaacatcagacccgtgtggcagctggccagcctggtggagaacatcgagagactgaaggtggacaagggcagacagcccggcgaggtgaccagagagcagcaggacgccaagctgtgcgagagacacagagagaagctgcactactactgcgaggacgacggcaagctgctgtgcgtgatgtgcagagagagcagagagcacagaccccacaccgccgtgctgatggagaaggccgcccagccccacagagagaagatcctgaaccacctgagcaccctgagatag

SEQ ID NO: 11813 - DNA, 939 bp, Artificial Sequence
  Description of Artificial Sequence: Synthetic coding sequence
atggcccagccctacccccccgcccagtaccccccccccccccagaacggcatccccgccgagtacgcccccccccccccccaccccacccaggactacagcggccagacccccgtgcccaccgagcacggcatgaccctgtacacccccgcccagacccaccccgagcagcccggcagcgaggccagcacccagcccatcgccggcacccagaccgtgccccagaccgacgaggccgcccagaccgacagccagcccctgcaccccagcgaccccaccgagaagcagcagcccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaccagcagcgacgccgacagagccagagagaagctgaacggcaccatcgtggagggcagaaagatcgaggtgaacaacgccaccgccagagtgatgaccaacaagaagaccggcaacccctacaccaacggctggaagctgaaccccgtggtgggcgccgtgtacggccccgagttctacgccgtgaccggcttcccctaccccaccaccggcaccgccgtggcctacagaggcgcccacctgagaggcagaggcagagccgtgtacaacaccttcagagccgcccccccccccccccccatccccacctacggcgccgtggtgtaccaggacggcttctacggcgccgagatctacggcggctacgccgcctacagatacgcccagcccgccgccgccgccgccgcctacagcgacagctacggcagagtgtacgccgccgccgacccctaccaccacaccatcggccccgccgccacctacagcatcggcaccatgtag

SEQ ID NO: 11814 - DNA, 300 bp, Artificial Sequence
  Description of Artificial Sequence: Synthetic coding sequence
atggccagcctgctgcaggaccagctgaccaccgaccaggacctgctgctgatgcaggagggcatgcccatgagaaaggtgagaagcaagagctggaagaagctgagatacttcagactgcagaacgacggcatgaccgtgtggcacgccagacaggccagaggcagcgccaagcccagcttcagcatcagcgacgtggagaccatcagaaacggccacgacagcgagctgctgagaagcctggccgaggagctgcccctggagcagggcttcaccatcgtgttccacggcagaagatag

SEQ ID NO: 11815 - DNA, 1620 bp, Artificial Sequence; identical to SEQ ID NO: 10018
  Description of Artificial Sequence: Synthetic coding sequence

SEQ ID NO: 11816 - DNA, 480 bp, Artificial Sequence
  Description of Artificial Sequence: Synthetic coding sequence
atggccaccagcgcccccctgagaagcctggaggaggaggtgacctgcagcatctgcctggactacctgagagaccccgtgaccatcgactgcggccacgtgttctgcagaagctgcaccaccgacgtgagacccatcagcggcagcagacccgtgtgccccctgtgcaagaagcccttcaagaaggagaacatcagacccgtgtggcagctggagaagatcctgaaccacctgagcaccctgagaagagacagagacaagatccagggcttccaggccaagggcgaggccgacatcctggccgccctgaagaagctgcaggaccagagacagtacatcgtggccgagttcgagcagggccaccagttcctgagagagagagaggagcacctgctggagcagctggccaagctggagcaggagctgaccgagggcagagagaagttcaagagcagaggcgtgggcgagctggccagatag

SEQ ID NO: 11817 - DNA, 579 bp, Artificial Sequence; identical to SEQ ID NO: 11225
  Description of Artificial Sequence: Synthetic coding sequence

SEQ ID NO: 11818 - DNA, 309 bp, Artificial Sequence
  Description of Artificial Sequence: Synthetic coding sequence
atgcacaacagaagccagggcttcttcttcagcagctgccacccccagaaccacgtgagctacggctgccagagccccagcttcatcttctgcagatgccagagcctgaacttcgtgagcagaacctgctaccccctgagctacttcagctacggcaaccagaccatcggcagcatcagcaacagcttcagaagcctgaactacgtgagccacagcttccagcccatcagcttcatgcacagcagcttccagcccgcctgcagcgacttcgtgggctggcagagccccttcctgagaagaacctgctag

SEQ ID NO: 11819 - DNA, 723 bp, Artificial Sequence
  Description of Artificial Sequence: Synthetic coding sequence
atggacctggtgagactgggcctggagagaggcgagaccgccaaggaggccctggacgtgatcgtgagcctgctggaggagcacggccagggcggcaactacttcgaggacgccaacagctgccacagcttccagagcgcctacctgatcgtggacagagacgaggcctgggtgctggagaccatcggcaagtactgggccgccgagaaggtgaccgagagcatcaccgtgcagaccatgatgaacaccctgagagacaaggccagcggcgtgtgcatcgacagcgagttcttcctgaccaccgccagcggcgtgagcgtgctgccccagaacagaagcagcccctgcatccactacttcaccggcacccccgaccccagcagaagcatcttcaagcccttcatcttcgtggacgacgtgaagctggtgcccaagacccagagcccctgcttcggcgacgacgaccccgccaagaaggagcccagattccaggagaagcccgacagaagacacgagctgtacaaggcccacgagtgggccagagccatcatcgagagcgaccaggagcagggcagaaagctgagaagcaccatgctggagctggagaagcagggcctggaggccatggaggagatcctgaccagcagcgagcccctggaccccgccgaggtgggcgacctgttctacgactgcgtggacaccgagatcaagttcttcaagtag

SEQ ID NO: 11820 - DNA, 900 bp, Artificial Sequence
  Description of Artificial Sequence: Synthetic coding sequence
tgaagagaggaggacatctaccagttcgcctactgctacccctacacctacaccagattccagcactacctggacagcctgcagaagagaaacatggactacttcttcagagagcagctgggccagagcgtgcagcagagaaagctggacctgctgaccatcaccagccccgacaacctgagagagggcgccgagcagaaggtggtgttcatcaccggcagagtgcaccccggcgagacccccagcagcttcgtgtgccagggcatcatcgacttcctggtgagccagcaccccatcgcctgcgtgctgagagagtacctggtgttcaagatcgcccccatgctgaaccccgacggcgtgtacctgggcaactacagatgcagcctgatgggcttcgacctgaacagacactggctggaccccagcccctgggtgcaccccaccctgcacggcgtgaagcagctgatcgtgcagatgtacaacgaccccaagaccagcctggagttctacatcgacatccacgcccacagcaccatgatgaacggcttcatgtacggcaacatcttcgaggacgaggagagattccagagacaggccatcttccccaagctgctgtgccagaacgccgaggacttcagctacagcagcaccagcttcaacagagacgccgtgaaggccggcaccggcagaagattcctgggcggcctgctggaccacaccagctactgctacaccctggaggtgagcttctacagctacatcatcagcggcaccaccgccgccgtgccctacaccgaggaggcctgcatcctgagcccccaccccgccctgggccagcccagcagcagcagagagtaccccagcctgaccggccaggagctgggcccccagctgagatag

SEQ ID NO: 11821 - DNA, 1041 bp, Artificial Sequence
  Description of Artificial Sequence: Synthetic coding sequence
atggccgccgccgagcccgccagcagcggccagcaggcccccgccggccagggccagggccagagaccccccccccagcccccccaggcccaggccccccagccccccccccccccccagctgggcggcgccggcggcggcagcagcagacacgagaagagcctgggcctgctgaccaccaagttcgtgagcctgctgcaggaggccaaggacggcgtgctggacctgaaggccgccgccgacaccctggccgtgagacagaagagaagaatctacgacatcaccaacgtgctggagggcatcgacctgatcgagaagaagagcaagaacagcatccagtggaagggcgtgggcgccggctgcaacaccaaggaggtgatcgacagactgagatacctgaaggccgagatcgaggacctggagctgaaggagagagagctggaccagcagaagctgtggctgcagcagagcatcaagaacgtgatggacgacagcatcaacaacagattcagctacgtgacccacgaggacatctgcaactgcttcaacggcgacaccctgctggccatccaggcccccagcggcacccagctggaggtgcccatccccgagatgggccagaacggccagaagaagtaccagatcaacctgaagagccacagcggccccatccacgtgctgctgatcaacaaggagagcagcagcagcaagcccgtggtgttccccgtgcccccccccgacgacctgacccagcccagcagccagagcctgacccccgtgaccccccagaagagcagcatggccacccagaacctgcccgagcagcacgtgagcgagagaagccaggccctgcagcagaccagcgccaccgacatcagcagcgccggcagcatcagcggcgacatcatcgacgagctgatgagcagcgacgtgttccccctgctgagactgagccccacccccgccgacgactacaacttcaacctggacgacaacgagggcgtgtgcgacctgttcgacgtgcagatcctgaactactag

SEQ ID NO: 11822 - DNA, 396 bp, Artificial Sequence
  Description of Artificial Sequence: Synthetic coding sequence
atgagcaagagatacctgcagaaggccaccaagggcaagctgctgatcatcatcttcatcgtgaccctgtggggcaaggtggtgagcagcgccaaccaccacaaggcccaccacgtgaagaccggcacctgcgaggtggtggccctgcacagatgctgcaacaagaacaagatcgaggagagaagccagaccgtgaagtgcagctgcttccccggccaggtggccggcaccaccagagccgcccccagctgcgtggacgccagcatcgtggagcagaagtggtggtgccacatgcagccctgcctggagggcgaggagtgcaaggtgctgcccgacagaaagggctggagctgcagcagcggcaacaaggtgaagaccaccagagtgacccactag

SEQ ID NO: 11823 - DNA, 306 bp, Artificial Sequence
  Description of Artificial Sequence: Synthetic coding sequence
atgcccttcttcggcaacaccttcagccccaagaagaccccccccagaaagagcgccagcctgagcaacctgcacagcctggacagaagcaccagagaggtggagctgggcctggagtacggcagccccaccatgaacctggccggccagagcctgaagttcgagaacggccagtggatcgccgagaccggcgtgagcggcggcgtggacagaagagaggtgcagagactgagaagaagaaaccagcagctggaggaggagaacaacctgctgagactgaaggtggacatcctgctggacatgtag

SEQ ID NO: 11824 - DNA, 393 bp, Artificial Sequence
  Description of Artificial Sequence: Synthetic coding sequence
atggacatcagcaagggcctgcccggcatgcagggcggcctgcacatctggatcagcgagaacagaaagatggtgcccgtgcccgagggcgcctacggcaacttcttcgaggagcactgctacgtgatcctgcacgtgccccagagccccaaggccacccagggcgccagcagcgacctgcactactgggtgggcaagcaggccggcgccgaggcccagggcgccgccgaggccttccagcagagactgcaggacgagctgggcggccagaccgtgctgcacagagaggcccagggccacgagagcgactgcttctgcagctacttcagacccggcatcatctacagaaagggcggcctggccagcgacctgaagcacgtggagaccaactag

SEQ ID NO: 11825 - DNA, 51 bp, Artificial Sequence
  Description of Artificial Sequence: Synthetic coding sequence
atgtgcaccagcgagaccttccaggccctggacaccttcgaggccagatag

SEQ ID NO: 11826 - DNA, 5553 bp, Artificial Sequence
  Description of Artificial Sequence: Synthetic coding sequence
atggagagcaacttcaaccaggagggcgtgcccagacccagctacgtgttcagcgccgaccccatcgccagacccagcgagatcaacttcgacggcatcaagctggacctgagccacgagttcagcctggtggcccccaacaccgaggccaacagcttcgagagcaaggactacctgcaggtgtgcctgagaatcagacccttcacccagagcgagaaggagctggagagcgagggctgcgtgcacatcctggacagccagaccgtggtgctgaaggagccccagtgcatcctgggcagactgagcgagaagagcagcggccagatggcccagaagttcagcttcagcaaggtgttcggccccgccaccacccagaaggagttcttccagggctgcatcatgcagcccgtgaaggacctgctgaagggccagagcagactgatcttcacctacggcctgaccaacagcggcaagacctacaccttccagggcaccgaggagaacatcggcatcctgcccagaaccctgaacgtgctgttcgacagcctgcaggagagactgtacaccaagatgaacctgaagccccacagaagcagagagtacctgagactgagcagcgagcaggagaaggaggagatcgccagcaagagcgccctgctgagacagatcaaggaggtgaccgtgcacaacgacagcgacgacaccctgtacggcagcctgaccaacagcctgaacatcagcgagttcgaggagagcatcaaggactacgagcaggccaacctgaacatggccaacagcatcaagttcagcgtgtgggtgagcttcttcgagatctacaacgagtacatctacgacctgttcgtgcccgtgagcagcaagttccagaagagaaagatgctgagactgagccaggacgtgaagggctacagcttcatcaaggacctgcagtggatccaggtgagcgacagcaaggaggcctacagactgctgaagctgggcatcaagcaccagagcgtggccttcaccaagctgaacaacgccagcagcagaagccacagcatcttcaccgtgaagatcctgcagatcgaggacagcgagatgagcagagtgatcagagtgagcgagctgagcctgtgcgacctggccggcagcgagagaaccatgaagacccagaacgagggcgagagactgagagagaccggcaacatcaacaccagcctgctgaccctgggcaagtgcatcaacgtgctgaagaacagcgagaagagcaagttccagcagcacgtgcccttcagagagagcaagctgacccactacttccagagcttcttcaacggcaagggcaagatctgcatgatcgtgaacatcagccagtgctacctggcctacgacgagaccctgaacgtgctgaagttcagcgccatcgcccagaaggtgtgcgtgcccgacaccctgaacagcagccaggagaagctgttcggccccgtgaagagcagccaggacgtgagcctggacagcaacagcaacagcaagatcctgaacgtgaagagagccaccatcagctgggagaacagcctggaggacctgatggaggacgaggacctggtggaggagctggagaacgccgaggagacccagaacgtggagaccaagctgctggacgaggacctggacaagaccctggaggagaacaaggccttcatcagccacgaggagaagagaaagctgctggacctgatcgaggacctgaagaagaagctgatcaacgagaagaaggagaagctgaccctggagttcaagatcagagaggaggtgacccaggagttcacccagtactgggcccagagagaggccgacttcaaggagaccctgctgcaggagagagagatcctggaggagaacgccgagagaagactggccatcttcaaggacctggtgggcaagtgcgacaccagagaggaggccgccaaggacatctgcgccaccaaggtggagaccgaggagacccacaactacgtgggcttcgaggacatcatcgacagcctgcaggacaacgtggccgacatcaagaagcaggccgagatcgcccacctgtacatcgccagcctgcccgacccccaggaggccaccgcctgcctggagctgaagttcaaccagatcaaggccgagctggccaagaccaagggcgagctgatcaagaccaaggaggagctgaagaagagagagaacgagagcgacagcctgatccaggagctggagaccagcaacaagaagatcatcacccagaaccagagaatcaaggagctgatcaacatcatcgaccagaaggaggacaccatcaacgagttccagaacctgaagagccacatggagaacaccttcaagtgcaacgacaaggccgacaccagcagcctgatcatcaacaacaagctgatctgcaacgagaccgtggaggtgcccaaggacagcaagagcaagatctgcagcgagagaaagagagtgaacgagaacgagctgcagcaggacgagccccccgccaagaagggcaccaccagcgccgccagcagcagaagactgagaaagctgatcagcaagcccgtgaacagaaccagacagaccgagggccacagcctggtgagcatccacgtgagcagcgccatcaccgaggaccagaagaagagcgaggaggtgagacccaacatcgccgagatcgaggacatcagagtgctgcaggagaacaacgagggcctgagagccttcctgctgaccatcgagaacgagctgaagaacgagaaggaggagaaggccgagctgaacaagcagatcgtgcacttccagcaggagctgagcctgagcgagaagaagaacctgaccctgagcaaggaggtgcagcagatccagagcaactacgacatcgccatcgccgagctgcacgtgcagaagagcaagaaccaggagcaggaggagaagatcatgaagctgagcaacgagatcgagaccgccaccagaagcatcaccaacaacgtgagccagatcaagctgatgcacaccaagatcgacgagctgagaaccctggacagcgtgagccagatcagcaacatcgacctgctgaacctgagagacctgagcaacggcagcgaggaggacaacctgcccaacacccagctggacctgctgggcaacgactacctggtgagcaagcaggtgaaggagtacagaatccaggagcccaacagagagaacagcttccacagcagcatcgaggccatctgggaggagtgcaaggagatcgtgaaggccagcagcaagaagagccaccagatcgaggagctggagcagcagatcgagaagctgcaggccgaggtgaagggctacaaggacgagaacaacagactgaaggagaaggagcacaagaaccaggacgacctgctgaaggagaaggagaccctgatccagcagctgaaggaggagctgcaggagaagaacgtgaccctggacgtgcagatccagcacgtggtggagggcaagagagccctgagcgagctgacccagggcgtgacctgctacaaggccaagatcaaggagctggagaccatcctggagacccagaaggtggagtgcagccacagcgccaagctggagcaggacatcctggagaaggagagcatcatcctgaagctggagagaaacctgaaggagttccaggagcacctgcaggacagcgtgaagaacaccaaggacctgaacgtgaaggagctgaagctgaaggaggagatcacccagctgaccaacaacctgcaggacatgaagcacctgctgcagctgaaggaggaggaggaggagaccaacagacaggagaccgagaagctgaaggaggagctgagcgccagcagcgccagaacccagaacctgaaggccgacctgcagagaaaggaggaggactacgccgacctgaaggagaagctgaccgacgccaagaagcagatcaagcaggtgcagaaggaggtgagcgtgatgagagacgaggacaagctgctgagaatcaagatcaacgagctggagaagaagaagaaccagtgcagccaggagctggacatgaagcagagaaccatccagcagctgaaggagcagctgaacaaccagaaggtggaggaggccatccagcagtacgagagagcctgcaaggacctgaacgtgaaggagaagatcatcgaggacatgagaatgaccctggaggagcaggagcagacccaggtggagcaggaccaggtgctggaggccaagctggaggaggtggagagactggccaccgagctggagaagtggaaggagaagtgcaacgacctggagaccaagaacaaccagagaagcaacaaggagcacgagaacaacaccgacgtgctgggcaagctgaccaacctgcaggacgagctgcaggagagcgagcagaagtacaacgccgacagaaagaagtggctggaggagaagatgatgctgatcacccaggccaaggaggccgagaacatcagaaacaaggagatgaagaagtacgccgaggacagagagagattcttcaagcagcagaacgagatggagatcctgaccgcccagctgaccgagaaggacagcgacctgcagaagtggagagaggagagagaccagctggtggccgccctggagatccagctgaaggccctgatcagcagcaacgtgcagaaggacaacgagatcgagcagctgaagagaatcatcagcgagaccagcaagatcgagacccagatcatggacatcaagcccaagagaatcagcagcgccgaccccgacaagctgcagaccgagcccctgagcaccagcttcgagatcagcagaaacaagatcgaggacggcagcgtggtgctggacagctgcgaggtgagcaccgagaacgaccagagcaccagattccccaagcccgagctggagatccagttcacccccctgcagcccaacaagatggccgtgaagcaccccggctgcaccacccccgtgaccgtgaagatccccaaggccagaaagagaaagagcaacgagatggaggaggacctggtgaagtgcgagaacaagaagaacgccacccccagaaccaacctgaagttccccatcagcgacgacagaaacagcagcgtgaagaaggagcagaaggtggccatcagacccagcagcaagaagacctacagcctgagaagccaggccagcatcatcggcgtgaacctggccaccaagaagaaggagggcaccctgcagaagttcggcgacttcctgcagcacagccccagcatcctgcagagcaaggccaagaagatcatcgagaccatgagcagcagcaagctgagcaacgtggaggccagcaaggagaacgtgagccagcccaagagagccaagagaaagctgtacaccagcgagatcagcagccccatcgacatcagcggccaggtgatcctgatggaccagaagatgaaggagagcgaccaccagatcatcaagagaagactgagaaccaagaccgccaagtag

SEQ ID NO: 11827 - DNA, 1527 bp, Artificial Sequence; identical to SEQ ID NO: 11102
  Description of Artificial Sequence: Synthetic coding sequence

SEQ ID NO: 11828 - DNA, 975 bp, Artificial Sequence
  Description of Artificial Sequence: Synthetic coding sequence
atgttcatcggcggcctgagctggcagaccagccccgacagcctgagagactacttcagcaagttcggcgagatcagagagtgcatggtgatgagagaccccaccaccaagagaagcagaggcttcggcttcgtgaccttcgccgaccccgccagcgtggacaaggtgctgggccagccccaccacgagctggacagcaagaccatcgaccccaaggtggccttccccagaagagcccagcccaagatggtgaccagaaccaagaagatcttcgtgggcggcctgagcgccaacaccgtggtggaggacgtgaagcagtacttcgagcagttcggcaaggtggaggacgccatgctgatgttcgacaagaccaccaacagacacagaggcttcggcttcgtgaccttcgagaacgaggacgtggtggagaaggtgtgcgagatccacttccacgagatcaacaacaagatggtggagtgcaagaaggcccagcccaaggaggtgatgttcccccccggcaccagaggcagagccagaggcctgccctacaccatggacgccttcatgctgggcatgggcatgctgggctaccccaacttcgtggccacctacggcagaggctaccccggcttcgcccccagctacggctaccagttccccggcttccccgccgccgcctacggccccgtggccgccgccgccgtggccgccgccagaggcagcgtgctgaacagctacagcgcccagcccaacttcggcgcccccgccagccccgccggcagcaaccccgccagacccggcggcttccccggcgccaacagccccggccccgtggccgacctgtacggccccgccagccaggacagcggcgtgggcaactacatcagcgccgccagcccccagcccggcagcggcttcggccacggcatcgccggccccctgatcgccaccgccttcaccaacggctaccactag

SEQ ID NO: 11829 - DNA, 333 bp, Artificial Sequence
  Description of Artificial Sequence: Synthetic coding sequence
tgacacaagccctgctacggcgccctgttcggccccagaggcgtgaacatcggcggcgtgggcagctacctgtacaacccccccacccccagccccggctgcaccacccccctgagccccagcagcttcagcccccccagacccagaaccggcctgccccagggcaagaagaccgagaaggtgatgagcctgggcagaaactggcacagaccctgcctgagatgccagagatgccacaagaccctgaccgccggcagccacgccgagcacgacggcgtgccctactgccacgtgccctgctacggctacctgttcggccccaaggccctgtag

SEQ ID NO: 11830 - DNA, 411 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactggacaccgagaagctgtgcaccttcagccagagattccccctgcccagcatgtacagagccctggtgtggaaggtgctgctgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggcctag

SEQ ID NO: 11831 - DNA, 1686 bp, Artificial Sequence
  Description of Artificial Sequence: Synthetic coding sequence
atggccagccagttctgcctgcccgagagcccctgcctgagccccccccccctgagccccctggccctggcccccagcagcgccatcagagaccagagaaccgccaccaagtgggtggccatgatcccccagaagaaccagaccgccagcggcgacagcctggacgtgagagtgcccagcaagccctgcctgatgaagcagaagaagagcccctgcctgtgggagatccagaagctgcaggagcagagagagaagagaagaagactgcagcaggagatcagagccagaagagccctggacgtgaacaccagaaaccccaactacgagatcatgcacatgatcgaggagtacagaagacacctggacagcagcaagatcagcgtgctggagcccccccaggagcacagaatctgcgtgtgcgtgagaaagagacccctgaaccagagagagaccaccctgaaggaccacgccttcgacgacaaggccagcaacgagctggtgtaccagttcaccgcccagcccctggtggagagcatcttcagaaagggcatggccacctgcttcgcctacggccagaccggcagcggcaagacctacaccatgggcggcgacttcagcggcaccgcccaggactgcagcaagggcatctacgccctggtggcccaggacgtgttcctgctgctgagaaacagcacctacgagaagctggacctgaaggtgtacggcaccttcttcgagatctacggcggcaaggtgtacgacctgctgaactggaagaagaagctgcaggtgctggaggacggcaaccagcagatccaggtggtgggcctgcaggagaaggaggtgtgctgcgtggaggaggtgctgaacctggtggagatcggcaacagctgcagaaccagcagacagacccccgtgaacgcccacagcagcagaagccacgccgtgttccagatcatcctgaagagcggcagaatcatgcacggcaagttcagcctggtggacctggccggcaacgagagaggcgccgacaccaccaaggccagcagaaagagacagctggagggcgccgagatcaacaagagcctgctggccctgaaggagtgcatcctggccctgggccagaacaagccccacacccccttcagagccagcaagctgaccctggtgctgagagacagcttcatcggccagaacagcagcacctgcatgatcgccaccatcagccccggcatgaccagctgcgagaacaccctgaacaccctgagatacgccaacagagtgaagaagctgaacgtggacgtgagaccctaccacagaggccactaccccatcggccacgaggcccccagaatgctgaagagccacatcggcaacagcgagatgagcctgcagagagacgagttcatcaagatcccctacgtgcagagcgaggagcagaaggagatcgaggaggtggagaccctgcccaccctgctgggcaaggacaccaccatcagcggcaagggcagcagccagtggctggagaacatccaggagagagccggcggcgtgcaccacgacatcgacttctgcatcgccagaagcctgagcatcctggagcagaagatcgacgccctgaccgagatccagaagaagctgaagctgctgctggccgacctgcacgtgaagagcaaggtggagtag

SEQ ID NO: 11832 - DNA, 375 bp, Artificial Sequence
  Description of Artificial Sequence: Synthetic coding sequence
tgaagcgcctgcatcggcaactgcagcaccgccctggaggagctgaccgacgacatgaccgaggacttcctgcccgtgctgagagagtacatcctgtacagcgacagcatgaagagcgtgctgaagaagagagaccaggtgcaggccgagtacgaggccaagctggaggccgtggccctgagaaaggaggacagacccaaggtgcccgccgacgtggagaagtgccaggacagaatggagtgcttcaacgccgacctgaaggccgacatggagagatggcagaacaacaagagacaggacttcagacagctgctgatgggcatggccgacaagaacatccagtactacgagaagagcatcgccgacctgaagtag

SEQ ID NO: 11833 - DNA, 747 bp, Artificial Sequence; identical to SEQ ID NO: 11765
  Description of Artificial Sequence: Synthetic coding sequence

SEQ ID NO: 11834 - DNA, 1125 bp, Artificial Sequence
  Description of Artificial Sequence: Synthetic coding sequence
atggacttcaacatgaagaagctggccagcgacgccggcatcttcttcaccagagccgtgcagttcaccgaggagaagttcggccaggccgagaagaccgagctggacgcccacttcgagaacctgctggccagagccgacagcaccaagaactggaccgagaagatcctgagacagaccgaggtgctgctgcagcccaaccccagcgccagagtggaggagttcctgtacgagaagctggacagaaaggtgcccagcagagtgaccaacggcgagctgctggcccagtacatggccgacgccgccagcgagctgggccccaccaccccctacggcaagaccctgatcaaggtggccgaggccgagaagcagctgggcgccgccgagagagacttcatccacaccgccagcatcagcttcctgacccccctgagaaacttcctggagggcgactggaagaccatcagcaaggagagaagactgctgcagaacagaagactggacctggacgcctgcaaggccagactgaagaaggccaaggccgccgaggccaaggccaccctgtggaacgacgaggtggacaaggccgagcaggagctgagagtggcccagaccgagttcgacagacaggccgaggtgaccagactgctgctggagggcatcagcagcacccacgtgaaccacctgagatgcctgcacgagttcgtgaagagccagaccacctactacgcccagtgctacagacacatgctggacctgcagaagcagctgggcagattccccggcaccttcgtgggcaccaccgagcccgccagcccccccctgagcagcaccagccccaccaccgccgccgccaccatgcccgtggtgcccagcgtggccagcctggccccccccggcgaggccagcctgtgcctggaggaggtggccccccccgccagcggcaccagaaaggccagagtgctgtacgactacgaggccgccgacagcagcgagctggccctgctggccgacgagctgatcaccgtgtacagcctgcccggcatggaccccgactggctgatcggcgagagaggcaacaagaagggcaaggtgcccgtgacctacctggagctgctgagctag

SEQ ID NO: 11835 - DNA, 1188 bp, Artificial Sequence; identical to SEQ ID NO: 11022
  Description of Artificial Sequence: Synthetic coding sequence

SEQ ID NO: 11836 - DNA, 1131 bp, Artificial Sequence
  Description of Artificial Sequence: Synthetic coding sequence
atggagaagaagaagatggtgacccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcatccccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacggcggctacgccgcctacagatacgcccagcccgccaccgccaccgccgccaccgccgccgccgccgccgccgccgcctacagcgacggctacggcagagtgtacaccgccgacccctaccacgccctggcccccgccgccagctacggcgtgggcgccgtggccagcctgtacagaggcggctacagcagattcgccccctactag

SEQ ID NO: 11837 - DNA, 1638 bp, Artificial Sequence
  Description of Artificial Sequence: Synthetic coding sequence
atgggcaccccctggagaccccccagcagaagaccctggagatggcccaccggctgcaccagaaagacctgcggcccccccacctggagcctggagagaaccagaagctggctgagcggcagagagcacagcgtgttcaccggcgtggccatcgtgcactgcagcagcaaggaccaccagctggacaccagagtgagcgagttctacgaggagaccaaggtgaagttcagcgagctgagcgaggagctgctgtgggagtacgtgcacagcggcgagcccatggacaaggccggcggctacggcatccaggccctgggcggcatgctggtggagagcgtgcacggcgacttcctgaacgtggtgggcttccccctgaaccacttctgcaagcagctggtgaagctgtactacccccccagacccgaggacctgagaagaagcgtgaagcacgacagcatccccgccgccgacaccttcgaggacctgagcgacgtggagggcggcggcagcgagcccacccagagagacgccggcagcagagacgagaaggccgaggccggcgaggccggccaggccaccgccgaggccgagtgccacagaaccagagagaccctgccccccttccccaccagactgctggagctgatcgagggcttcatgctgagcaagggcctgctgaccgcctgcaagctgaaggtgttcgacctgctgaaggacgaggccccccagaaggccgccgacatcgccagcaaggtggacgccagcgcctgcggcatggagagactgctggacatctgcgccgccatgggcctgctggagaagaccgagcagggctacagcaacaccgagaccgccaacgtgtacctggccagcgacggcgagtacagcctgcacggcttcatcatgcacaacaacgacctgacctggaacctgttcacctacctggagttcgccatcagagagggcaccaaccagcaccacagagccctgggcaagaaggccgaggacctgttccaggacgcctactaccagagccccgagaccagactgagattcatgagagccatgcacggcatgaccaagctgaccgcctgccaggtggccaccgccttcaacctgagcagattcagcagcgcctgcgacgtgggcggctgcaccggcgccctggccagagagctggccagagagtaccccagaatgcaggtgaccgtgttcgacctgcccgacatcatcgagctggccgcccacttccagccccccggcccccaggccgtgcagatccacttcgccgccggcgacttcttcagagaccccctgcccagcgccgagctgtacgtgctgtgcagaatcctgcacgactggcccgacgacaaggtgcacaagctgctgagcagagtggccgagagctgcaagcccggcgccggcctgctgctggtggagaccctgctggacgaggagaagagagtggcccagagagccctgatgcagagcctgaacatgctggtgcagaccgagggcaaggagagaagcctgggcgagtaccagtgcctgctggagctgcacggcttccaccaggtgcaggtggtgcacctgggcggcgtgctggacgccatcctggccaccaaggtggccccctag

SEQ ID NO: 11838 - DNA, 621 bp, Artificial Sequence
  Description of Artificial Sequence: Synthetic coding sequence
atgagccagaccagcctgaagcagaagaagaacgagcccggcatgagaagcagcaaggagagcctggaggccgagaagagaaaggagagcgacaagaccggcgtgagactgagcaaccagatgagaagagccgtgaaccccaaccacagcctgagatgctgccccttccagggccacagcagctgcagaagatgcctgtgcgccgccgagggcaccgccctgggcccctgccacaccatcagaatctacatccacatgtgcctgctgtgggagcagggccagcagatcaccatgatgagagtgagcagagaccacaccaccgacagcggcggcgagccccagaccacctggggcagccaggagagcagcctgagaaagaccgacagcagaggctacctggtgagaagccagtggagcagaatcagcagaagccccagcaccaaggcccccagcatcgacgagcccagaagcagaaacaccagcgccaagctgcccagcagcagcaccagcagcagaacccccagcaccagccccagcctgcacgacagcagccccccccccctgagcggccagcccagcctgcagccccccgccagcccccagctgcccagaagcctgtag

SEQ ID NO: 11839 - DNA, 414 bp, Artificial Sequence
  Description of Artificial Sequence: Synthetic coding sequence
atggcccccggcacccccaagagcctgctgctgagcgccagcatcaagagagagggcgagagccccaccgccagcccccacagcagcgccaccgacgacctgcaccacagcgacagataccagaccttcctgagagtgagagccaacagacagaccagactgaacgccagaatcggcaagatgaagagaagaaagcaggacgagggccaggtgtgccccctgtgcaacagacccctggccggcagcgagcaggagatgagcagacacgtggagcactgcctgagcaagagagagggcagctgcatggccgaggacgacgccgtggacatcgagcacgagaacaacaacagattcgaggagtacgagtggtgcggccagaagagaatcagagccaccaccctgctggagggctag

SEQ ID NO: 11840 - DNA, 570 bp, Artificial Sequence
  Description of Artificial Sequence: Synthetic coding sequence
atgatccccatctgccccgtggtgagcttcacctacgtgcccagcagactgggcgaggacgccaagatggccaccggcaactacttcggcttcacccacagcggcgccgccgccgccgccgccgccgcccagtacagccagcagcccgccagcggcgtggcctacagccaccccaccaccgtggccagctacaccgtgcaccaggcccccgtggccgcccacaccgtgaccgccgcctacgcccccgccgccgccaccgtggccgtggccagacccgcccccgtggccgtggccgccgccgccaccgccgccgcctacggcggctaccccaccgcccacaccgccaccgactacggctacacccagagacagcaggaggccccccccccccccccccccgccaccacccagaactaccaggacagctacagctacgtgagaagcaccgcccccgccgtggcctacgacagcaagcagtactaccagcagcccgccgccaccgaggccggcagcagcagcagctgctgctgctgctgcaacagctgcctggacagagaccacctgtactag

SEQ ID NO: 11841 - DNA, 387 bp, Artificial Sequence
  Description of Artificial Sequence: Synthetic coding sequence
atggacgccgacagcgacgtggccctggacatcctgatcaccaacgtggtgtgcgtgttcagaaccagatgccacctgaacctgagaaagatcgccctggagggcgccaacgtgatctacaagagagacgtgggcaaggtgctgatgaagctgagaaagcccagaatcaccgccaccatctggagcagcggcaagatcatctgcaccggcgccaccagcgaggaggaggccaagttcggcgccagaagactggccagaagcctgcagaagctgggcttccaggtgatcttcaccgacttcaaggtggtgaacgtgctggccgtgtgcaacatgcccttcgagatcagactgcccgagttcaccaagaacaacagaccccacgcctag

SEQ ID NO: 11842 - DNA, 381 bp, Artificial Sequence
  Description of Artificial Sequence: Synthetic coding sequence
atgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgcccttccagcaccacggctacagcggccccaacgagagaacctag

SEQ ID NO: 11843 - DNA, 912 bp, Artificial Sequence
  Description of Artificial Sequence: Synthetic coding sequence
gaggacgagtacatccagagccacaacttcgacagcgccatgaaggtgaccagccagggccagcccagccccgtggagcccagaggccccttctacttctgcagactgctgctggacgacctgggcatgaacagctgggacagaagaaagaacttccacctgctgaagaagaacagcaagctgctgagagagctgaagaacctggacagcagacagtgcagagagacccacaagatcgccgtgttctacatcgccgagggccaggaggacaagtgcagcatcctgagcaacgagagaggcagccaggcctacgaggacttcgtggccggcctgggctgggaggtggacctgagcacccactgcggcttcatgggcggcctgcagagaaacggcagcaccggccagaccgccccctactacgccaccagcaccgtggaggtgatcttccacgtgagcaccagaatgcccagcgacagcgacgacagcctgaccaagaagctgagacacctgggcaacgacgaggtgcacatcgtgtggagcgagcacagcagagactacagaagaggcatcatccccaccgccttcggcgacgtgagcatcatcatctaccccatgaagaaccacatgttcttcatcgccatcaccaagaagcccgaggtgcccttcttcggccccctgttcgacggcgccatcgtgagcggcaagctgctgcccagcctggtgtgcgccacctgcatcaacgccagcagagccgtgaagtgcctgatccccctgtaccagagcttctacgaggagagagccctgtacctggaggccatcatccagaaccacagagaggtgatgaccttcgaggacttcgccgcccaggtgttcagccccagccccagctacagcctgagcggcaccgactag

SEQ ID NO: 11844 - DNA, 2883 bp, Artificial Sequence
  Description of Artificial Sequence: Synthetic coding sequence
atggaggtgcaggtgagccaggccagcctgggcttcgagctgaccagcgtggagaagagcctgagagagtggagcagactgagcagagaggtgatcgcctggctgtgccccagcagccccaacttcatcctgaacttcccccccccccccagcgccagcagcgtgagcatggtgcagctgttcagcagccccttcggctaccagagccccagcggccacagcgaggaggagagagagggcaacatgaagagcgccaagccccaggtgaaccacagccagcacggcgagagccagagagccctgagccccctgcagagcaccctgagcagcgccgccagccccagccaggcctacgagacctacatcgagaacggcctgatctgcctgaagcacaagatcagaaacatcgagaagaagaagctgaagctggaggactacaaggacagactgaagagcggcgagcacctgaaccccgaccagctggaggccgtggagaagtacgaggaggtgctgcacaacctggagttcgccaaggagctgcagaagaccttcagcggcctgagcctggacctgctgaaggcccagaagaaggcccagagaagagagcacatgctgaagctggaggccgagaagaagaagctgagaaccatcctgcaggtgcagtacgtgctgcagaacctgacccaggagcacgtgcagaaggacttcaagggcggcctgaacggcgccgtgtacctgcccagcaaggagctggactacctgatcaagttcagcaagctgacctgccccgagagaaacgagagcctgagcgtggaggaccagatggagcagagcagcctgtacttctgggacctgctggagggcagcgagaaggccgtggtgggcaccacctacaagcacctgaaggacctgctgagcaagctgctgaacagcggctacttcgagagcatccccgtgcccaagaacgccaaggagaaggaggtgcccctggaggaggagatgctgatccagagcgagaagaagacccagctgagcaagaccgagagcgtgaaggagagcgagagcctgatggagttcgcccagcccgagatccagccccaggagttcctgaacagaagatacatgaccgaggtggactacagcaacaagcagggcgaggagcagccctgggaggccgactacgccagaaagcccaacctgcccaagagatgggacatgctgaccgagcccgacggccaggagaagaagcaggagagcttcaagagctgggaggccagcggcaagcaccaggaggtgagcaagcccgccgtgagcctggagcagagaaagcaggacaccagcaagctgagaagcaccctgcccgaggagcagaagaagcaggagatcagcaagagcaagcccagccccagccagtggaagcaggacacccccaagagcaaggccggctacgtgcaggaggagcagaagaagcaggagacccccaagctgtggcccgtgcagctgcagaaggagcaggaccccaagaagcagacccccaagagctggacccccagcatgcagagcgagcagaacaccaccaagagctggaccacccccatgtgcgaggagcaggacagcaagcagcccgagacccccaagagctgggagaacaacgtggagagccagaagcacagcctgaccagccagagccagatcagccccaagagctggggcgtggccaccgccagcctgatccccaacgaccagctgctgcccagaaagctgaacaccgagcccaaggacgtgcccaagcccgtgcaccagcccgtgggcagcagcagcaccctgcccaaggaccccgtgctgagaaaggagaagctgcaggacctgatgacccagatccagggcacctgcaacttcatgcaggagagcgtgctggacttcgacaagcccagcagcgccatccccaccagccagccccccagcgccacccccggcagccccgtggccagcaaggagcagaacctgagcagccagagcgacttcctgcaggagcccctgcaggccaccagcagccccgtgacctgcagcagcaacgcctgcctggtgaccaccgaccaggccagcagcggcagcgagaccgagttcatgaccagcgagacccccgaggccgccatcccccccggcaagcagcccagcagcctggccagccccaacccccccatggccaagggcagcgagcagggcttccagagcccccccgccagcagcagcagcgtgaccatcaacaccgcccccttccaggccatgcagaccgtgttcaacgtgaacgcccccctgccccccagaaaggagcaggagatcaaggagagcccctacagccccggctacaaccagagcttcaccaccgccagcacccagacccccccccagtgccagctgcccagcatccacgtggagcagaccgtgcacagccaggagaccgccaactaccaccccgacggcaccatccaggtgagcaacggcagcctggccttctaccccgcccagaccaacgtgttccccagacccacccagcccttcgtgaacagcagaggcagcgtgagaggctgcaccagaggcggcagactgatcaccaacagctacagaagccccggcggctacaagggcttcgacacctacagaggcctgcccagcatcagcaacggcaactacagccagctgcagttccaggccagagagtacagcggcgccccctacagccagagagacaacttccagcagtgctacaagagaggcggcaccagcggcggccccagagccaacagcagagccaactgcttcatcatgagaaacagcctgctgctgatcaagcagcagggcggcgtgatcctgctgagatag

SEQ ID NO: 11845 - DNA, 1746 bp, Artificial Sequence
  Description of Artificial Sequence: Synthetic coding sequence
aacaacaacggcacctacgacggcatcgcctacttcgagtgcaaggagaagcacggcatcttcgcccccccccagaagatcagccacatccccgagaacttcgacgactacgtggacatcaacgaggacgaggactgctacagcgacgagagataccagtgctacaaccaggagcagaacgacaccgagggccccaaggacagagagaaggacgtgagcgagtacttctacgagaagagcctgcccagcgtgaacgacatcgaggccagcgtgaacagaagcagaagcctgaagatcgagaccgacaacgtgcaggacatcagcggcgtgctggaggcccacgtgcaccagcagagcagcgtggacagccagatcagcagcaaggagaacaaggacctgatcagcgacgccaccgagaaggtgagcatcgccgccgaggacgacaccctggacaacaccttcagcgaggagctggagaagcagcagcagttcaccgaggaggaggacaacctgtacgccgaggccagcgagaagctgtgcacccccctgctggacctgctgaccagagagaagaaccagctggaggcccagctgaagagcagcctgaacgaggagaagaagagcaagcagcagctggagaagatcagcctgctgaccgacagcctgctgaaggtgttcgtgaaggacaccgtgaaccagctgcagcagatcaagaagaccagagacgagaagatccagctgagcaaccaggagctgctgggcgacgaccagaagaaggtgaccccccaggacctgagccagaacgtggaggagcagagccccagcatcagcggctgcttcctgagcagcgagctggaggacgagaaggaggagatcagcagccccgacatgtgccccagacccgagagccccgtgttcggcgccagcggccaggaggagctggccaagagactggccgagctggagctgagcagagagttcctgagcgccctgggcgacgaccaggactggttcgacgaggacttcggcctgagcagcagccacaagatccagaagaacaaggccgaggagaccatcgtgcccctgatggccgagcccaagagagtgacccagcagccctgcgagaccctgctggccgtgccccacaccgccgaggaggtggagatcctggtgcacaacgccgccgaggagctgtggaagtggaaggagctgggccacgacctgcacagcatcagcatccccaccaagctgctgggctgcgccagcaagggcctggacatcgagagcaccagcaagagagtgtacaagcaggccgtgttcgacctgaccaaggagatcttcgaggagatcttcgccgaggaccccaacctgaaccagcccgtgtggatgaagccctgcagaatcaacagcagctacttcagaagagtgaagaaccccaacaacctggacgagatcaagagcttcatcgccagcgaggtgctgaagctgttcagcctgaagaaggagcccaaccacaagaccgactggcagaagatgatgaagttcggcagaaagaagagagacagagtggaccacatcctggtgcaggagctgcacgaggaggaggcccagtgggtgaactacgacgaggacgagctgtgcgtgaagatgcagctggccgacggcatcttcgagaccctgatcaaggacaccatcgacgtgctgaaccagatcagcgagaagcagggcagaatgctgctggtgtag

SEQ ID NO: 11846 - DNA, 345 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacccagatcctggagagactgtgcagattcgactacctgaccgtggtgatcctgggcgaggacgtgatcctgaacgagcccgtggagaactggcccagctgccactgcctgatcagcttccacagcaagtag

SEQ ID NO: 11847 - DNA, 918 bp, Artificial Sequence
  Description of Artificial Sequence: Synthetic coding sequence
atggaggccgagagcttcccctgcctgctgagacccttcttcaaggagagaagctgcgccctgagacccgccttccacaccgccaagtgcgagaagctgcagaaggagaaggaggagctggagagaagattcgaggccgagatggccagactgcaggaggagcacggcgaccagctgctgagcatcagatgccagcaccaggagcaggtggaggacctgaccgccagccacgacgccgccctgctggagatggagaacaaccacaccgtggccatcaccatcctgcaggacgaccacgaccacaaggtgcaggagctgatgagcacccacgagctggagaagaaggagctggaggagaacttcgagaagctgagactgagcctgcaggaccaggtggacaccctgaccttccagagccagagcctgagagacagagccagaagattcgaggaggccctgagaaagaacaccgaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaacgaggacctgaaggccagaatcgaccagaacaccgtggtgaccagacagctgagcgaggagaacgccaacctgcaggagtacgtggagaaggagacccaggagaagaagagactgagcagaaccaacgaggagctgctgtggaagctgcagaccggcgaccccaccagccccatcaagctgagccccaccagccccgtgtacagaggcagcagcagcggccccagcagccccgccagagtgagcaccacccccagatag

SEQ ID NO: 11848 - DNA, 2319 bp, Artificial Sequence
  Description of Artificial Sequence: Synthetic coding sequence
atgcaggagctggaggagctgagaaagcagctgggcagcgtggccaccggcagcaccctgcagcagagcctggagctgaagagaaagatgctgagagacaagcagaacaagaagaacagcggccagcacctgcccatcttccccgcctgggtgtacgagagacccgccctgatcggcgacttcctgatcggcgccggcatcagcaccgacaccgccctgcccatcggcaccctgcccctggccagccaggagagcgccgtggtggaggacctgctgtacgtgctggtgggcgtggacggcagatacgtgagcgcccagcccctggccggcagacagagcagaaccttcctggtggaccccaacctggacctgagcatcagagagctggtgcacagaatcctgcccgtggccgccagctacagcgccgtgaccagattcatcgaggagaagagcagcttcgagtacggccaggtgaaccacgccctggccgccgccatgagaaccctggtgaaggagcacctgatcctggtgagccagctggagcagctgcacagacagggcctgctgagcctgcagaagctgtggttctacatccagcccgccatgagaaccatggacatcctggccagcctggccaccagcgtggacaagggcgagtgcctgggcggcagcaccctgagcctgctgcacgacagaagcttcagctacaccggcgacagccaggcccaggagctgtgcctgtacctgaccaaggccgccagcgccccctacttcgaggtgctggagaagtggatctacagaggcatcatccacgacccctacagcgagttcatggtggaggagcacgagctgagaaaggagagaatccaggaggactacaacgacaagtactgggaccagagatacaccatcgtgcagcagcagatccccagcttcctgcagaagatggccgacaagatcctgagcaccggcaagtacctgaacgtggtgagagagtgcggccacgacgtgacctgccccgtggccaaggagatcatctacaccctgaaggagagagcctacgtggagcagatcgagaaggccttcaactacgccagcaaggtgctgctggacttcctgatggaggagaaggagctggtggcccacctgagaagcatcaagagatacttcctgatggaccagggcgacttcttcgtgcacttcatggacctggccgaggaggagctgagaaagcccgtggaggacatcaccccccccagactggaggccctgctggagctggccctgagaatgagcaccgccaacaccgaccccttcaaggacgacctgaagatcgacctgatgccccacgacctgatcacccagctgctgagagtgctggccatcgagaccaagcaggagaaggccatggcccacgccgaccccaccgagctggccctgagcggcctggaggccttcagcttcgactacatcgtgaagtggcccctgagcctgatcatcaacagaaaggccctgaccagataccagatgctgttcagacacatgttctactgcaagcacgtggagagacagctgtgcagcgtgtggatcagcaacaagaccgccaagcagcacagcctgcacagcgcccagtggttcgccggcgccttcaccctgagacagagaatgctgaacttcgtgcagaacatccagtactacatgatgttcgaggtgatggagcccacctggcacatcctggagaagaacctgaagagcgccagcaacatcgacgacgtgctgggccaccacaccggcttcctggacacctgcctgaaggactgcatgctgaccaaccccgagctgctgaaggtgttcagcaagctgatgagcgtgtgcgtgatgttcaccaactgcatgcagaagttcacccagagcatgaagctggacggcgagctgggcggccagaccctggagcacagcaccgtgctgggcctgcccgccggcgccgaggagagagccagaaaggagctggccagaaagcacctggccgagcacgccgacaccgtgcagctggtgagcggcttcgaggccaccatcaacaagttcgacaagaacttcagcgcccacctgctggacctgctggccagactgagcatctacagcaccagcgactgcgagcacggcatggccagcgtgatcagcagactggacttcaacggcttctacaccgagagactggagagactgagcgccgagagaagccagaaggccaccccccaggtgcccgtgctgagaggcccccccgcccccgcccccagagtggccgtgaccgcccagtag

SEQ ID NO: 11849 - DNA, 1203 bp, Artificial Sequence
  Description of Artificial Sequence: Synthetic coding sequence
atggacttcaacatgaagaagctggccagcgacgccggcatcttcttcaccagagccgtgcagttcaccgaggagaagttcggccaggccgagaagaccgagctggacgcccacttcgagaacctgctggccagagccgacagcaccaagaactggaccgagaagatcctgagacagaccgaggtgctgctgcagcccaaccccagcgccagagtggaggagttcctgtacgagaagctggacagaaaggtgcccagcagagtgaccaacggcgagctgctggcccagtacatggccgacgccgccagcgagctgggccccaccaccccctacggcaagaccctgatcaaggtggccgaggccgagaagcagctgggcgccgccgagagagacttcatccacaccgccagcatcagcttcctgacccccctgagaaacttcctggagggcgactggaagaccatcagcaaggagagaagactgctgcagaacagaagactggacctggacgcctgcaaggccagactgaagaaggccaaggccgccgaggccaaggccaccaccgtgcccgacttccaggagaccagacccagaaactacatcctgagcgccagcgccagcgccctgtggaacgacgaggtggacaaggccgagcaggagctgagagtggcccagaccgagttcgacagacaggccgaggtgaccagactgctgctggagggcatcagcagcacccacgtgaaccacctgagatgcctgcacgagttcgtgaagagccagaccacctactacgcccagtgctacagacacatgctggacctgcagaagcagctgggcagcagccagggcgccatcttccccggcaccttcgtgggcaccaccgagcccgccagcccccccctgagcagcaccagccccaccaccgccgccgccaccatgcccgtggtgcccagcgtggccagcctggccccccccggcgaggccagcctgtgcctggaggaggtggccccccccgccagcggcaccagaaaggccagagtgctgtacgactacgaggccgccgacagcagcgagctggccctgctggccgacgagctgatcaccgtgtacagcctgcccggcatggaccccgactggctgatcggcgagagaggcaacaagaagggcaaggtgcccgtgacctacctggagctgctgagctag

SEQ ID NO: 11850 - DNA, 1827 bp, Artificial Sequence
  Description of Artificial Sequence: Synthetic coding sequence
atgcccttctggcccatcagatgcctgaagagaagcagaagaatgcccagaggcggcgccggcgagagagagaaggtgcccgccaaccccgaggccctgctgctgatggccagcagccagagagacatggaggactgggtgcaggccatcagaagagtgatctgggcccccctgggcggcggcatcttcggccagagactggaggagaccgtgcaccacgagagaaagtacggccccagactggcccccctgctggtggagcagtgcgtggacttcatcagagagagaggcctgaccgaggagggcctgttcagaatgcccggccaggccaacctggtgagagacctgcaggacagcttcgactgcggcgagaagcccctgttcgacagcaccaccgacgtgcacaccgtggccagcctgctgaagctgtacctgagagagctgcccgagcccgtggtgcccttcgccagatacgaggacttcctgagctgcgcccagctgctgaccaaggacgagggcgagggcaccctggagctggccaagcaggtgagcaacctgccccaggccaactacaacctgctgagatacatctgcaagttcctggacgaggtgcaggcctacagcaacgtgaacaagatgagcgtgcagaacctggccaccgtgttcggccccaacatcctgagaccccaggtggaggaccccgtgaccatcatggagggcaccagcctggtgcagcacctgatgaccgtgctgatcagaaagcacagccagctgttcaccgcccccgtgcccgagggccccaccagccccagaggcggcctgcagtgcgccgtgggctggggcagcgaggaggtgaccagagacagccagggcgagcccggcggccccggcctgcccgcccacagaaccagcagcctggacggcgccgccgtggccgtgctgagcagaaccgcccccaccggccccggcagcagatgcagccccggcaagaaggtgcagaccctgcccagctggaagagcagcttcagacagcccagaagcctgagcggcagccccaagggcggcggcagcagcctggaggtgcccatcatcagcagcggcggcaactggctgatgaacggcctgagcagcctgagaggccacagaagagccagcagcggcgacagactgaaggacagcggcagcgtgcagagactgagcacctacgacaacgtgcccgcccccggcctggtgcccggcatccccagcgtggccagcatggcctggagcggcgccagcagcagcgagagcagcgtgggcggcagcctgagcagctgcaccgcctgcagagccagcgacagcagcgccagaagcagcctgcacaccgactgggccctggagcccagccccctgcccagcagcagcgaggaccccaagagcctggacctggaccacagcatggacgaggccggcgccggcgccagcaacagcgagcccagcgagcccgacagccccaccagagagcacgccagaagaagcgaggccctgcagggcctggtgaccgagctgagagccgagctgtgcagacagagaaccgagtacgagagaagcgtgaagagaatcgaggagggcagcgccgacctgagaaagagaatgagcagactggaggaggagctggaccaggagaagaagaagtacatcatgctggagatcaagctgagaaacagcgagagagccagagaggacgccgagagaagaaaccagctgctgcagagagagatggaggagttcttcagcaccctgggcagcctgaccgtgggcgccaagggcgccagagcccccaagtag

SEQ ID NO: 11851 - DNA, 708 bp, Artificial Sequence
  Description of Artificial Sequence: Synthetic coding sequence
atgttcagcgaggagtgcatcatggacgtgatcggctgcctggagtacgaccccgccctgagccagcccagaaagcacagagagttcctgaccaagaccgccaagttcaaggaggtgatccccatcagcgaccccgagctgaagcagaagatccaccagacctacagagtgcagtacatccaggacatggtgctgcccacccccagcgtgttcgaggagaacatgctgagcaccctgcacagcttcatcttcttcaacaaggtggagatcgtgggcatgctgcaggaggacgagaagttcctgaccgacctgttcgcccagctgaccgacgaggccaccgacgaggagaagagacaggagctggtgaacttcctgaaggagttctgcgccttcagccagaccctgcagccccagaacagagacgccttcttcaagaccctgagcaacatgggcatcctgcccgccctggaggtgatcctgggcatggacgacacccaggtgagaagcgccgccaccgacatcttcagctacctggtggagtacaaccccagcatggtgagagagttcgtgatgcaggaggcccagcagaacgacgacgtgagcaagaagctgaccgagcagaagatcaccagcaaggtgaacatcatctgcaccaacagcaagtacctgtacatcggcagctacaactgcttctactacagcttctag

SEQ ID NO: 11852 - DNA, 3513 bp, Artificial Sequence
  Description of Artificial Sequence: Synthetic coding sequence
gtgtacaagggcagacacgtgaagaccggccagctggccgccatcaaggtgatggacgtgaccgaggacgaggaggaggagatcaagctggagatcaacatgctgaagaagtacagccaccacagaaacatcgccacctactacggcgccttcatcaagaagagcccccccggccacgacgaccagctgtggctggtgatggagttctgcggcgccggcagcatcaccgacctggtgaagaacaccaagggcaacaccctgaaggaggactggatcgcctacatcagcagagagatcctgagaggcctggcccacctgcacatccaccacgtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacctgtggagctgcggcatcaccgccatcgagatggccgagggcgccccccccctgtgcgacatgcaccccatgagagccctgttcctgatccccagaaaccccccccccagactgaagagcaagaagtggagcaagaagttcttcagcttcatcgagggctgcctggtgaagaactacatgcagagacccagcaccgagcagctgctgaagcaccccttcatcagagaccagcccaacgagagacaggtgagaatccagctgaaggaccacatcgacagaaccagaaagaagagaggcgagaaggacgagaccgagtacgagtacagcggcagcgaggaggaggaggaggaggtgcccgagcaggagggcgagcccagcagcatcgtgaacgtgcccggcgagagcaccctgagaagagacttcctgagactgcagcaggagaacaaggagagaagcgaggccctgagaagacagcagctgctgcaggagcagcagctgagagagcaggaggagtacaagagacagctgctggccgagagacagaagagaatcgagcagcagaaggagcagagaagaagactggaggagcagcagagaagagagagagaggccagaagacagcaggagagagagcagagaagaagagagcaggaggagaagagaagactggaggagctggagagaagaagaaaggaggaggaggagagaagaagagccgaggaggagaagagaagagtggagagagagcaggagtacatcagaagacagctggaggaggagcagagacacctggaggtgctgcagcagcagctgctgcaggagcaggccatgctgctgcacgaccacagaagaccccacccccagcacagccagcagcccccccccccccagcaggagagaagcaagcccagcttccacgcccccgagcccaaggcccactacgagcccgccgacagagccagagaggtggaggacagattcagaaagaccaaccacagcagccccgaggcccagagcaagcagaccggcagagtgctggagccccccgtgcccagcagaagcgagagcttcagcaacggcaacagcgagagcgtgcaccccgccctgcagagacccgccgagccccaggtgcccgtgagaaccaccagcagaagccccgtgctgagcagaagagacagccccctgcagggcagcggccagcagaacagccaggccggccagagaaacagcaccagcatcgagcccagactgctgtgggagagagtggagaagctggtgcccagacccggcagcggcagcagcagcggcagcagcaacagcggcagccagcccggcagccaccccggcagccagagcggcagcggcgagagattcagagtgagaagcagcagcaagagcgagggcagccccagccagagactggagaacgccgtgaagaagcccgaggacaagaaggaggtgttcagacccctgaagcccgccgacctgaccgccctggccaaggagctgagagccgtggaggacgtgagacccccccacaaggtgaccgactacagcagcagcagcgaggagagcggcaccaccgacgaggaggacgacgacgtggagcaggagggcgccgacgagagcaccagcggccccgaggacaccagagccgccagcagcctgaacctgagcaacggcgagaccgagagcgtgaagaccatgatcgtgcacgacgacgtggagagcgagcccgccatgacccccagcaaggagggcaccctgatcgtgagacagacccagagcgccagcagcaccctgcagaagcacaagagcagcagcagcttcacccccttcatcgaccccagactgctgcagatcagccccagcagcggcaccaccgtgaccagcgtggtgggcttcagctgcgacggcatgagacccgaggccatcagacaggaccccaccagaaagggcagcgtggtgaacgtgaaccccaccaacaccagaccccagagcgacacccccgagatcagaaagtacaagaagagattcaacagcgagatcctgtgcgccgccctgtggggcgtgaacctgctggtgggcaccgagagcggcctgatgctgctggacagaagcggccagggcaaggtgtaccccctgatcaacagaagaagattccagcagatggacgtgctggagggcctgaacgtgctggtgaccatcagcggcaagaaggacaagctgagagtgtactacctgagctggctgagaaacaagatcctgcacaacgaccccgaggtggagaagaagcagggctggaccaccgtgggcgacctggagggctgcgtgcactacaaggtggtgaagtacgagagaatcaagttcctggtgatcgccctgaagagcagcgtggaggtgtacgcctgggcccccaagccctaccacaagttcatggccttcaagagcttcggcgagctggtgcacaagcccctgctggtggacctgaccgtggaggagggccagagactgaaggtgatctacggcagctgcgccggcttccacgccgtggacgtggacagcggcagcgtgtacgacatctacctgcccacccacatccagtgcagcatcaagccccacgccatcatcatcctgcccaacaccgacggcatggagctgctggtgtgctacgaggacgagggcgtgtacgtgaacacctacggcagaatcaccaaggacgtggtgctgcagtggggcgagatgcccaccagcgtggcctacatcagaagcaaccagaccatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgggcagaaccagcctgctgagctggtag

SEQ ID NO: 11853 - DNA, 1476 bp, Artificial Sequence
  Description of Artificial Sequence: Synthetic coding sequence
gtgatcatccacagagtgctggagaagcaggaggtggaggtgttctaccccgacttcggcaacatcggcatcgtgcagaagagcagcctgagattcctgaagtgctgctacaccaagctgcccgcccaggccatcccctgcagcctggcctgggtgagacccgtggaggagcactggaccagcaaggccatcctgcagttccagaagctgtgcggcctgaagcccctggtgggcgtggtggacgagtacgtggacggcatcctgaacatcttcctgtgcgacaccagcagcaacgaggacgtgtacttccaccacgtgctgagaaccgagggccacgccatcgtgtgcagagagaacatcagcagcaagggcttcagcgagctgaaccccctggccctgtacaccaccagcagcggcggccccgaggacatcgtgctgaccgagctgggctaccccagccagcagcactacttcaacgaggacagaaagatcagcccccagagcaaggagagcgagctgagaatcctgcaggacatcaacgacgagaagagcctgagccacctgaagagcgagagcaaggagcccctgaaggacagcgagttcgagagcctgaagacctgcaacaagagcttcgaggaggaccccaagtggagcaaccccgagcccaacgacctgaaggaggagaacgaggacgagatccccaccggcatgccctgcctggagagcgtgaccatcggcgacgacatctgggacgagaactggctgcccctgcaggccaagatgggcaagggcggcgacgccgccagccacctgttcaccgccagcctgggcggcaagaaccagtacagcagctgcaaggagatgccccagaaggactggtgcttcagcacccccaaggacacctgggacgacagctggcagcccagcggcctggtgaacggcaccaaggtggaggtgcacaagcccgaggtgctgggcgcccaggagaagaacaccggcaccaacagaacccagaagcagctggacatcaacggcagcagcgacagcagcaccctgcccaagctggaggagttctgcaccagcctgacccagagcgagcagagcgccgacggcagccagagcgagcccaacaacagccagacccagcccaagcagatccagctgagcaccgccgccccctgcagcaccaccgccgtggacgacagcgccgagaagcccagcggcagcgtggagagcagccccgagatcctgaagaacgaggacttcagcagcagcagagccatcaccctgtacaaggacaagagacaggagagcgtggaccagctgagcctgatcctgagctacgagtgccagatcagccagaagctgtacatccccagaagcaccgccaccgccgccctgggcgccgccgccagactggccaccagcagaagcctgctgcactggtaccccagcgtgaagagaatggaggcctag

SEQ ID NO: 11854 - DNA, 426 bp, Artificial Sequence
  Description of Artificial Sequence: Synthetic coding sequence
atgcccaccaccagcagacccgccctggacgtgaagggcggcaccagccccgccaaggaggacgccaaccaggagatgagcagcgtggcctacagcaacctggccgtgaaggacagaaaggccgtggccatcctgcactaccccggcgtggccagcaacggcaccaaggccagcggcgcccccaccagcagcagcggcagccccatcggcagccccaccaccaccccccccaccaagccccccagcttcaacctgcaccccgccccccacctgctggccagcatgcacctgcagaagctgaacagccagtaccagggcatggccgccgccacccccggccagcccggcgaggccggccccctgcagaactgggacttcggcgcccaggccggcggcgccgagagcctgagccccagcgccggctag

SEQ ID NO: 11855 - DNA, 1188 bp, Artificial Sequence; identical to SEQ ID NO: 11022
  Description of Artificial Sequence: Synthetic coding sequence

SEQ ID NO: 11856 - DNA, 1344 bp, Artificial Sequence
  Description of Artificial Sequence: Synthetic coding sequence
atggccaccgacagctgggccctggccgtggacgagcaggaggccgccgtgaagagcatgaccaacctgcagatcaaggaggagaaggtgaaggccgacaccaacggcatcatcaagaccagcaccaccgccgagaagaccgacgaggaggagaaggaggacagagccgcccagagcctgctgaacaagctgatcagaagcaacctggtggacaacaccaaccaggtggaggtgctgcagagagaccccaacagccccctgtacagcgtgaagagcttcgaggagctgagactgccccagaacctgatcgcccagagccagagcggcaccggcaagaccgccgccttcgtgctggccatgctgagcagagtggagcccagcgacagatacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 11857 - DNA, 630 bp, Artificial Sequence
  Description of Artificial Sequence: Synthetic coding sequence
atggccagcagcgacctggagcagctgtgcagccacgtgaacgagaagatcggcaacatcaagaagaccctgagcctgagaaactgcggccaggagcccaccctgaagaccgtgctgaacaagatcggcgacgagatcatcgtgatcaacgagctgctgaacaagctggagctggagatccagtaccaggagcagaccaacaacagcctgaaggagctgtgcgagagcctggaggaggactacaaggacatcgagcacctgaaggagaacgtgcccagccacctgccccaggtgaccgtgacccagagctggtacatgaagagcagactgacctacaaccagatcaacgacgtgatcaaggagatcaacaaggccgtgatcagcaagtacaagatcctgcaccagcccaagaagagcatgaacagcgtgaccagaaacctgtaccacagattcatcgacgaggagaccaaggacaccaagggcagatacttcatcgtggaggccgacatcaaggagttcaccaccctgaaggccgacaagaagttccacgtgctgctgaacatcctgagacactgcagaagactgagcgaggtgagaggcggcggcctgaccagatacgtgatcacctag

SEQ ID NO: 11858 - DNA, 1125 bp, Artificial Sequence
  Description of Artificial Sequence: Synthetic coding sequence
atggacagcgtgagaagcggccccttcggccagctgttcagacccgacaacttcatcttcggccagaccggcgccggcaacaactgggccaagggccactacaccgagggcgccgagctggtggacgccgtgctggacgtggtgagaaaggagtgcgagcactgcgactgcctgcagggcttccagctgacccacagcctgggcggcggcaccggcagcggcatgggcaccctgctgatcagcaagatcagagaggagttccccgacagaatcatgaacaccttcagcgtgatgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacgccagaaacatgatggccgcctgcgaccccagacacggcagatacctgaccgtggccaccgtgttcagaggccccatgagcatgaaggaggtggacgagcagatgctggccatccagagcaagaacagcagctacttcgtggagtggatccccaacaacgtgaaggtggccgtgtgcgacatcccccccagaggcctgaagatggccagcaccttcatcggcaacagcaccgccatccaggagctgttcaagagaatcagcgagcagttcagcgccatgttcagaagaaaggccttcctgcactggttcaccggcgagggcatggacgagatggagttcaccgaggccgagagcaacatgaacgacctggtgagcgagtaccagcagtaccaggacgccaccgccaacgacggcgaggaggccttcgaggacgaggaggaggagatcgacggctag

SEQ ID NO: 11859 - DNA, 2289 bp, Artificial Sequence
  Description of Artificial Sequence: Synthetic coding sequence
atggccagcctgctgcaggaccagctgaccaccgaccaggacctgctgctgatgcaggagggcatgcccatgagaaaggtgagaagcaagagctggaagaagctgagatacttcagactgcagaacgacggcatgaccgtgtggcacgccagacaggccagaggcagcgccaagcccagcttcagcatcagcgacgtggagaccatcagaaacggccacgacagcgagctgctgagaagcctggccgaggagctgcccctggagcagggcttcaccatcgtgttccacggcagaagaagcaacctggacctgatggccaacagcgtggaggaggcccagatctggatgagaggcctgcagctgctggtggacctggtgaccagcatggaccaccaggagagactggaccagtggctgagcgactggttccagagaggcgacaagaaccaggacggcaagatgagcttccaggaggtgcagagactgctgcacctgatgaacgtggagatggaccaggagtacgccttcagcctgttccaggccgccgacaccagccagagcggcaccctggagggcgaggagttcgtgcagttctacaaggccctgaccaagagagccgaggtgcaggagctgttcgagagcttcagcgccgacggccagaagctgaccctgctggagttcctggacttcctgcaggaggagcagaaggagagagactgcaccagcgagctggccctggagctgatcgacagatacgagcccagcgacagcggcaagctgagacacgtgctgagcatggacggcttcctgagctacctgtgcagcaaggacggcgacatcttcaaccccgcctgcctgcccatctaccaggacatgacccagcccctgaaccactacttcatctgcagcagccacaacacctacctggtgggcgaccagctgtgcggccagagcagcgtggagggctacatcagagccctgaagagaggctgcagatgcgtggaggtggacgtgtgggacggccccagcggcgagcccgtggtgtaccacggccacaccctgaccagcagaatcctgttcaaggacgtggtggccaccgtggcccagtacgccttccagaccagcgactaccccgtgatcctgagcctggagacccactgcagctgggagcagcagcagaccatggccagacacctgaccgagatcctgggcgagcagctgctgagcaccaccctggacggcgtgctgcccacccagctgcccagccccgaggagctgagaagaaagatcctggtgaagggcaagaagctgaccctggaggaggacctggagtacgaggaggaggaggccgagcccgagctggaggagagcgagctggccctggagagccagttcgagaccgagcccgagccccaggagcagaacctgcagaacaaggacaagaagaagaagagcaagcccatcctgtgccccgccctgagcagcctggtgatctacctgaagagcgtgagcttcagaagcttcacccacagcaaggagcactaccacttctacgagatcagcagcttcagcgagaccaaggccaagagactgatcaaggaggccggcaacgagttcgtgcagcacaacacctggcagctgagcagagtgtaccccagcggcctgagaaccgacagcagcaactacaacccccaggagctgtggaacgccggctgccagatggtggccatgaacatgcagaccgccggcctggagatggacatctgcgacggccacttcagacagaacggcggctgcggctacgtgctgaagcccgacttcctgagagacatccagagcagcttccaccccgagaagcccatcagccccttcaaggcccagaccctgctgatccaggtgatcagcggccagcagctgcccaaggtggacaagaccaaggagggcagcatcgtggaccccctggtgaaggtgcagatcttcggcgtgagactggacaccgccagacaggagaccaactacgtggagaacaacggcttcaacccctactggggccagaccctgtgcttcagagtgctggtgcccgagctggccatgctgagattcgtggtgatggactacgactggaagagcagaaacgacttcatcggccagtacaccctgccctggacctgcatgcagcagggctacagacacatccacctgctgagcaaggacggcatcagcctgagacccgccagcatcttcgtgtacatctgcatccaggagggcctggagggcgacgagagctag

SEQ ID NO: 11860 - DNA, 1461 bp, Artificial Sequence
  Description of Artificial Sequence: Synthetic coding sequence
atggccgagctgcagatgctgctggaggaggagatccccggcggcagaagagccctgttcgacagctacaccaacctggagagagtggccgactactgcgagaacaactacatccagagcgccgacaagcagagagccctggaggagaccaaggcctacaccacccagagcctggccagcgtggcctacctgatcaacaccctggccaacaacgtgctgcagatgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacctggagagacccgtgagatacatcagaaagcccatcgactacaccatcctggacgacatcggccacggcgtgaagtggctgctgagattcaaggtgagcacccagaacatgaagatgggcggcctgcccagaaccaccccccccacccagaagccccccagcccccccatgagcggcaagggcaccctgggcagacacagcccctacagaaccctggagcccgtgagaccccccgtggtgcccaacgactacgtgcccagccccaccagaaacatggcccccagccagcagagccccgtgagaaccgccagcgtgaaccagagaaacagaacctacagcagcagcggcagcagcggcggcagccaccccagcagcagaagcagcagcagagagaacagcggcagcggcagcgtgggcgtgcccatcgccgtgcccacccccagcccccccagcgtgttccccgcccccgccggcagcgccggcaccccccccctgcccgccaccagcgccagcgcccccgcccccctggtgcccgccaccgtgcccagcagcaccgcccccgacgccgccgccggcggcgcccagaccctggccgacggcttcaccagccccaccccccccgtggtgagcagcaccccccccaccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgactag

SEQ ID NO: 11861 - DNA, 2145 bp, Artificial Sequence
  Description of Artificial Sequence: Synthetic coding sequence
atgctgagccccaagatcagacaggccagaagagccagaagcaagagcctggtgatgggcgagcagagcagaagccccggcagaatgccctgcccccacagactgggccccgtgctgaaggccggctggctgaagaagcagagaagcatcatgaagaactggcagcagagatggttcgtgctgagaggcgaccagctgttctactacaaggacaaggacgagatcaagccccagggcttcatcagcctgcagggcacccaggtgaccgagctgccccccggccccgaggaccccggcaagcacctgttcgagatcagccccggcggcgccggcgagagagagaaggtgcccgccaaccccgaggccctgctgctgatggccagcagccagagagacatggaggactgggtgcaggccatcagaagagtgatctgggcccccctgggcggcggcaccgccagaagaagccacgcccaccccctggagcccctgccccccggcatcttcggccagagactggaggagaccgtgcaccacgagagaaagtacggccccagactggcccccctgctggtggagcagtgcgtggacttcatcagagagagaggcctgaccgaggagggcctgttcagaatgcccggccaggccaacctggtgagagacctgcaggacagcttcgactgcggcgagaagcccctgttcgacagcaccaccgacgtgcacaccgtggccagcctgctgaagctgtacctgagagagctgcccgagcccgtggtgcccttcgccagatacgaggacttcctgagctgcgcccagctgctgaccaaggacgagggcgagggcaccctggagctggccaagcaggtgagcaacctgccccaggccaactacaacctgctgagatacatctgcaagttcctggacgaggtgcaggcctacagcaacgtgaacaagatgagcgtgcagaacctggccaccgtgttcggccccaacatcctgagaccccaggtggaggaccccgtgaccatcatggagggcaccagcctggtgcagcacctgatgaccgtgctgatcagaaagcacagccagctgttcaccgcccccgtgcccgagggccccaccagccccagaggcggcctgcagtgcgccgtgggctggggcagcgaggaggtgaccagagacagccagggcgagcccggcggccccggcctgcccgcccacagaaccagcagcctggacggcgccgccgtggccgtgctgagcagaaccgcccccaccggccccggcagcagatgcagccccggcaagaaggtgcagaccctgcccagctggaagagcagcttcagacagcccagaagcctgagcggcagccccaagggcggcggcagcagcctggaggtgcccatcatcagcagcggcggcaactggctgatgaacggcctgagcagcctgagaggccacagaagagccagcagcggcgacagactgaaggacagcggcagcgtgcagagactgagcacctacgacaacgtgcccgcccccggcctggtgcccggcatccccagcgtggccagcatggcctggagcggcgccagcagcagcgagagcagcgtgggcggcagcctgagcagctgcaccgcctgcagagccagcgacagcagcgccagaagcagcctgcacaccgactgggccctggagcccagccccctgcccagcagcagcgaggaccccaagagcctggacctggaccacagcatggacgaggccggcgccggcgccagcaacagcgagcccagcgagcccgacagccccaccagagagcacgccagaagaagcgaggccctgcagggcctggtgaccgagctgagagccgagctgtgcagacagagaaccgagtacgagagaagcgtgaagagaatcgaggagggcagcgccgacctgagaaagagaatgagcagactggaggaggagctggaccaggagaagaagaagtacatcatgctggagatcaagctgagaaacagcgagagagccagagaggacgccgagagaagaaaccagctgctgcagagagagatggaggagttcttcagcaccctgggcagcctgaccgtgggcgccaagggcgccagagcccccaagtag

SEQ ID NO: 11862 - DNA, 381 bp, Artificial Sequence; identical to SEQ ID NO: 11842
  Description of Artificial Sequence: Synthetic coding sequence

SEQ ID NO: 11863 - DNA, 2442 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagagcctggacgaggaggagaagctggagctgcagagaagactggaggcccagaaccaggagagaagaaagagcaagagcggcgccggcaagggcaagctgaccagaagcctggccgtgtgcgaggagagcagcgccagacccggcggcgagagcctgcaggaccaggagagcatccacctgcagctgagcagcttcagcagcctgcaggaggaggacaagagcagaaaggacgacagcgagagagagaaggagaaggacaagaacaaggacaagaccagcgagaagcccaagatcagaatgctgagcaaggactgcagccaggagtacaccgacagcaccggcatcgacctgcacgagttcctgatcaacaccctgaagaacaacagcagagacagaatgatcctgctgaagatggagcaggagatcatcgacttcatcgccgacaacaacaaccactacaagaagttcccccagatgagcagctaccagagaatgctggtgcacagagtggccgcctacttcggcctggaccacaacgtggaccagaccggcaagagcgtgatcatcaacaagaccagcagcaccagaatccccgagcagagattctgcgagcacctgaaggacgagaagggcgaggagagccagaagagattcatcctgaagagagacaacagcagcatcgacaaggaggacaaccagagcgtgtgcagccaggagagcctgttcgtggagaacagcagactgctggaggacagcaacatctgcaacgagacctacaagaagagacagctgttcagaggcaacagagacggcagcggcagaaccagcggcagcagacagagcagcagcgagaacgagctgaagtggagcgaccaccagagagcctggagcagcaccgacagcgacagcagcaacagaaacctgaagcccgccatgaccaagaccgccagcttcggcggcatcaccgtgctgaccagaggcgacagcaccagcagcaccagaagcaccggcaagctgagcaaggccggcagcgagagcagcagcagcgccggcagcagcggcagcctgagcagaacccacccccccctgcagagcacccccctggtgagcggcgtggccgccggcagccccggctgcgtgccctaccccgagaacggcatcggcggccaggtggcccccagcagcaccagctacatcctgctgcccctggaggccgccaccggcatcccccccggcagcatcctgctgaacccccacaccggccagcccttcgtgaaccccgacggcacccccgccatctacaacccccccaccagccagcagcccctgagaagcgccatggtgggccagagccagcagcagcccccccagcagcagcccagcccccagccccagcagcaggtgcagcccccccagccccagatggccggccccctggtgacccagagcgtgcagggcctgcaggccagcagccagagcgtgcagtaccccgccgtgagcttccccccccagcacctgctgcccgtgagccccacccagcacttccccatgagagacgacgtggccacccagttcggccagatgaccctgagcagacagagcagcggcgagacccccgagccccccagcggccccgtgtaccccagcagcctgatgccccagcccgcccagcagcccagctacgtgatcgccagcaccggccagcagctgcccaccggcggcttcagcggcagcggcccccccatcagccagcaggtgctgcagcccccccccagcccccagggcttcgtgcagcagcccccccccgcccagatgcccgtgtactactaccccagcggccagtaccccaccagcaccacccagcagtacagacccatggcccccgtgcagtacaacgcccagagaagccagcagatgccccaggccgcccagcaggccggctaccagcccgtgctgagcggccagcagggcttccagggcctgatcggcgtgcagcagcccccccagagccagaacgtgatcaacaaccagcagggcacccccgtgcagagcgtgatggtgagctaccccaccatgagcagctaccaggtgcccatgacccagggcagccagggcctgccccagcagagctaccagcagcccatcatgctgcccaaccaggccggccagggcagcctgcccgccaccggcatgcccgtgtactgcaacgtgaccccccccaccccccagaacaacctgagactgatcggcccccactgccccagcagcaccgtgcccgtgatgagcgccagctgcagaaccaactgcgccagcatgagcaacgccggctggcaggtgaagttctag

SEQ ID NO: 11864 - DNA, 1467 bp, Artificial Sequence
  Description of Artificial Sequence: Synthetic coding sequence
atgaacggcgccctggaccacagcgaccagcccgaccccgacgccatcaagatgttcgtgggccagatccccagaagctggagcgagaaggagctgaaggagctgttcgagccctacggcgccgtgtaccagatcaacgtgctgagagacagaagccagaaccccccccagagcaagggctgctgcttcgtgaccttctacaccagaaaggccgccctggaggcccagaacgccctgcacaacatcaagaccctgcccggcatgcaccaccccatccagatgaagcccgccgacagcgagaagagcaacgccgtggaggacagaaagctgttcatcggcatggtgagcaagaagtgcaacgagaacgacatcagagtgatgttcagccccttcggccagatcgaggagtgcagaatcctgagaggccccgacggcctgagcagaggctgcgccttcgtgaccttcagcaccagagccatggcccagaacgccatcaaggccatgcaccagagccagaccatggagggctgcagcagccccatcgtggtgaagttcgccgacacccagaaggacaaggagcagagaagactgcagcagcagctggcccagcagatgcagcagctgaacaccgccacctggggcaacctgaccggcctgggcggcctgaccccccagtacctggccctgctgcagcaggccaccagcagcagcaacctgggcgccttcagcggcatccagcagatggccggcatgaacgccctgcagctgcagaacctggccaccctggccgccgccgccgccgccgcccagaccagcgccaccagcaccaacgccaaccccctgagcaccaccagcagcgccctgggcgccctgaccagccccgtggccgccagcacccccaacagcaccgccggcgccgccatgaacagcctgaccagcctgggcaccctgcagggcctggccggcgccaccgtgggcctgaacaacatcaacgccctggccggcaccatcaacagcatggccgccctgaacggcggcctgggcgccaccggcctgaccaacggcaccgccggcaccatggacgccctgacccaggcctacagcggcatccagcagtacgccgccgccgccctgcccaccctgtacagccagagcctgctgcagcagcagagcgccgccggcagccagaaggagggccccgagggcgccaacctgttcatctaccacctgccccaggagttcggcgaccaggacatcctgcagatgttcatgcccttcggcaacgtgatcagcgccaaggtgttcatcgacaagcagaccaacctgagcaagtgcttcggcttcgtgagctacgacaaccccgtgagcgcccaggccgccatccaggccatgaacggcttccagatcggcatgaagagactgaaggtgcagctgaagagaagcaagaacgacagcaagccctactag

SEQ ID NO: 11865 - DNA, 474 bp, Artificial Sequence; identical to SEQ ID NO: 11812
  Description of Artificial Sequence: Synthetic coding sequence

SEQ ID NO: 11866 - DNA, 303 bp, Artificial Sequence
  Description of Artificial Sequence: Synthetic coding sequence
atggccagcgaggacatcgccaagctggccgagaccctggccaagacccaggtggccggcggccagctgagcttcaagggcaagagcctgaagctgaacaccgccgaggacgccaaggacgtgatcaaggagatcgaggacttcgacagcctggaggccctgagactggagggcaacaccgtgggcgtggaggccgccagagtgatcgccaaggccctggagaagaagagcgagctgaagagatgccactggagcgacatgttcaccggcagactgagaaccgagatcccccccgccctgtag

SEQ ID NO: 11867 - DNA, 459 bp, Artificial Sequence
  Description of Artificial Sequence: Synthetic coding sequence
atgagcgtgacctacgacgacagcgtgggcgtggaggtgagcagcgacagcttctgggaggtgggcaactacaagagaaccgtgaagagaatcgacgacggccacagactgtgcagcgacctgatgaactgcctgcacgagagagccagaatcgagaaggcctacgcccagcagctgaccgagtgggccagaagatggagacagctggtggagaagggcccccagtacggcaccgtggagaaggcctggatggccttcatgagcgaggccgagagagtgagcgagctgcacctggaggtgaaggccagcctgatgaacgacgacttcgagaagatcaagaactggcagaaggaggccttccacaagcagatgatgggcggcttcaaggagaccaaggaggccgaggacggcttcagaaaggcccagaagccctgggccaagaagctgaaggaggtgtag

SEQ ID NO: 11868 - DNA, 543 bp, Artificial Sequence
  Description of Artificial Sequence: Synthetic coding sequence
atgttcgccagcgacctgctgagagccctggactgctgccccggcgccggcagcagcggcctgctgccccagctgggccccagacagctgctggccttcaccgtgaactgcctgggcaaccacagatacctgggcttcttcgaggacctggagcagagacacaaggcccaggtgctggtggaggacatcagcgacatcctggaggagcacgccgagaagcacttccacccctacatcgcctactgcagcaacgaggtgtaccagcagagaaccctgcagaagctgatcagcagcaacgccgccttcagagaggccctgagagagatcgagagaagacccgcctgcggcggcctgcccatgctgagcttcctgatcctgcccatgcagagagtgaccagactgcccctgctgatggacaccctgtgcctgaagacccagggccacagcgagagatacaaggccgccagcagagccctgaaggccatcagcaagctggtgagacagtgcaacgagggcgcccacagaatggagagaatggagtag

SEQ ID NO: 11869 - DNA, 2487 bp, Artificial Sequence; identical to SEQ ID NO: 10544
  Description of Artificial Sequence: Synthetic coding sequence

SEQ ID NO: 11870 - DNA, 4455 bp, Artificial Sequence
  Description of Artificial Sequence: Synthetic coding sequence
atgagaatccccgaccagaagtacgtgaccctgaagctgaacgacgtgatcagattcggctacgacagcaacatgtacgtgctggagagagtgcagcacagagtgcccgaggaggccctgaagcacgagaagtacaccagccagctgcaggtgagcgtgaagggcctggcccccaagagaagcgaggccctgcccgagcacaccccctactgcgaggccagcaaccccagacccgagaagggcgacagaagacccggcaccgaggccgccagctacagaacccccctgtacggccagcccagctggtggggcgaggacgacggcagcaccctgcccgacgcccagagacagggcgagccctaccccgagagacccaagggccccgtgcagcaggacggcgagctgcacggcttcagagcccccgccgagccccagggctgcagcttcagaagagagcccagctacttcgagatccccaccaaggagaccccccagcccagccagccccccgaggtgcccgcccacgagatgcccaccaaggacgccgaggccggcggcggcggcgccgcccccgtggtgcagagccacgccagcttcaccatcgagttcgacgactgcagccccggcaagatgaagatcaaggaccacatcaccaagttcagcctgagacagagaagaccccccggcaaggaggccacccccggcgagatggtgagcgccgagaccaaggtggccgactggctggtgcagaacgaccccagcctgctgcacagagtgggccccggcgacgacagacacagcaccaagagcgacctgcccgtgcacaccagaaccctgaagggccacaagcacgaggacggcacccagagcgacagcgaggaccccctggccaaggccgccagcgccgccggcgtgcccctggaggccagcggcgagcaggtgagactgcagagacagatcaagagagacccccaggagctgctgcacaaccagcaggccttcgtgatcgagttcttcgacgaggacacccccagaaagaagagaagccagagcttcacccacagccccagcggcgaccccaaggccgacaagagaagaggccccacccccgccgacagagacagacccagcgtgcccgcccccgtgcaggccggcggcagaagcagcggcccccagagagccggcagcctgaagagagagaagaccgaggagagactgggcagccccagccccgccagcagaacccccgccagacccttcggcagcgtgggcagaagaagcagactggcccaggacttcatggcccagtgcctgagagagagcagccccgccgccagacccagccccgagaaggtgccccccgtgctgcccgcccccctgaccccccacggcaccagccccgtgggcccccccacccccccccccgcccccaccgacccccagctgaccaaggccagaaagcaggaggaggacgacagcctgagcgacgccggcacctacaccatcgagaccgaggcccaggacaccgaggtggaggaggccagaaagatgatcgaccaggtgttcggcgtgctggagagccccgagctgagcagagccagcagcgccaccttcagacccgtgatcagaggcgacagagacgagagcgacgacggcggcgtggcccagagaatggccctgctgcaggagttcgccagcagacccctgggcgccgccccccaggccgagcaccagggcctgcccgtgcccggcagccccggcggccagaagtgggtgagcagatgggccagcctggccgacagctacagcgaccccggcctgaccgaggacggcctgggcagaagaggcggcgagcccgagggcagcctgcccgtgagaatgagaagaagactgccccagctgcccagcgagagagccgacagccccgccggccccgagagcagcagaagaagcggccccggcccccccgagctggacagcgagcagcccagcagactgttcggccaggaggagctggaccccgacagcctgagcgacgccagcggcagcgacggcggcagaggccccgagcccggcgtggagccccaggacagcagaagaagaagcccccaggagggccccacctggagcagaggcagaagaagccccagagcccccggcgagcccacccccgccagcttcttcatcggcgaccagaacggcgacgccgtgctgagcagaaagcccctggccgcccccggcgacggcgagggcctgggccagaccgcccagcccagcccccccgccagagacggcgtgtacgtgagcgccaacggcagaatggtgatccagctgagacccggcagaagccccgagcccgacggccccgcccccgccttcctgagacaggagagcttcaccaaggagcccgccagcggcccccccgcccccggcaagcccccccacatcagcagccaccccctgctgcaggacctggccgccaccagagccgccagaatggacttccacagccaggacacccacctgatcctgaaggagaccgagaccgccctggccgccctggaggccagactgctgagcaacagcgtggacgccgagtgcgagggcggcagcacccccagaccccccgaggacgccctgagcggcgacagcgacgtggacaccgccagcaccgtgagcctgagaagcggcaagagcggccccagccccaccaccccccagcccctgagagcccagaaggagatgagccccagcccccccgccgcccaggaccccggcggcaccgccctggtgagcgccagagagcagagcagcgagagacagcaccaccccctgggccccaccgacatgggcagaggcgagcccgtgagaagaagcgccatcagaagaggccacagacccagaggcagcctggactggcccagcgaggagagaggccccgtgctggcccacctgcccagcagcgacgtgatggccagcaaccacgagacccccgaggccaccggcgccggcagactgggcagcagaagaaagcccgccgcccccccccccagccccgccgccagagaggagcagagcagaagcagcgccagcagccagaagggcccccaggccctgaccagaagcaacagcctgagcacccccagacccaccagagccagcagactgagaagagccagactgggcgacgccagcgacaccgaggccgccgacggcgagagaggcagcctgggcaaccccgagcccgtgggcagacccgccgccgagcaggccaagaagctgagcagactggacatcctggccatgcccagaaagagagccggcagcttcaccggcaccagcgaccccgaggccgcccccgccagaaccagcttcagcggcagaagcgtggagctgtgctgcgccagcagaaagcccaccatggccgaggccagagccgtgagcagaaaggccgccaacaccgccaccaccaccggccccagacagcccttcagcagagccagaagcggcagcgccagatacaccagcaccacccagacccccagagccggcagcagcagcagagccagaagcagagcccccggccccagagacaccgacgacgacgaggaggagcccgacccctacggcttcatcgtgcagaccgccgagatcgccgagatcgccagactgagccagaccctggtgaaggacgtggccatcctggcccaggagatccacgacgtggccggcgacggcgacaccctgggcagcagcgagcccgcccacagcgccagcctgagcaacatgcccagcacccccgccagcaccatcagcgccagagaggagctggtgcagagaatccccgaggccagcctgaacttccagaaggtgccccccggcagcctgaacagcagagacttcgaccagaacatgaacgacagctgcgaggacgccctggccaacaagaccagacccagaaacagagaggaggtgatcttcgacaacctgatgctgaaccccgtgagccagctgagccaggccatcagagagaacaccgagcacctggccgagaagatgaagatcctgttccagaacaccggcagagcctgggaggacctggaggccagaatcaacgccgagaacgaggtgcccatcctgaagaccagcaacaaggagatcagcagcatcctgaaggagctgagaagagtgcagaagcagctggaggtgatcaacgccatcgtggaccccagcggcagcctggacctgctgaccggcaacagaagcctggccagcagcgcccagcccggcctgggcaagggcagagtggccgcccagagcccccccagccccgccagcgccgaggccctgctgcccgccctgcccctgagaaacttcccccagagagccagctgcggcccccccagcctgcccgaccccaccttcctgcccgacgccgagagattcctgatctag

SEQ ID NO: 11871 - DNA, 150 bp, Artificial Sequence
  Description of Artificial Sequence: Synthetic coding sequence
atgtaccccaaccccctgatctactgcacctgctgggacccctggaacctgggccccagaaagctgatcaagaccccccagctgcccagaaagaacagcaccggcagcagcaagctgacccccctggtgcccgcccccaagaaccactag

SEQ ID NO: 11872 - DNA, 948 bp, Artificial Sequence; identical to SEQ ID NO: 9297
  Description of Artificial Sequence: Synthetic coding sequence

SEQ ID NO: 11873 - DNA, 3015 bp, Artificial Sequence
  Description of Artificial Sequence: Synthetic coding sequence
atgaaggccaccacccccctgcagaccgtggacagacccaaggactggtacaagaccatgttcaagcagatccacatggtgcacaagcccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccgccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaagggcggcgacgacagcaagatctgccccagcctgtgcagctacagcggcctgaacggcaaccccagcagcgagctggactactgcagcacctacagacagcacctggacgtgcccagagacagccccagagccatcagcttcaagaacggctggcagatggccagacagaacgccgagatctggagcagcaccgaggagaccgtgagccccaagatcaagagcagaagctgcgacgacctgctgaacgacgactgcgacagcttccccgaccccaaggtgaagagcgagagcatgggcagcctgctgtgcgaggaggacagcaaggagagctgccccatggcctggggcagcccctacgtgcccgaggtgagaagcaacggcagaagcagaatcagacacagaagcgccagaaacgcccccggcttcctgaagatgtacaagaagatgcacagaatcaacagaaaggacctgatgaacagcgaggtgatctgcagcgtgaagagcagaatcctgcagtacgagagcgagcagcagcacaaggacctgctgagagcctggagccagtgcagcaccgaggaggtgcccagagacatggtgcccaccagaatcagcgagttcgagaagctgatccagaagagcaagagcatgcccaacctgggcgacgacatgctgagccccgtgaccctggagcccccccagaacggcctgtgccccaagagaagattcagcatcgagtacctgctggaggaggagaaccagagcggcccccccgccagaggcagaagaggctgccagagcaacgccctggtgcccatccacatcgaggtgaccagcgacgagcagcccagagcccacgtggagttcagcgacagcgaccaggacggcgtggtgagcgaccacagcgactacatccacctggagggcagcagcttctgcagcgagagcgacttcgaccacttcagcttcaccagcagcgagagcttctacggcagcagccaccaccaccaccaccaccaccaccaccaccacagacacctgatcagcagctgcaagggcagatgccccgccagctacaccagattcaccaccatgctgaagcacgagagagccagacacgagaacaccgaggagcccagaagacaggagatggaccccggcctgagcaagctggccttcctggtgagccccgtgcccttcagaagaaagaagaacagcgcccccaagaagcagaccgagaaggccaagtgcaaggccagcgtgttcgaggccctggacagcgccctgaaggacatctgcgaccagatcaaggccgagaagaagagaggcagcctgcccgacaacagcatcctgcacagactgatcagcgagctgctgcccgacgtgcccgagagaaacagcagcctgagagccctgagaagaagccccctgcaccagcccctgcaccccctgccccccgacggcgccatccactgccccccctaccagaacgactgcggcagaatgcccagaagcgccagcttccaggacgtggacaccgccaacagcagctgccaccaccaggacagaggcggcgccctgcaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 11874 - DNA, 981 bp, Artificial Sequence
  Description of Artificial Sequence: Synthetic coding sequence
atggccgccgccgccgccgccgccgccgccaccaacggcaccggcggcagcagcggcatggaggtggacgccgccgtgcccagcgtgatggcctgcggcgtgaccggcagcgtgagcgtggccctgcaccccctggtgatcctgaacatcagcgaccactggatcagaatgagaagccaggagggcagacccgtgcaggtgatcggcgccctgatcggcaagcaggagggcagaaacatcgaggtgatgaacagcttcgagctgctgagccacaccgtggaggagaagatcatcatcgacaaggagtactactacaccaaggaggagcagttcaagcaggtgttcaaggagctggagttcctgggctggtacaccaccggcggcccccccgaccccagcgacatccacgtgcacaagcaggtgtgcgagatcatcgagagccccctgttcctgaagctgaaccccatgaccaagcacaccgacctgcccgtgagcgtgttcgagagcgtgatcgacatcatcaacggcgaggccaccatgctgttcgccgagctgacctacaccctggccaccgaggaggccgagagaatcggcgtggaccacgtggccagaatgaccgccaccggcagcggcgagaacagcaccgtggccgagcacctgatcgcccagcacagcgccatcaagatgctgcacagcagagtgaagctgatcctggagtacgtgaaggccagcgaggccggcgaggtgcccttcaaccacgagatcctgagagaggcctacgccctgtgccactgcctgcccgtgctgagcaccgacaagttcaagaccgacttctacgaccagtgcaacgacgtgggcctgatggcctacctgggcaccatcaccaagacctgcaacaccatgaaccagttcgtgaacaagttcaacgtgctgtacgacagacagggcatcggcagaagaatgagaggcctgttcttctag

SEQ ID NO: 11875 - DNA, 780 bp, Artificial Sequence
  Description of Artificial Sequence: Synthetic coding sequence
tgattcaccgcccaggcccccagcggcagaggcgccgccgtgggcagcggcaccagactggccagcctgagactgctgaccgagctggagagccccgcctggtggcccttcagcagcaagctgtggaagaccccccccgagaccaagcccagagaggacgtgagcatgaccagctgcgagcccttcggcaaggagggcatcctgatcaagatccccgccgtgatcagccacagaaccgagagccacgtgaagcccggcagactgaccgtgctggtgagcggcctggagatccacgacagcagcagcctgctgatgcacagattcgagagagaggacgtggacgacatcaaggtgcacagcccctacgagatcagcatcagacagagattcatcggcaagcccgacatggcctacagactgatcagcgccaagatgcccgaggtgatccccatcctggaggtgcagttcagcaagaagatggagctgctggaggacgccctggtgctgagaagcgccagaaccagcagccccgccgagaagagctgcagcgtgtggcacgccgccagcggcctgatgggcagaaccctgcacagagagccccccgccggcgaccaggagggcaccgccctgcacctgcagaccagcctgcccgccctgagcgaggccgacacccaggagctgacccagggcttcagacccatgagcctgagcacccagaccgtgctggtgatgctgtgcagcgagagcgccggcgccctgtggagacagagactgagctag

SEQ ID NO: 11876 - DNA, 1038 bp, Artificial Sequence
  Description of Artificial Sequence: Synthetic coding sequence
atggccgccgccgagcccgccagcagcggccagcaggcccccgccggccagggccagggccagagaccccccccccagcccccccaggcccaggccccccagccccccccccccccccagctgggcggcgccggcggcggcagcagcagacacgagaagagcctgggcctgctgaccaccaagttcgtgagcctgctgcaggaggccaaggacggcgtgctggacctgaaggccgccgccgacaccctggccgtgagacagaagagaagaatctacgacatcaccaacgtgctggagggcatcgacctgatcgagaagaagagcaagaacagcatccagtggaagggcgtgggcgccggctgcaacaccaaggaggtgatcgacagactgagatacctgaaggccgagatcgaggacctggagctgaaggagagagagctggaccagcagaagctgtggctgcagcagagcatcaagaacgtgatggacgacagcatcaacaacagattcagctacgtgacccacgaggacatctgcaactgcttcaacggcgacaccctgctggccatccaggcccccagcggcacccagctggaggtgcccatccccgagatgggccagaacggccagaagaagtaccagatcaacctgaagagccacagcggccccatccacgtgctgctgatcaacaaggagagcagcagcagcaagcccgtggtgttccccgtgcccccccccgacgacctgacccagcccagcagccagagcctgacccccgtgaccccccagaagagcagcatggccacccagaacctgcccgagcagcacgtgagcgagagaagccaggccctgcagcagaccagcgccaccgacatcagcagcggcagcatcagcggcgacatcatcgacgagctgatgagcagcgacgtgttccccctgctgagactgagccccacccccgccgacgactacaacttcaacctggacgacaacgagggcgtgtgcgacctgttcgacgtgcagatcctgaactactag

SEQ ID NO: 11877 - DNA, 96 bp, Artificial Sequence
  Description of Artificial Sequence: Synthetic coding sequence
atgaccgtgccctggagacccggcaagagaagaatcacctacaaggaggaggaggacctgaccctgcagcccagaagctgcctgcagtgcagctag

SEQ ID NO: 11878 - DNA, 489 bp, Artificial Sequence
  Description of Artificial Sequence: Synthetic coding sequence
atgaacaaccagaagcagcagaagcccaccctgagcggccagagattcaagaccagaaagagagacgagaaggagagattcgaccccacccagttccaggactgcatcatccagggcctgaccgagaccggcaccgacctggaggccgtggccaagttcctggacgccagcggcgccaagctggactacagaagatacgccgagaccctgttcgacatcctggtggccggcggcatgctggcccccggcggcaccctggccgacgacatgatgagaaccgacgtgtgcgtgttcgccgcccaggaggacctggagaccatgcaggccttcgcccaggtgttcaacaagctgatcagaagatacaagtacctggagaagggcttcgaggacgaggtgaagaagctgctgctgttcctgaagggcttcagcgagagcgagagaaacaagctggccatgctgaccggcgtgctgctggccaacggcacctag

SEQ ID NO: 11879 - DNA, 270 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagttcagcgccttcgacatgagcgcccccacccccgccagatgctgccccgccatcggcaccctgtacaactag

SEQ ID NO: 11880 - DNA, 2025 bp, Artificial Sequence; identical to SEQ ID NO: 10426
  Description of Artificial Sequence: Synthetic coding sequence

SEQ ID NO: 11881 - DNA, 1923 bp, Artificial Sequence
  Description of Artificial Sequence: Synthetic coding sequence
atggagaaccagctggccaagagcaccgaggagagaaccttccagtaccaggacagcctgcccagcctgcccgtgcccagcctggaggagagcctgaagaagtacctggagagcgtgaccagaacctgctaccagatcagaggcctggaccccgacgccaagagaggcttcctggacctgaccagagagggcatccaggtgaagcccttcgccaaccaggaggagtacaagaagaccgaggagatcgtgcagaagttccagagcggcatcggcgagaagctgcaccagaagctgctggagagagccaagggcaagagaaactggctggaggagtggtggctgaacgtggcctacctggacgtgagaatccccagccagctgaacgtgaacttcgccggccccgccgcccacttcgagcactactggccccccaaggagggcacccagctggagagaggcagcatcaccctgtggcacaacctgaactactggcagctgctgagaaaggagaaggtgcccgtgcacaaggtgggcaacacccccctggacatgaaccagttcagaatgctgttcagcacctgcaaggtgcccggcatcaccagagacagcatcatgaactacttcagaaccgagagcgagggcagaagccccaaccacatcgtggtgctgtgcagaggcagagccttcgtgttcgacgtgatccacgagggctgcctggtgaccccccccgagctgctgagacagctgacctacatccacaagaagtgccacagcgagcccgacggccccggcatcgccgccctgaccagcgaggagagaaccagatgggccaaggccagagagtacctgatcggcctggaccccgagaacctggccctgctggagaagatccagagcagcctgctggtgtacagcatggaggacagcagcccccacgtgacccccgaggactacagcgagatcatcgccgccatcctgatcggcgaccccaccgtgagatggggcgacaagagctacaacctgatcagcttcagcaacggcgtgttcggctgcaactgcgaccacgcccccttcgacgccatgatcatggtgaacatcagctactacgtggacgagaagatcttccagaacgagggcagatggaagggcagcgagaaggtgagagacatccccctgcccgaggagctgatcttcatcgtggacgagaaggtgctgaacgacatcaaccaggccaaggcccagtacctgagagaggccagcgacctgcagatcgccgcctacgccttcaccagcttcggcaagaagctgaccaagaacaagatgctgcaccccgacaccttcatccagctggccctgcagctggcctactacagactgcacggccaccccggctgctgctacgagaccgccatgaccagacacttctaccacggcagaaccgagaccatgagaagctgcaccgtggaggccgtgagatggtgccagagcatgcaggaccccagcgtgaacctgagagagagacagcagaagatgctgcaggccttcgccaagcacaacaagatgatgaaggactgcagcgccggcaagggcttcgacagacacctgctgggcctgctgctgatcgccaaggaggagggcctgcccgtgcccgagctgttcaccgaccccctgttcagcaagagcggcggcggcggcaacttcgtgctgagcaccagcctggtgggctacctgagagtgcagggcgtggtggtgcccatggtgcacaacggctacggcttcttctaccacatcagagacgacagattcgtggtggcctgcagcgcctggaagagctgccccgagaccgacgccgagaagctggtgcagctgaccttctgcgccttccacgacatgatccagctgatgaacagcacccacctgtag

SEQ ID NO: 11882 - DNA, 474 bp, Artificial Sequence; identical to SEQ ID NO: 11812
  Description of Artificial Sequence: Synthetic coding sequence

SEQ ID NO: 11883 - DNA, 432 bp, Artificial Sequence
  Description of Artificial Sequence: Synthetic coding sequence
tgaaccagacacttcaaggagagcatcaagttcatccacgagtgcagactgagaggcgagagctgcctggtgcactgcctggccggcgtgagcagaagcgtgaccctggtgatcgcctacatcatgaccgtgaccgacttcggctgggaggacgccctgcacaccgtgagagccggcagaagctgcgccaaccccaacgtgggcttccagagacagctgcaggagttcgagaagcacgaggtgcaccagtacagacagtggctgaaggaggagtacggcgagagccccctgcaggacgccgaggaggccaagaacatcctgggcaagtacaaggagcagggcagaaccgagccccagcccggcgccagaagatggagcagcttccccgccctggcccccctgacctacgacaactacaccaccgagacctag

SEQ ID NO: 11884 - DNA, 495 bp, Artificial Sequence
  Description of Artificial Sequence: Synthetic coding sequence
atggtgaacagcgtgatcttcttcgacatcaccgtggacggcaagcccctgggcagaatcagcatcaagcagttcgccgacaagatccccaagaccgccgagaacttcagagccctgagcaccggcgagaagggcttcagatacaagggcagctgcttccacagaatcatccccggcttcatgtgccagggcggcgacttcacccaccccaacggcaccggcgacaagagcatctacggcgagaagttcgacgacgagaacctgatcagaaagcacaccggcagcggcatcctgagcatggccaacgccggccccaacaccaacggcagccagttcttcatctgcaccgccaagaccgagtggctggacggcaagcacgtggccttcggcaaggtgaaggagagagtgaacatcgtggaggccatggagcacttcggctacagaaacagcaagaccagcaagaagatcaccatcgccgactgcggccagttctag

SEQ ID NO: 11885 - DNA, 468 bp, Artificial Sequence
  Description of Artificial Sequence: Synthetic coding sequence
atgagcgagggcgagagccagaccgtgctgagcagcggcagcgaccccaaggtggagagcagcagcagcgcccccggcctgaccagcgtgagcccccccgtgaccagcaccaccagcgccgccagccccgaggaggaggaggagagcgaggacgagagcgagatcctggaggagagcccctgcggcagatggcagaagagaagagaggaggtgaaccagagaaacgtgcccggcatcgacagcgcctacctggccatggacaccgaggagggcgtggaggtggtgtggaacgaggtgcagttcagcgagagaaagaactacaagctgcaggaggagaaggtgagagccgtgttcgacaacctgatccagctggagcacctgaacatcgtgaagttccacaagtactgggccgacatcaaggagaacaaggccagagtgatcttcatcaccgagtacatgagcagctag

SEQ ID NO: 11886 - DNA, 837 bp, Artificial Sequence
  Description of Artificial Sequence: Synthetic coding sequence
atgtggcccttccccagcagaagcctgttccccccccccacccaggcctggctgcagaccgtgagcagcgaccccgaggcccagggctggggcgcctggaacgagaccaaggagatcctgggccccgagggcggcgagggcaaggaggagaaggaggaggaggaggacgccgaggaggaccaggacggcgacgccggcttcctgctgagcctgctggagcaggagaacctggccgagtgccccctgcccgaccaggagctggaggccatcaagatgaaggtgtgcgccatggagcaggccgagggcacccccagaccccccggcgtgcagcagcaggccgaggaggaggagggcaccgccgccggccagctgctgagccccgagaccgtgggctgccccctgagcggcacccccgaggagaaggtggaggccgaccacagaagcgtgtacgtgggcaacgtggactacggcggcagcgccgaggagctggaggcccacttcagcagatgcggcgaggtgcacagagtgaccatcctgtgcgacaagttcagcggccaccccaagggctacgcctacatcgagttcgccaccaagggcagcgtgcaggccgccgtggagctggaccagagcctgttcagaggcagagtgatcaaggtgctgcccaagagaaccaacttccccggcatcagcagcaccgacagaggcggcctgagaggccaccccggcagcagaggcgcccccttcccccacagcggcctgcagggcagacccagactgagaccccagggccagaacagagccagaggcaagttcagcccctggttcagcccctactag

SEQ ID NO: 11887 - DNA, 132 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagagcctggacgaggaggagaagctggagctgcagtag

SEQ ID NO: 11888 - DNA, 390 bp, Artificial Sequence
  Description of Artificial Sequence: Synthetic coding sequence
atggccgacgaggagctggaggccctgagaagacagagactggccgagctgcaggccaagcacggcgaccccggcgacgccgcccagcaggaggccaagcacagagaggccgagatgagaaacagcatcctggcccaggtgctggaccagagcgccagagccagactgagcaacctggccctggtgaagcccgagaagaccaaggccgtggagaactacctgatccagatggccagatacggccagctgagcgagaaggtgagcctggacagcctggaggagctgtactgctacctgctgtaccagaacatggccagcaagggccagctgcacctgcactggatcaccgagttcctgctgaccctgagaagaaactgctggagagagtag

SEQ ID NO: 11889 - DNA, 2286 bp, Artificial Sequence
  Description of Artificial Sequence: Synthetic coding sequence
atgagaaagcaggaggtgagaaccggcagagaggccggccagggccacggcaccggcagccccgccgagcaggtgaaggccctgatggacctgctggccggcaagggcagccagggcagccaggccccccaggccctggacagaacccccgacgcccccctgggcccctgcagcaacgacagcagaatccagagacacagaaaggccctgctgagcaaggtgggcggcggccccgagctgggcggcccctggcacagactggccagcctgctgctggtggagggcctgaccgacctgcagctgagagagcacgacttcacccaggtggaggccaccagaggcggcggccaccccgccagaaccgtggccctggacagactgttcctgcccctgagcagagtgagcgtgccccccagagtgagcatcaccatcggcgtggccggcatgggcaagaccaccctggtgagacacttcgtgagactgtgggcccacggccaggtgggcaaggacttcagcctggtgctgcccctgaccttcagagacctgaacacccacgagaagctgtgcgccgacagactgatctgcagcgtgttcccccacgtgggcgagcccagcctggccgtggccgtgcccgccagagccctgctgatcctggacggcctggacgagtgcagaacccccctggacttcagcaacaccgtggcctgcaccgaccccaagaaggagatccccgtggaccacctgatcaccaacatcatcagaggcaacctgttccccgaggtgagcatctggatcaccagcagacccagcgccagcggccagatccccggcggcctggtggacagaatgaccgagatcagaggcttcaacgaggaggagatcaaggtgtgcctggagcagatgttccccgaggaccaggccctgctgggctggatgctgagccaggtgcaggccgacagagccctgtacctgatgtgcaccgtgcccgccttctgcagactgaccggcatggccctgggccacctgtggagaagcagaaccggcccccaggacgccgagctgtggccccccagaaccctgtgcgagctgtacagctggtacttcagaatggccctgagcggcgagggccaggagaagggcaaggccagccccagaatcgagcaggtggcccacggcggcagaaagatggtgggcaccctgggcagactggccttccacggcctgctgaagaagaagtacgtgttctacgagcaggacatgaaggccttcggcgtggacctggccctgctgcagggcgccccctgcagctgcttcctgcagagagaggagaccctggccagcagcgtggcctactgcttcacccacctgagcctgcaggagttcgtggccgccgcctactactacggcgccagcagaagagccatcttcgacctgttcaccgagagcggcgtgagctggcccagactgggcttcctgacccacttcagaagcgccgcccagagagccatgcaggccgaggacggcagactggacgtgttcctgagattcctgagcggcctgctgagccccagagtgaacgccctgctggccggcagcctgctggcccagggcgagcaccaggcctacagaacccaggtggccgagctgctgcagggctgcctgagacccgacgccgccgtgtgcgccagagccatcaacgtgctgcactgcctgcacgagctgcagcacaccgagctggccagaagcgtggaggaggccatggagagcggcgccctggccagactgaccggccccgcccacagagccgccctggcctacctgctgcaggtgagcgacgcctgcgcccaggaggccaacctgagcctgagcctgagccagggcgtgctgcagagcctgctgccccagctgctgtactgcagaaagctgagactggacaccaaccagttccaggaccccgtgatggagctgctgggcagcgtgctgagcggcaaggactgcagaatccagaagatcagcctggccgagaaccagatcagcaacaagggcgccaaggccctggccagaagcctgctggtgaacagaagcctgaccagcctggacctgagaggcaacagcatcggcccccagggcgccaaggccctggccgacgccctgaagatcaacagaaccctgaccagcctgagagtgaagttcatgtaccacaagatcgactgcttcagaagagtgcccgaggccgacgcctgcaaccccagcaccctgggcggccagggcagatggatcacctag

SEQ ID NO: 11890 - DNA, 474 bp, Artificial Sequence; identical to SEQ ID NO: 11812
  Description of Artificial Sequence: Synthetic coding sequence

SEQ ID NO: 11891 - DNA, 1473 bp, Artificial Sequence
  Description of Artificial Sequence: Synthetic coding sequence
atgaccatcggcagaatggagaacgtggaggtgttcaccgccgagggcaagggcagaggcctgaaggccaccaaggagttctgggccgccgacatcatcttcgccgagagagcctacagcgccgtggtgttcgacagcctggtgaacttcgtgtgccacacctgcttcaagagacaggagaagctgcacagatgcggccagtgcaagttcgcccactactgcgacagaacctgccagaaggacgcctggctgaaccacaagaacgagtgcagcgccatcaagagatacggcaaggtgcccaacgagaacatcagactggccgccagaatcatgtggagagtggagagagagggcaccggcctgaccgagggctgcctggtgagcgtggacgacctgcagaaccacgtggagcacttcggcgaggaggagcagaaggacctgagagtggacgtggacaccttcctgcagtactggcccccccagagccagcagttcagcatgcagtacatcagccacatcttcggcgtgatcaactgcaacggcttcaccctgagcgaccagagaggcctgcaggccgtgggcgtgggcatcttccccaacctgggcctggtgaaccacgactgctggcccaactgcaccgtgatcttcaacaacggcaaccacgaggccgtgaagagcatgttccacacccagatgagaatcgagctgagagccctgggcaagatcagcgagggcgaggagctgaccgtgagctacatcgacttcctgaacgtgagcgaggagagaaagagacagctgaagaagcagtactacttcgactgcacctgcgagcactgccagaagaagctgaaggacgacctgttcctgggcgtgaaggacaaccccaagcccagccaggaggtggtgaaggagatgatccagttcagcaaggacaccctggagaagatcgacaaggccagaagcgagggcctgtaccacgaggtggtgaagctgtgcagagagtgcctggagaagcaggagcccgtgttcgccgacaccaacatctacatgctgagaatgctgagcatcgtgagcgaggtgctgagctacctgcaggccttcgaggaggccagcttctacgccagaagaatggtggacggctacatgaagctgtaccaccccaacaacgcccagctgggcatggccgtgatgagagccggcctgaccaactggcacgccggcaacatcgaggtgggccacggcatgatctgcaaggcctacgccatcctgctggtgacccacggccccagccaccccatcaccaaggacctggaggccatgagagtgcagaccgagatggagctgagaatgttcagacagaacgagttcatgtactacaagatgagagaggccgccctgaacaaccagcccatgcaggtgatggccgagcccagcaacgagcccagccccgccctgttccacaagaagcagtag

SEQ ID NO: 11892 - DNA, 1491 bp, Artificial Sequence
  Description of Artificial Sequence: Synthetic coding sequence
atgtggggcagattcctggcccccgaggccagcggcagagacagccccggcggcgccagaagcttccccgccggccccgactacagcagcgcctggctgcccgccaacgagagcctgtggcaggccaccaccgtgcccagcaaccacagaaacaaccacatcagaagacacagcatcgccagcgacagcggcgacaccggcatcggcaccagctgcagcgacagcgtggaggaccacagcaccagcagcggcaccctgagcttcaagcccagccagagcctgatcaccctgcccaccgcccacgtgatgcccagcaacagcagcgccagcatcagcaagctgagagagagcctgacccccgacggcagcaagtggagcaccagcctgatgcagaccctgggcaaccacagcagaggcgagcaggacagcagcctggacatgaaggacttcagacccctgagaaagtggagcagcctgagcaagctgaccgcccccgacaactgcggccagggcggcaccgtgtgcagagaggagagcagaaacggcctggagaagatcggcaaggccaaggccctgaccagccagctgagaaccatcggccccagctgcctgcacgacagcatggagatgctgagactggaggacaaggagatcaacaagaagagaagcagcaccctggactgcaagtacaagttcgagagctgcagcaaggaggacttcagagccagcagcagcaccctgagaagacagcccgtggacatgacctacagcgccctgcccgagagcaagcccatcatgaccagcagcgaggccttcgagccccccaagtacctgatgctgggccagcaggccgtgggcggcgtgcccatccagcccagcgtgagaacccagatgtggctgaccgagcagctgagaaccaaccccctggagggcagaaacaccgaggacagctacagcctggccccctggcagcagcagcagatcgaggacttcagacagggcagcgagacccccatgcaggtgctgaccggcagcagcagacagagctacagccccggctaccaggacttcagcaagtgggagagcatgctgaagatcaaggagggcctgctgagacagaaggagatcgtgatcgacagacagaagcagcagatcacccacctgcacgagagaatcagagacaacgagctgagagcccagcacgccatgctgggccactacgtgaactgcgaggacagctacgtggccagcctgcagccccagtacgagaacaccagcctgcagacccccttcagcgaggagagcgtgagccacagccagcagggcgagttcgagcagaagctggccagcaccgagaaggaggtgctgcagctgaacgagttcctgaagcagagactgagcctgttcagcgaggagaagaagaagctggaggagaaggtgggcttcagcaacaaggtggagctgggccagcagcacttcctgagcatctag

SEQ ID NO: 11893 - DNA, 1083 bp, Artificial Sequence
  Description of Artificial Sequence: Synthetic coding sequence
atggccgagctgcagcagctgcaggagttcgagatccccaccggcagagaggccctgagaggcaaccacagcgccctgctgagagtggccgactactgcgaggacaactacgtgcaggccaccgacaagagaaaggccctggaggagaccatggccttcaccacccaggccctggccagcgtggcctaccaggtgggcaacctggccggccacaccctgagaatgctggacctgcagggcgccgccctgagacaggtggaggccagaatggtgaacatgcacatggagaaggtggccagaagagagatcggcaccctggccaccgtgcagagactgccccccggccagaaggtgatcgcccccgagaacctgccccccctgaccccctactgcagaagacccctgaacttcggctgcctggacgacatcggccacggcatcaaggacctgagcacccagctgagcagaaccggcaccctgagcagaaagagcatcaaggcccccgccacccccgccagcgccaccctgggcagaccccccagaatccccgagcccgtgcacctgcccgtggtgcccgacggcagactgagcgccgccagcagcgccttcagcctggccagcgccggcagcgccgagggcgtgggcggcgcccccacccccaagggccaggccgccccccccgccccccccctgcccagcagcctggaccccccccccccccccgccgccgtggaggtgttccagagaccccccaccctggaggagctgagcccccccccccccgacgaggagctgcccctgcccctggacctgcccccccccccccccctggacggcgacgagctgggcctgcccccccccccccccggcttcggccccgacgagcccagctgggtgcccgccagctacctggagaaggtggtgaccctgtacccctacaccagccagaaggacaacgagctgagcttcagcgagggcaccgtgatctgcgtgaccagaagatacagcgacggctggtgcgagggcgtgagcagcgagggcaccggcttcttccccggcaactacgtggagcccagctgctag

SEQ ID NO: 11894 - DNA, 201 bp, Artificial Sequence
  Description of Artificial Sequence: Synthetic coding sequence
atgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggctag

SEQ ID NO: 11895 - DNA, 1476 bp, Artificial Sequence
  Description of Artificial Sequence: Synthetic coding sequence
atggagcagccccccgcccccaagagcaagctgaagaagctgagcgaggacagcctgaccaagcagcccgaggaggtgttcgacgtgctggagaagctgggcgagggcagctacggcagcgtgttcaaggccatccacaaggagagcggccaggtggtggccatcaagcaggtgcccgtggagagcgacctgcaggagatcatcaaggagatcagcatcatgcagcagtgcgacagcccctacgtggtgaagtactacggcagctacttcaagaacaccgacctgtggatcgtgatggagtactgcggcgccggcagcgtgagcgacatcatcagactgagaaacaagaccctgatcgaggacgagatcgccaccatcctgaagagcaccctgaagggcctggagtacctgcacttcatgagaaagatccacagagacatcaaggccggcaacatcctgctgaacaccgagggccacgccaagctggccgacttcggcgtggccggccagctgaccgacaccatggccaagagaaacaccgtgatcggcacccccttctggatggcccccgaggtgatccaggagatcggctacaactgcgtggccgacatctggagcctgggcatcaccagcatcgagatggccgagggcaagcccccctacgccgacatccaccccatgagagccatcttcatgatccccaccaaccccccccccaccttcagaaagcccgagctgtggagcgacgacttcaccgacttcgtgaagaagtgcctggtgaagaaccccgagcagagagccaccgccacccagctgctgcagcaccccttcatcaagaacgccaagcccgtgagcatcctgagagacctgatcaccgaggccatggagatcaaggccaagagacacgaggagcagcagagagagctggaggaggaggaggagaacagcgacgaggacgagctggacagccacaccatggtgaagaccagcgtggagagcgtgggcaccatgagagccaccagcaccatgagcgagggcgcccagaccatgatcgagcacaacagcaccatgctggagagcgacctgggcaccatggtgatcaacagcgaggacgaggaggaggaggacggcaccatgaagagaaacgccaccagcccccaggtgcagagacccagcttcatggactacttcgacaagcaggacttcaagaacaagagccacgagaactgcaaccagaacatgcacgagcccttccccatgagcaagaacgtgttccccgacaactggaaggtgccccaggacggcgacttcgacttcctgaagaacctgagcctggaggagctgcagatgagactgaaggccctggaccccatgatggagagagagatcgaggagctgagacagagatacaccgccaagagacagcccatcctggacgccatggacgccaagaagagaagacagcagaacttctag

SEQ ID NO: 11896 - DNA, 126 bp, Artificial Sequence
  Description of Artificial Sequence: Synthetic coding sequence
atgagcagcaagggcagcagcaccgacggcagaaccgacctggccaacggcagcctgagcagcagccccgaggagatgagcggcgccgaggagggcagagagaccagcagcggcatcgaggtgtag

SEQ ID NO: 11897 - DNA, 945 bp, Artificial Sequence
  Description of Artificial Sequence: Synthetic coding sequence
atgcccaacgtggccgagaccgagagaagcaacgacagcggcaacggcgagcacaagagcgagagaaagagccccgaggagaacctgcagggcgccgtgaagagcttctgcaccagcgccagcggcgcccccctgggccccaagggcgacggccactacccctggagctgccccgtgacccacaccagagagaagatctacgccatctgcagcgactacgccttcctgaaccaggccaccagcatctacaagacccccaaccccagcagaagcccctgcctgcccgacagcaccagcctgagcgccggcaacaacagcagcagatacatcggcatccccaccagcaccagcgagatcatctacaacgaggagaacagcctggagaacctgagcaacagcctgggcaagctgcccctggcctgggagatcgacaagagcgagttcgacggcgtgaccaccaacagcaagcacaagagcggcaacgccaagaagcaggtgagcaagagaaagaccagcgacaagaagggcagataccagaaggagtgcccccagcacagccccctggaggacatcaagcagagaaaggtgctggacctgagaagatggtactgcatcagcagaccccagtacaagaccagctgcggcatcagcagcctgatcagctgctggaacttcctgtacagcaccatgggcgccggcaacctgccccccatcacccaggaggaggccctgcacatcctgggcttccagccccccttcgaggacatcagattcggccccttcaccggcaacaccaccctgatgagatggttcagacagatcaacgaccacttccacgtgaagggctgcagctacgtgctgtacaagccccacggcaagaacaagaccgccggcgagaccgccggcgacctgagccaccacagaaagctgaacatcggcagctag

SEQ ID NO: 11898 - DNA, 1500 bp, Artificial Sequence
  Description of Artificial Sequence: Synthetic coding sequence
atgcccgagatcagagtgacccccctgggcgccggccaggacgtgggcagaagctgcatcctggtgagcatcgccggcaagaacgtgatgctggactgcggcatgcacatgggcttcaacgacgacgtggacgacgagctggagatcaaggcctactacgccggccacgtgctgggcgccgccatgttccagatcaaggtgggcagcgagagcgtggtgtacaccggcgactacaacatgacccccgacagacacctgggcgccgcctggatcgacaagtgcagacccaacctgctgatcaccgagagcacctacgccaccaccatcagagacagcaagagatgcagagagagagacttcctgaagaaggtgcacgagaccgtggagagaggcggcaaggtgctgatccccgtgttcgccctgggcagagcccaggagctgtgcatcctgctggagaccttctgggagagaatgaacctgaaggtgcccatctacttcagcaccggcctgaccgagaaggccaaccactactacaagctgttcatcccctggaccaaccagaagatcagaaagaccttcgtgcagagaaacatgttcgagttcaagcacatcaaggccttcgacagagccttcgccgacaaccccggccccatggtggtgttcgccacccccggcatgctgcacgccggccagagcctgcagatcttcagaaagtgggccggcaacgagaagaacatggtgatcatgcccggctactgcgtgcagggcaccgtgggccacaagatcctgagcggccagagaaagctggagatggagggcagacaggtgctggaggtgaagatgcaggtggagtacatgagcttcagcgcccacgccgacgccaagggcatcatgcagctggtgggccaggccgagcccgagagcgtgctgctggtgcacggcgaggccaagaagatggagttcctgaagcagaagatcgagcaggagctgagagtgaactgctacatgcccgccaacggcgagaccgtgaccctgcccaccagccccagcatccccgtgggcatcagcctgggcctgctgaagagagagatggcccagggcctgctgcccgaggccaagaagcccagactgctgcacggcaccctgatcatgaaggacagcaacttcagactggtgagcagcgagcaggccctgaaggagctgggcctggccgagcaccagctgagattcacctgcagagtgcacctgcacgacaccagaaaggagcaggagaccgccctgagagtgtacagccacctgaagagcgtgctgaaggaccactgcgtgcagcacctgcccgacggcagcgtgaccgtggagagcgtgctgctgcaggccgccgcccccagcgaggaccccggcaccaaggtgctgctggtgagctggacctaccaggacgaggagctgggcagcttcctgaccagcctgctgaagaagggcctgccccaggcccccagctag

SEQ ID NO: 11899 - DNA, 396 bp, Artificial Sequence
  Description of Artificial Sequence: Synthetic coding sequence
ggcaccatcagctgcagcaccggcaccctgcagagaagaaacctgggccccgagagacagaccggcctgctgctgctgggcatgaaggagaaccaggagctgaagaccatccaggccaacctgagcagacagagagtggagcaccagtgcctgagcagcgaggagctgaagcagagattccccaacatcagactgcccagaggcgaggtgggcctgctggacaacagcggcggcgtgatctacgcctacaaggccctgagagccctgcaggacgccatcagacagctgggcggcatcgtgagagacggcgagaaggtggtggagatcaaccccggcctgctggtgaccgtgaagaccaccagcagaagctaccaggccaagagcctggtgatctag

SEQ ID NO: 11900 - DNA, 687 bp, Artificial Sequence
  Description of Artificial Sequence: Synthetic coding sequence
atgagcagagagagaggcagcagaagcgaggagcccggcgccggcaacagagagagcggcagcagagagcccggcctggccgccgccgccatgagcaccgtggacctggccagagtgggcgcctgcatcctgaagcacgccgtgaccggcgaggccgtggagctgagaagcctgtggagagagcacgcctgcgtggtggccggcctgagaagattcggctgcgtggtgtgcagatggatcgcccaggacctgagcagcctggccggcctgctggaccagcacggcgtgagactggtgggcgtgggccccgaggccctgggcctgcaggagttcctggacggcgactacttcgccggcgagctgtacctggacgagagcaagcagctgtacaaggagctgggcttcaagagatacaacagcctgagcatcctgcccgccgccctgggcaagcccgtgagagacgtggccgccaaggccaaggccgtgggcatccagggcaacctgagcggcgacctgctgcagagcggcggcctgctggtggtgagcaagggcggcgacaaggtgctgctgcacttcgtgcagaagagccccggcgactacgtgcccaaggagcacatcctgcaggtgctgggcatcagcgccgaggtgtgcgccagcgaccccccccagtgcgacagagaggtgtag

SEQ ID NO: 11901 - DNA, 654 bp, Artificial Sequence
  Description of Artificial Sequence: Synthetic coding sequence
atgaacttcagcgaggtgttcaagctgagcagcctgctgtgcaagttcagccccgacggcaagtacctggccagctgcgtgcagtacagactggtggtgagagacgtgaacaccctgcagatcctgcagctgtacacctgcctggaccagatccagcacatcgagtggagcgccgacagcctgttcatcctgtgcgccatgtacaagagaggcctggtgcaggtgtggagcctggagcagcccgagtggcactgcaagatcgacgagggcagcgccggcctggtggccagctgctggagccccgacggcagacacatcctgaacaccaccgagttccacctgagaatcaccgtgtggagcctgtgcaccaagagcgtgagctacatcaagtaccccaaggcctgcctgcagggcatcaccttcaccagagacggcagatacatggccctggccgagagaagagactgcaaggactacgtgagcatcttcgtgtgcagcgactggcagctgctgagatacaagatcctgctgtacagcctggacggcagactgctgagcacctacagcgcctacgagtggagcctgggcatcaagagcgtggcctggagccccagcagccagttcctggccgtgggcagctacgacggcaagtag

SEQ ID NO: 11902 - DNA, 483 bp, Artificial Sequence; identical to SEQ ID NO: 10977
  Description of Artificial Sequence: Synthetic coding sequence

SEQ ID NO: 11903 - DNA, 951 bp, Artificial Sequence
  Description of Artificial Sequence: Synthetic coding sequence
atggaggagaacaacctgcagtgcagcagcgtggtggacggcaacttcgaggaggtgcccagagagaccgccatccagttcaagccccccctgtacagacagagataccagttcgtgaagaacctggtggaccagcacgagcccaagaaggtggccgacctgggctgcggcgacaccagcctgctgagactgctgaaggtgaacccctgcatcgagctgctggtgggcgtggacatcaacgaggacaagctgagatggagaggcgacagcctggcccccttcctgggcgacttcctgaagcccagagacctgaacctgaccatcaccctgtaccacggcagcgtggtggagagagacagcagactgctgggcttcgacctgatcacctgcatcgagctgatcgagcacctggacagcggcgacctggccagattccccgaggtggtgttcggctacctgagccccagcatgatcgtgatcagcacccccaacagcgagttcaaccccctgttccccagcgtgaccctgagagacagcgaccacaagttcgagtggaccagaatggagttccagacctgggccctgtacgtggccaacagatacgactacagcgtggagttcaccggcgtgggcgagccccccgccggcgccgagaacgtgggctactgcacccagatcggcatcttcagaaagaacggcggcaaggccaccgagagctgcctgagcgagcagcacgaccagcacgtgtacaaggccgtgttcaccaccagctaccccagcctgcagcaggagagattcttcaagctggtgctggtgaacgaggtgagccagcaggtggagagcctgagagtgagccacctgcccagaagaaaggagcaggccggcgagagaggcgacaagcccaaggacatcggcggcagcaaggcccccgtgccctgcttcggcccctag

SEQ ID NO: 11904 - DNA, 1056 bp, Artificial Sequence
  Description of Artificial Sequence: Synthetic coding sequence
atgtggacccccagacccgccctgcacgtgcacgtgatcctgtacagccccatccacagatgctacgccagagccgaccccaccatgggcagaatctgggtggacgccgccgtgccctgcctggaggagtgcggcttcctgctgcacttcagagacggctgctaccacctggagaccagcacccaccacttcctgagccacgtggacagactgttcagccagcccagcagccagaccgccttccacatgcaggtgagacccggcggcctggtggccctgtgcgacggcgagggcggcatgctgtacccccagggcacccacctgctgctgggcatgggctgcaaccccatgagaggcgaggagtggttcatcctgcagcactgccccacctgggtgagcctgagaagcaagaccggcagattcatcagcgtgatctacgacggcgaggtgagagccgccagcgagagactgaacagaatgagcctgttccagttcgagtgcgacagcgagagccccaccgtgcagctgagaagcgccaacggctactacctgagccagagaagacacagagccgtgatggccgacggccaccccctggagagcgacaccttcttcagaatgcactggaactgcggcagaatcatcctgcagagctgcagaggcagattcctgggcatcgcccccaacagcctgctgatggccaacgtgatcctgcccggccccaacgaggagttcggcatcctgttcgccaacagaagcttcctggtgctgagaggcagatacggctacgtgggcagcagcagcggccacgacctgatccagtgcaaccaggaccagcccgacagaatccacctgctgccctgcagacccggcatctaccacttccagggcggcatcctgctggtgaacaacatcctgtggcacctgagccccctgggccaggtgtgcccccagctgctgtacagagccagcggcgagcagctgacccactgcaccggcccccagtggctgctgcacgccagcagacccaagtggcaccccgtgggcagacagtag

SEQ ID NO: 11905 - DNA, 333 bp, Artificial Sequence
  Description of Artificial Sequence: Synthetic coding sequence
atgcagatcagcagcgagaaggaggaggacgacaacgagaagagacaggaccccggcgacaactgggaggagggcggcggcggcggcggcggcatggagaagagcagcggcccctggaacaagaccgcccccgtgcaggccccccccgcccccgtgatcgtgaccgagacccccgagcccgccatgaccagcggcgtgtacagaccccccggcgccagactgaccaccaccagaaagaccccccagggcccccccgagatctacagcgacacccagttccccagcctgcagagcaccgccaagcacgtggagagcagaaagtacctgaagtag

SEQ ID NO: 11906 - DNA, 972 bp, Artificial Sequence
  Description of Artificial Sequence: Synthetic coding sequence
atggagggccacgaccccaaggagcccgagcagctgagaaagctgttcatcggcggcctgagcttcgagaccaccgacgacagcctgagagagcacttcgagaagtggggcaccctgaccgactgcgtggtgatgagagacccccagaccaagagaagcagaggcttcggcttcgtgacctacagctgcgtggaggaggtggacgccgccatgtgcgccagaccccacaaggtggacggcagagtggtggagcccaagagagccgtgagcagagaggacagcgtgaagcccggcgcccacctgaccgtgaagaagatcttcgtgggcggcatcaaggaggacaccgaggagtacaacctgagagactacttcgagaagtacggcaagatcgagaccatcgaggtgatggaggacagacagagcggcaagaagagaggcttcgccttcgtgaccttcgacgaccacgacaccgtggacaagatcgtggtgcagaagtaccacaccatcaacggccacaactgcgaggtgaagaaggccctgagcaagcaggagatgcagagcgccggcagccagagaggcagaggcggcggcagcggcaacttcatgggcagaggcggcaacttcggcggcggcggcggcaacttcggcagaggcggcggcaactacggcggcggccccggctacagcagcagaggcggctacggcggcggcggccccggctacggcaaccagggcggcggctacggcggcggcggcggctacgacggctacaacgagggcggcaacttcggcggcggcaactacggcggcggcggcaactacaacgacttcggcaactacagcggccagcagcagagcaactacggccccatgaagggcggcagcttcggcggcagaagcagcggcagcccctacggcggcggctacggcagcggcggcggcagcggcggctacggcagcagaagattctag

SEQ ID NO: 11907 - DNA, 291 bp, Artificial Sequence
  Description of Artificial Sequence: Synthetic coding sequence
aacatccagctggtggccgacggctgctgcaacctgcagaagcagatccagatcacccagctgttcggcgtgcccgtggtggtggccctgaacgtgttcaagaccgacaccagagccgagatcgacctggtgtgcgagctggccaagagagccggcgccttcgacgccgtgccctgctaccactggagcgtgggcggcaagggcagcgtggacctggccagagccgtgagagaggccgccagcaagagaagcagattccagttcctgtacgacgtgcagcccttcagctag

SEQ ID NO: 11908 - DNA, 483 bp, Artificial Sequence
  Description of Artificial Sequence: Synthetic coding sequence
atgaccgacgtgcccgccaccttcacccaggccgagtgcaacggcgacaagccccccgagaacggccagcagaccatcaccaagatcagcgaggagctgaccgacgtggacagccccctgccccactacagagtggagcccagcctggagggcgccctgaccaagggcagccaggaggagagaagaaagctgcagggcaacatgctgctgaacagcagcatggaggacaagatgctgaaggagaaccccgaggagaagctgttcatcgtgcacaaggccatcaccgacctgagcctgcaggagaccagcgccgacgagatgaccttcagagagggccaccagtgggagaagatccccctgagcggcagcaaccaggagatcagaagacagaaggagagaatcaccgagcagcccctgaaggaggaggaggacgaggacagaaagaacaagggccaccaggccgccgagatcgagtggctgtag

SEQ ID NO: 11909 - DNA, 480 bp, Artificial Sequence; identical to SEQ ID NO: 11816
  Description of Artificial Sequence: Synthetic coding sequence

SEQ ID NO: 11910 - DNA, 432 bp, Artificial Sequence
  Description of Artificial Sequence: Synthetic coding sequence
atggacagcagccagcagaagaccttcagaggccacgacgcccccgtgctgagcctgagcttcgaccccaaggacatcttcctggccagcgccagctgcgacggcagcgtgagagtgtggcagatcagcgaccagacctgcgccatcagctggcccctgctgcagaagtgcaacgacgtgatcaacgccaagagcatctgcagactggcctggcagcccaagagcggcaagctgctggccatccccgtggagaagagcgtgaagctgtacagaagagagagctggagccaccagttcgacctgagcgacaacttcatcagccagaccctgaacatcgtgacctggagcccctgcggccagtacctggccgccggcagcatcaacggcctgatcatcgtgtggaacgtggagaccaaggactgcatggagtag

SEQ ID NO: 11911 - DNA, 2109 bp, Artificial Sequence
  Description of Artificial Sequence: Synthetic coding sequence
atgaccgagagatgcagcctgtggagcgccctgagcgccgccgcctgctgcttctacagaggcagcttcgtgcaggtgcagttcagcaaggagaagtacatcctggacagcagccccgagaagctgcacaaggagctggaggaggagctgaagctgagcagcaccgacctgagaagccacgcctggtaccacggcagaatccccagagaggtgagcgagaccctggtgcagagaaacggcgacttcctgatcagagacagcctgaccagcctgggcgactacgtgctgacctgcagatggagaaaccaggccctgcacttcaagatcaacaaggtggtggtgaaggccggcgagagctacacccacatccagtacctgttcgagcaggagagcttcgaccacgtgcccgccctggtgagataccacgtgggcagcagaaaggccgtgagcgagcagagcggcgccatcatctactgccccgtgaacagaaccttccccctgagatacctggaggccagctacggcctgggccagggcagcagcaagcccgccagccccgtgagccccagcggccccaagggcagccacatgaagagaagaagcgtgaccatgaccgacggcctgaccgccgacaaggtgaccagaagcgacggctgccccaccagcaccagcctgcccagacccagagacagcatcagaagctgcgccctgagcatggaccagatccccgacctgcacagccccatgagccccatcagcgagagccccagcagccccgcctacagcaccgtgaccagagtgcacgccgcccccgccgcccccagcgccaccgccctgcccgccagccccgtggccagaagaagcagcgagccccagctgtgccccggcagcgcccccaagacccacggcgagagcgacaagggcccccacaccagccccagccacaccctgggcaaggccagccccagccccagcctgagcagctacagcgaccccgacagcggccactactgccagctgcagccccccgtgagaggcagcagagagtgggccgccaccgagaccagcagccagcaggccagaagctacggcgagagactgaaggagctgagcgagaacggcgcccccgagggcgactggggcaagaccttcaccgtgcccatcgtggaggtgaccagcagcttcaaccccgccaccttccagagcctgctgatccccagagacaacagacccctggaggtgggcctgctgagaaaggtgaaggagctgctggccgaggtggacgccagaaccctggccagacacgtgaccaaggtggactgcctggtggccagaatcctgggcgtgaccaaggagatgcagaccctgatgggcgtgagatggggcatggagctgctgaccctgccccacggcagacagctgagactggacctgctggagagattccacaccatgagcatcatgctggccgtggacatcctgggctgcaccggcagcgccgaggagagagccgccctgctgcacaagaccatccagctggccgccgagctgagaggcaccatgggcaacatgttcagcttcgccgccgtgatgggcgccctggacatggcccagatcagcagactggagcagacctgggtgaccctgagacagagacacaccgagggcgccatcctgtacgagaagaagctgaagcccttcctgaagagcctgaacgagggcaaggagggcccccccctgagcaacaccaccttcccccacgtgctgcccctgatcaccctgctggagtgcgacagcgccccccccgagggccccgagccctggggcagcaccgagcacggcgtggaggtggtgctggcccacctggaggccgccagaaccgtggcccaccacggcggcctgtaccacaccaacgccgaggtgaagctgcagggcttccaggccagacccgagctgctggaggtgttcagcaccgagttccagatgagactgctgtggggcagccagggcgccagcagcagccaggccagaagatacgagaagttcgacaaggtgctgaccgccctgagccacaagctggagcccgccgtgagaagcagcgagctgtag

SEQ ID NO: 11912 - DNA, 585 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagtag

SEQ ID NO: 11913 - DNA, 2334 bp, Artificial Sequence
  Description of Artificial Sequence: Synthetic coding sequence
atggagcccaaggaggccaccggcaaggagaacatggtgaccaagaagaagaacctggccttcctgagaagcagactgtacatgctggagagaagaaagaccgacaccgtggtggagagcagcgtgagcggcgaccacagcggcaccctgagaagaagccagagcgacagaaccgagtacaaccagaagctgcaggagaagatgaccccccagggcgagtgcagcgtggccgagaccctgacccccgaggaggagcaccacatgaagagaatgatggccaagagagagaagatcatcaaggagctgatccagaccgagaaggactacctgaacgacctggagctgtgcgtgagagaggtggtgcagcccctgagaaacaagaagaccgacagactggacgtggacagcctgttcagcaacatcgagagcgtgcaccagatcagcgccaagctgctgagcctgctggaggaggccaccaccgacgtggagcccgccatgcaggtgatcggcgaggtgttcctgcagatcaagggccccctggaggacatctacaagatctactgctaccaccacgacgaggcccacagcatcctggagagctacgagaaggaggaggagctgaaggagcacctgagccactgcatccagagcctgaagaagatctacatgcaggagggcaagcccaacctgctggacatgggcagcctgatgatcaagcccatccagagagtgatgaagtaccccctgctgctgtgcgagctgagaaacagcaccccccccagccaccccgactacagagccctggacgacgccttcgccgccgtgaaggacatcaacgtgaacatcaacgagctgaagagaagaaaggacctggtgctgaagtacaagaagaacgacgaggacgagagcctgaaggacaagctgagcaagctgaacatccacagcatcagcaagaagagcaagagagtgaccaaccacctgaagatcctgaccagaggcgagagccaggtgaaggacaacaccttcaacagagaggagaagctgttcagagccctggagaagaccgtgagactgtgcgtgaagaacatcagcctgtgcctgcagcacatccaggacgccatgcccctggccctgcagagcgtgatggacctgcaggagatcagctacaacaaggacgacgagatggactacagcgagaccctgagcaacgccctgaacagctgccacgacttcgccagccacctgcagagactgatcctgacccccctgagcgccctgctgagcctgttccccggcccccacaagctgatccagaagagatacgacaagctgctggactgcaacagctacctgcagagaagcaccggcgaggagagcgacctggccaagaaggagtacgaggccctgaacgcccagctggtggaggagctgcaggccttcaaccaggccgccagaaagatcctgctgaactgcctgtgcagcttcatcaccctgctgagagacctgatgctggtggcccagcaggcctacagcaccctggtgcccatgcccctgctggtgagcagcatcagcgagatccagaaccaggtgctggaggagatccagaacctgaactgcgtgaaggagaacagcgccaccttcatcgagagaaagctgagcttcgagaagaagaagcccgtgcagatcctgcccgagatgccccaccagaccgacatccacagaagcaagctgctgagcacctacagcgccgaggagctgtaccaggccaagagaaagtgcaacgccacccaggagtacgacatcaacctgctggagggcgacctggtggccgtgatcgagcagaaggaccccctgggcagcaccagcagatggctggtggacaccggcaacgtgaagggctacgtgtacagcagcttcctgaagccctacaaccccgccaagatgcagaaggtggacgccgagaacagattctgcgacgacgacttcgagaacatcagcctgttcgtgagcagcagacccgccagcgacagcgtgaccggcaccagcgagagcagcatcggcgacagcagcagcagcctgagcggcacctgcggcaagttcgagaccaacggcaccgacgtggacagcttccaggaggtggacgagcagatcttctacgccgtgcacgccttccaggccagaagcgaccacgagctgagcctgcaggagtaccagagagtgcacatcctgagattctgcgacctgagcggcaacaaggagtggtggctggccgaggcccagggccagaagggctacgtgcccgccaactacctgggcaagatgacctacgcctag

SEQ ID NO: 11914 - DNA, 543 bp, Artificial Sequence
  Description of Artificial Sequence: Synthetic coding sequence
tgaagccagcccaagagcttcgagaacagccccggcgacctgggcaacagcagcctgcccaccgccggctacaagagagcccagaccagcggcatcgaggaggagaccgtgaaggagaagaagagaaagggcaacaagcagagcaagcacggccccggcagacccaagggcaacaagaaccaggagaacgtgagccacctgagcgtgagcagcgccagccccaccagcagcgtggccagcgccgccggcagcatcaccagcagcagcctgcagaagagccccaccctgctgagaaacggcagcctgcagagcctgagcgtgggcagcagccccgtgggcagcgagatcagcatgcagtacagacacgacggcgcctgccccaccaccagcatctacaacagcaacgacgtggccgtgagcttccccaacgtggtgagcggcagcggcagcagcacccccgtgagcagcagccacctgccccagcagagcagcggccacctgcagcaggtgggcgccctgagccccagcgccgtgagcagctag

SEQ ID NO: 11915 - DNA, 384 bp, Artificial Sequence
  Description of Artificial Sequence: Synthetic coding sequence
atgaccaccaagaacctggagaccaaggtgaccgtgaccagcagccccatcagaggcgccggcgacggcatggagaccgaggagccccccaagagcgtggaggtgaccagcggcgtgcagagcagaaagcaccacagcctgcagagcccctggaagaaggccgtgcccagcgagagccccggcgtgctgcagctgggcaagatgctgaccgagaaggccatggaggtgaaggccgtgagaatcctggtgcccaaggccgccatcacccacgacatccccaacaagaacaccaaggtgaagagcctgggccaccacaagggcgagttcctgggccagagcgagggcgtgatcgagcccaacaaggagctgagcgaggtgaagtag

SEQ ID NO: 11916 - DNA, 1683 bp, Artificial Sequence
  Description of Artificial Sequence: Synthetic coding sequence
atgagcgagcacagcagaaacagcgaccaggaggagctgctggacgaggagatcaacgaggacgagatcctggccaacctgagcgccgaggagctgaaggagctgcagagcgagatggaggtgatggcccccgaccccagcctgcccgtgggcatgatccagaaggaccagaccgacaagccccccaccggcaacttcaaccacaagagcctggtggactacatgtactgggagaaggccagcagaagaatgctggaggaggagagagtgcccgtgaccttcgtgaagagcgaggagaagacccaggaggagcacgaggagatcgagaagagaaacaagaacatggcccagtacctgaaggagaagctgaacaacgagatcgtggccaacaagagagagagcaagggcagcagcaacatccaggagaccgacgaggaggacgaggaggaggaggacgacgacgacgacgacgagggcgaggacgacggcgaggagagcgaggagaccaacagagaggaggagggcaaggccaaggagcagatcagaaactgcgagaacaactgccagcaggtgaccgacaaggccttcaaggagcagagagacagacccgaggcccaggagcagagcgagaagaagatcagcaagctggaccccaagaagctggccctggacaccagcttcctgaaggtgagcaccagacccagcggcaaccagaccgacctggacggcagcctgagaagagtgagaaagaacgaccccgacatgaaggagctgaacctgaacaacatcgagaacatccccaaggagatgctgctggacttcgtgaacgccatgaagaagaacaagcacatcaagaccttcagcctggccaacgtgggcgccgacgagaacgtggccttcgccctggccaacatgctgagagagaacagaagcatcaccaccctgaacatcgagagcaacttcatcaccggcaagggcatcgtggccatcatgagatgcctgcagttcaacgagaccctgaccgagctgagattccacaaccagagacacatgctgggccaccacgccgagatggagatcgccagactgctgaaggccaacaacaccctgctgaagatgggctaccacttcgagctgcccggccccagaatggtggtgaccaacctgctgaccagaaaccaggacaagcagagacagaagagacaggaggagcagaagcagcagcagctgaaggagcagaagaagctgatcgccatgctggagaacggcctgggcctgccccccggcatgtgggagctgctgggcggccccaagcccgacagcagaatgcaggagttcttccagccccccccccccagaccccccaacccccagaacgtgcccttcagccagagaagcgagatgatgaagaagcccagccaggcccccaagtacagaaccgaccccgacagcttcagagtggtgaagctgaagagaatccagagaaagagcagaatgcccgaggccagagagccccccgagaagaccaacctgaaggacgtgatcaagaccctgaagcccgtgcccagaaacagacccccccccctggtggagatcacccccagagaccagctgctgaacgacatcagacacagcagcgtggcctacctgaagcccgtgcagctgcccaaggagctggcctag

SEQ ID NO: 11917 - DNA, 51 bp, Artificial Sequence; identical to SEQ ID NO: 11825
  Description of Artificial Sequence: Synthetic coding sequence

SEQ ID NO: 11918 - DNA, 513 bp, Artificial Sequence
  Description of Artificial Sequence: Synthetic coding sequence
atgcccatcctgctgttcctgatcgacaccagcgccagcatgaaccagagaagccacctgggcaccacctacctggacaccgccaagggcgccgtggagaccttcatgaagctgagagccagagaccccgccagcagaggcgacagatacatgctggtgaccttcgaggagcccccctacgccatcaaggccggctggaaggagaaccacgccaccttcatgaacgagctgaagaacctgcaggccgagggcctgaccaccctgggccagagcctgagaaccgccttcgacctgctgaacctgaacagactggtgaccggcatcgacaactacggccagggcagaaaccccttcttcctggagcccgccatcatcatcaccatcaccgacggcagcaagctgaccaccaccagcggcgtgcaggacgaggccgtgcacatcctgtgcgtgctgcaggagtgcctgatcagcgtgtggagcccctggtgcagaaagtacaaggtgggctggtag

SEQ ID NO: 11919 - DNA, 204 bp, Artificial Sequence
  Description of Artificial Sequence: Synthetic coding sequence
atgagcagaagaagattcgactgcagaagcatcagcggcctgctgaccaccaccccccagatccccatcaagatggagaacttcaacaacttctacatcctgaccagcaaggagctgggcagaggcaagttcgccgtggtgagacagtgcatcagcaagagcaccggccaggagtacgccgccaagttcctgaagaagagatag

SEQ ID NO: 11920 - DNA, 1107 bp, Artificial Sequence
  Description of Artificial Sequence: Synthetic coding sequence
atgctgagcaagagaggctgccacgccagaatctacgccgacttccccatcagaagactgatcagccagagaagcagcctggagaccctggaggacatcgaggagaacgcccccctgagaagatgcagaaccctgagcggcagccccagacccaagaacttcaagaagatccacttcatcaagaacatgagacagcacgacaccagaaacggcagaatcgtgctgatcagcggcagaagaagcttctgcagcatcttcagcgtgctgccctacagagacagcacccaggtgggcgacctgaagctggacggcggcagacagagcaccggcgccgtgagcctgaaggagatcatcggcctggagggcgtggagctgggcgccgacggcaagaccgtgagctacacccagttcctgctgcccaccaacgccttcggcgccagaagaaacaccatcgacagcaccagcagcttcagccagttcagaaacctgagccacagaagcctgagcatcggcagagccagcggcacccagggcagcctggacaccggcagcgacctgggcgacttcatggactacgaccccaacctgctggacgacccccagtggccctgcggcaagcacaagagagtgctgatcttccccagctacatgaccaccgtgatcgactacgtgaagcccagcgacctgaagaaggacatgaacgagaccttcaaggagaagttcccccacatcaagctgaccctgagcaagatcagaagcctgaagagagagatgagaaagctggcccaggaggactgcggcctggaggagcccaccgtggccatggccttcgtgtacttcgagaagctggccctgaagggcaagctgaacaagcagaacagaaagctgtgcgccggcgcctgcgtgctgctggccgccaagatcggcagcgacctgaagaagcacgaggtgaagcacctgatcgacaagctggaggagaagttcagactgaacagaagagagctgatcgccttcgagttccccgtgctggtggccctggagttcgccctgcacctgcccgagcacgaggtgatgccccactacagaagactggtgcagagcagctag

SEQ ID NO: 11921 - DNA, 795 bp, Artificial Sequence
  Description of Artificial Sequence: Synthetic coding sequence
atgaccgacgtgcccgccaccttcacccaggccgagtgcaacggcgacaagccccccgagaacggccagcagaccatcaccaagatcagcgaggagctgaccgacgtggacagccccctgccccactacagagtggagcccagcctggagggcgccctgaccaagggcagccaggaggagagaagaaagctgcagggcaacatgctgctgaacagcagcatggaggacaagatgctgaaggagaccagcgccgacgagatgaccttcagagagggccaccagtgggagaagatccccctgagcggcagcaaccaggagatcagaagacagaaggagagaatcaccgagcagcccctgaaggaggaggaggacgaggacagaaagaacaagggccaccaggccgccgagatcgagtggctgggcttcagaaagcccagccaggccgacatgctgcacagcaagcacgacgaggagcagaaggtgtgggacgaggagatcgacgacgacgacgacgacaactgcaacaacgacgaggacgaggtgagagtgatcgagttcaagaagaagcacgaggaggtgagccagttcaaggaggagggcgacgccagcgaggacagccccctgagcagcgccagcagccaggccgtgacccccgacgagcagcccaccctgggcaagaagagcgacatcagcagaaacgcctacagcagatacaacaccatcagctacagaaagatcagaaagggcaacaccaagcagagaatcgacgagttcgagagcatgatgcacctgtag

SEQ ID NO: 11922 - DNA, 4302 bp, Artificial Sequence; identical to SEQ ID NO: 9764
  Description of Artificial Sequence: Synthetic coding sequence

SEQ ID NO: 11923 - DNA, 810 bp, Artificial Sequence
  Description of Artificial Sequence: Synthetic coding sequence
atgttccccgccctggagacccacctgaagcagaccatccccgacccctacgaggacttcatgtacagacacctgcagtactacggctacttcaaggcccagagaggcagcctgcccaacagcgccacccaccagcacgtgagaaagaacaacccccagtgcctgctgaacggcagcctgggcgagaaggacgacctgatccccgacaccctgcagaaggagaagctgctgtacagccacatgctgagcctgccccacctgagaagcagacagctgctgtacgacgagctggacgaggtgaaccccagactgagagagccccaggagctgttcagcatcctgagcaccaagagacccctgcaggcccccagatggcccatcgagtgcgaggtgatcaaggagaacatccaccacatcgagtgggcccccccccagcccgagtacttctaccagcccaagggcaacgagaaggtgcccgagatcgtgggcgagaagaagggcaccgtggtgtaccagctggacagcgtgcccatcgagggcagctacttcaccagcagcagagtgggcggcaagagaggcatcgtgaaggagctggccgtgaccctgcagggccccgaggacaacaccctgctgttcgagagcagattcgagagcggcaacctgcagaaggccgtgagagtggaccccatgagcatgaacagcccctgcgagctgaccagcaccctgaccaacaccctgagcggcttcatcttcgtgttcagaacccccgagaagatgctgcccatcgccagccccctgagcacctgctag

SEQ ID NO: 11924 - DNA, 975 bp, Artificial Sequence
  Description of Artificial Sequence: Synthetic coding sequence
atgcccctgcaggtgagcgactacagctggcagcagaccaagaccgccgtgttcctgagcctgcccctgaagggcgtgtgcgtgagagacaccgacgtgttctgcaccgagaactacctgaaggtgaacttcccccccttcctgttcgaggccttcctgtacgcccccatcgacgacgagagcagcaaggccaagatcggcaacgacaccatcgtgttcaccctgtacaagaaggaggccgccatgtgggagaccctgagcgtgaccggcgtggacaaggagatgatgcagagaatcagagagaagagcatcctgcaggcccaggagagagccaaggaggccaccgaggccaaggccgccgccaagagagaggaccagaagtacgccctgagcgtgatgatgaagatcgaggaggaggagagaaagaagatcgaggacatgaaggagaacgagagaatcaaggccaccaaggccctggaggcctggaaggagtaccagagaaaggccgaggagcagaagaagatccagagagaggagaagctgtgccagaaggagaagcagatcaaggaggagagaaagaagatcaagtacaagagcctgaccagaaacctggccagcagaaacctggcccccaagggcagaaacagcgagaacatcttcaccgagaagctgaaggaggacagcatccccgcccccagaagcgtgggcagcatcaagatcaacttcacccccagagtgttccccaccgccctgagagagagccaggtggccgaggaggaggagtggctgcacaagcaggccgaggccagaagagccatgaacaccgacatcgccgagctgtgcgacctgaaggaggaggagaagaaccccgagtggctgaaggacaagggcaagcccgagagatgcctgaagatccccgtgaccgtgatccacctggtggtgggcctgagcagcgtgatgagaggccagatctag

SEQ ID NO: 11925 - DNA, 162 bp, Artificial Sequence
  Description of Artificial Sequence: Synthetic coding sequence
atgcagaccagcagcagcagaagcgtgcacctgagcgagtggcagaagaactacttcgccatcaccagcggcatctgcaccggccccaaggccgacgcctacagagcccagatcctgagaatccagtacgcctgggccaacagcgagatcagccaggtgtag

SEQ ID NO: 11926 - DNA, 2079 bp, Artificial Sequence
  Description of Artificial Sequence: Synthetic coding sequence
atggtgaccaccctgggccccaagatggccgccgagtggggcggcggcgtgggctacagcggcagcggccccggcagaagcagatggagatggagcggcagcgtgtgggtgagaagcgtgctgctgctgctgggcggcctgagagccagcgccaccagcacccccgtgagcctgggcagcagccccccctgcagacaccacgtgcccagcgacaccgaggtgatcaacaaggtgcacctgaaggccaaccacgtggtgaagagagacgtggacgagcacctgagaatcaagaccgtgtacgacaagagcgtggaggagctgctgcccgagaagaagaacctggtgaagaacaagctgttcccccaggccatcagctacctggagaagaccttccaggtgagaagacccgccggcaccatcctgctgagcagacagtgcgccaccaaccagtacctgagaaaggagaacgacccccacagatactgcaccggcgagtgcgccgcccacaccaagtgcggccccgtgatcgtgcccgaggagcacctgcagcagtgcagagtgtacagaggcggcaagtggccccacggcgccgtgggcgtgcccgaccaggagggcatcagcgacgccgacttcgtgctgtacgtgggcgccctggccaccgagagatgcagccacgagaacatcatcagctacgccgcctactgccagcaggaggccaacatggacagacccatcgccggctacgccaacctgtgccccaacatgatcagcacccagccccaggagttcgtgggcatgctgagcaccgtgaagcacgaggtgatccacgccctgggcttcagcgccggcctgttcgccttctaccacgacaaggacggcaaccccctgaccagcagattcgccgacggcctgccccccttcaactacagcctgggcctgtaccagtggagcgacaaggtggtgagaaaggtggagagactgtgggacgtgagagacaacaagatcgtgagacacaccgtgtacctgctggtgacccccagagtggtggaggaggccagaaagcacttcgactgccccgtgctggagggcatggagctggagaaccagggcggcgtgggcaccgagctgaaccactgggagaagagactgctggagaacgaggccatgaccggcagccacacccagaacagagtgctgagcagaatcaccctggccctgatggaggacaccggctggtacaaggccaactacagcatggccgagaagctggactggggcagaggcatgggctgcgacttcgtgagaaagagctgcaagttctggatcgaccagcagagacagaagagacagatgctgagcccctactgcgacaccctgagaagcaaccccctgcagctgacctgcagacaggaccagagagccgtggccgtgtgcaacctgcagaagttccccaagcccctgccccaggagtaccagtacttcgacgagctgagcggcatccccgccgaggacctgccctactacggcggcagcgtggagatcgccgactactgccccttcagccaggagttcagctggcacctgagcggcgagtaccagagaagcagcgactgcagaatcctggagaaccagcccgagatcttcaagaactacggcgccgagaagtacggcccccacagcgtgtgcctgatccagaagagcgccttcgtgatggagaagtgcgagagaaagctgagctaccccgactggggcagcggctgctaccaggtgagctgcagcccccagggcctgaaggtgtgggtgcaggacaccagctacctgtgcagcagagccggccaggtgctgcccgtgagcatccagatgaacggctggatccacgacggcaacctgctgtgccccagctgctgggacttctgcgagctgtgcccccccgagaccgacccccccgccaccaacctgaccagagccctgcccctggacctgtgcagctgcagcagcagcctggtggtgaccctgtggctgctgctgggcaacctgttccccctgctggccggcttcctgctgtgcatctggcactag

SEQ ID NO: 11927 - DNA, 3021 bp, Artificial Sequence
  Description of Artificial Sequence: Synthetic coding sequence
atggacagcagccagcagaagaccttcagaggccacgacgcccccgtgctgagcctgagcttcgaccccaaggacatcttcctggccagcgccagctgcgacggcagcgtgagagtgtggcagatcagcgaccagacctgcgccatcagctggcccctgctgcagaagtgcaacgacgtgatcaacgccaagagcatctgcagactggcctggcagcccaagagcggcaagctgctggccatccccgtggagaagagcgtgaagctgtacagaagagagagctggagccaccagttcgacctgagcgacaacttcatcagccagaccctgaacatcgtgacctggagcccctgcggccagtacctggccgccggcagcatcaacggcctgatcatcgtgtggaacgtggagaccaaggactgcatggagagagtgaagcacgagaagggctacgccatctgcggcctggcctggcaccccacctgcggcagaatcagctacaccgacgccgagggcaacctgggcctgctggagaacgtgtgcgaccccagcggcaagaccagcagcagcaaggtgagcagcagagtggagaaggactacaacgacctgttcgacggcgacgacatgagcaacgccggcgacttcctgaacgacaacgccgtggagatccccagcttcagcaagggcatcatcaacgacgacgaggacgacgaggacctgatgatggccagcggcagacccagacagagaagccacatcctggaggacgacgagaacagcgtggacatcagcatgctgaagaccggcagcagcctgctgaaggaggaggaggaggacggccaggagggcagcatccacaacctgcccctggtgaccagccagagacccttctacgacggccccatgcccacccccagacagaagcccttccagagcggcagcacccccctgcacctgacccacagattcatggtgtggaacagcatcggcatcatcagatgctacaacgacgagcaggacaacgccatcgacgtggagttccacgacaccagcatccaccacgccacccacctgagcaacaccctgaactacaccatcgccgacctgagccacgaggccatcctgctggcctgcgagagcaccgacgagctggccagcaagctgcactgcctgcacttcagcagctgggacagcagcaaggagtggatcatcgacctgccccagaacgaggacatcgaggccatctgcctgggccagggctgggccgccgccgccaccagcgccctgctgctgagactgttcaccatcggcggcgtgcagaaggaggtgttcagcctggccggccccgtggtgagcatggccggccacggcgagcagctgttcatcgtgtaccacagaggcaccggcttcgacggcgaccagtgcctgggcgtgcagctgctggagctgggcaagaagaagaagcagatcctgcacggcgaccccctgcccctgaccagaaagagctacctggcctggatcggcttcagcgccgagggcaccccctgctacgtggacagcgagggcatcgtgagaatgctgaacagaggcctgggcaacacctggacccccatctgcaacaccagagagcactgcaagggcaagagcgaccactactgggtggtgggcatccacgagaacccccagcagctgagatgcatcccctgcaagggcagcagattcccccccaccctgcccagacccgccgtggccatcctgagcttcaagctgccctactgccagatcgccaccgagaagggccagatggaggagcagttctggagaagcgtgatcttccacaaccacctggactacctggccaagaacggctacgagtacgaggagagcaccaagaaccaggccaccaaggagcagcaggagctgctgatgaagatgctggccctgagctgcaagctggagagagagttcagatgcgtggagctggccgacctgatgacccagaacgccgtgaacctggccatcaagtacgccagcagaagcagaaagctgatcctggcccagaagctgagcgagctggccgtggagaaggccgccgagctgaccgccacccaggtggaggaggaggaggaggaggaggacttcagaaagaagctgaacgccggctacagcaacaccgccaccgagtggagccagcccagattcagaaaccaggtggaggaggacgccgaggacagcggcgaggccgacgacgaggagaagcccgagatccacaagcccggccagaacagcttcagcaagagcaccaacagcagcgacgtgagcgccaagagcggcgccgtgaccttcagcagccagggcagagtgaaccccttcaaggtgagcgccagcagcaaggagcccgccatgagcatgaacagcgccagaagcaccaacatcctggacaacatgggcaagagcagcaagaagagcaccgccctgagcagaaccaccaacaacgagaagagccccatcatcaagcccctgatccccaagcccaagcccaagcaggccagcgccgccagctacttccagaagagaaacagccagaccaacaagaccgaggaggtgaaggaggagaacctgaagaacgtgctgagcgagacccccgccatctgccccccccagaacaccgagaaccagagacccaagaccggcttccagatgtggctggaggagaacagaagcaacatcctgagcgacaaccccgacttcagcgacgaggccgacatcatcaaggagggcatgatcagattcagagtgctgagcaccgaggagagaaaggtgtgggccaacaaggccaagggcgagaccgccagcgagggcaccgaggccaagaagagaaagagagtggtggacgagagcgacgagaccgagaaccaggaggagaaggccaaggagaacctgaacctgagcaagaagcagaagcccctggacttcagcaccaaccagaagctgagcgccttcgccttcaagcaggagtag

SEQ ID NO: 11928 - DNA, 540 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactggacaccgagaagctgtgcaccttcagccagagattccccctgcccagcatgtacagagccctggtgtggaaggtgctgctgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctggagggcatcaacgtgggctag

SEQ ID NO: 11929 - DNA, 3189 bp, Artificial Sequence
  Description of Artificial Sequence: Synthetic coding sequence
atgatcagcaagggcggcagcgaggccctgctgcagaccctggtggacaccgccagaaccgccccccccgactacgacatcctgctgcccctgttcagactgctggccaaggtgggcctgagagacaagaagatcggcagaaaggccctggagctggaggccctggacgtgaccctgatcctggccagaaagaacctgagccacggccagaacctgctgcactgcctgtgggccctgagagtgttcgccagcagcgtgagcatgggcgccatgctgggcatcaacggcgccatggagctgctgttcaaggtgatcaccccctacaccagaaagagaacccaggccatcagagccgccaccgaggtgctggccgccctgctgaagagcaagagcaacggcagaagagccgtgaacagaggctacgtgaccagcctgctgggcctgcaccaggactggcacagccacgacaccgccaacgcctacgtgcagatcagaagaggcctgctgctgtgcctgagacacatcgccgccctgagaagcggcagagaggccttcctggccgcccagggcatggagatcctgttcagcaccacccagaactgcctggacgacaagagcatggagcccgtgatcagcgtggtgctgcagatcctgagacagtgctaccccaccagccccctgcccctggtgaccgccagcagcgcctacgccttccccgtgcccggctgcatcaccaccgagcccccccacgacctgcccgaggaggacttcgaggacgacggcgacgacgaggtggacaaggacagcgacaccgaggacggcaaggtggaggacgacgacctggagaccgacgtgaacaagctgagcagcaagcccggcctggacagacccgaggaggagctgatgcagtacgaggtgatgtgcctggagctgagctacagcttcgaggagctgcagagcaagctgggcgacgacctgaacagcgagaagacccagtacgccaaccaccaccacatccccgccgccgccagcagcaagcagcactgctacagcaaggaccagagcagctgcggccaggagagagagtacgccgtgcagaccagcctgctgtgcagagtgaagaccggcagaagcaccgtgcacctgggcagcaagaagaaccccggcgtgaacctgtaccagaacgtgcagagcaacagcctgagaagagacagcagcgagagcgagatccccgacatccaggccagccccaaggccgacgcctgggacgtggacgccatcttctgccccagaatgagcgccagcttcagcaacagcaccagaaccagagaggtggtgaaggtgatcgacaagctgctgcagacccacctgaagagagtgcccttccacgacccctacctgtacatggccaaggccagaagaaccagcagcgtggtggacttcaagatgatggccttccccgacgtgtggggccactgccccccccccaccacccagcccatgctggagagaaagtgcggcgtgcagagaatcagaatcttcgaggacatcagaagactgatccagcccagcgacgtgatcaacaaggtggtgttcagcctggacgagccctggcccctgcaggacaacgccagcaactgcctgagattcttcagcaagttcgagagcggcaacctgagaaaggccatccaggtgagagagttcgagtacgacctgctggtgaacgccgacgtgaacagcacccagcaccagcagtggttctacttcaaggtgagcggcatgcaggccgccatcccctaccacttcaacatcatcaactgcgagaagcccaacagccagttcaactacggcatgcagcccaccctgtacagcgtgaaggaggccctgctgggcaagcccacctggatcagaaccggccacgagatctgctactacaagaaccactacagacagagcaccgccgtggccggcggcgccagcggcaagtgctactacaccctgaccttcgccgtgaccttcccccacagcgaggacgtgtgctacctggcctaccactacccctacacctacaccgccctgatgacccacctggacatcctggagaagagcgtgaacctgaaggaggtgtacttcagacaggacgtgctgtgccagaccctgggcggcaacccctgccccctggtgaccatcaccgccatgcccgagagcaacagcgacgagcacctggagcagttcagacacagaccctaccaggtgatcaccgccagagtgcaccccggcgagagcaacgccagctgggtgatgaagggcaccctggagttcctggtgagcagcgaccccgtggccagactgctgagagagaacttcatcttcaagatcatccccatgctgaaccccgacggcgtgatcaacggcaaccacagatgcagcctgagcggcgaggacctgaacagacagtggctgagccccagcgcccacctgcagcccaccatctaccacgccaagggcctgctgtaccacctgagcagcatcggcagaagccccgtggtgttctgcgacttccacggccacagccagaagaagaacgtgttcctgtacggctgcagcatcaaggagaccctgtggcaggccgcctgcaccgtgggcaccagcaccatcctggaggaggtgaactacagaaccctgcccaagatcctggacaagctggcccccgccttcaccatgagcagctgcagcttcctggtggagaagagcagagccagcaccgccagagtggtggtgtggagagagatgggcgtgagcagaagctacaccatggagagcagctactgcggctgcaaccagggcccctaccagtgcacccagagactgctggagagaaccaagaacgagagagcccaccccgtggacggcctgcagggcctgcagttcggcaccagagagctggaggagatgggcgccatgttctgcctgggcctgctgatcctggagctgaagagcgccagctgcagccaccagctgctggcccaggccgccaccctgctgagcgccgaggaggacgccctggaccagcacctgcagagactgaagagcagcaacttcctgcccaagcacatctggttcgcctaccacttcttcgccatcaccaacttcttcaagatgaacctgctgctgcacgtgagcccctag

SEQ ID NO: 11930 - DNA, 738 bp, Artificial Sequence
  Description of Artificial Sequence: Synthetic coding sequence
atggccgccgccccccccagctactgcttcgtggccttcccccccagagccaaggacggcctggtggtgttcggcaagaacagcgccagacccagagacgaggtgcaggaggtggtgtacttcagcgccgccgaccacgagcccgagagcaaggtggagtgcacctacatcagcatcgaccaggtgcccagaacctacgccatcatgatcagcagacccgcctggctgtggggcgccgagatgggcgccaacgagcacggcgtgtgcatcgccaacgaggccatcaacaccagagagcccgccgccgagatcgaggccctgctgggcatggacctggtgagactgggcctggagagaggcgagaccgccaaggaggccctggacgtgatcgtgagcctgctggaggagcacggccagggcggcaactacttcgaggacgccaacagctgccacagcttccagagcgcctacctgatcgtggacagagacgaggcctgggtgctggagaccatcggcaagtactgggccgccgagaaggtgaccgagggcgtgagatgcatctgcagccagctgagcctgaccaccaagatggacgccgagcaccccgagctgagaagctacgcccagagccagggctggtggaccggcgagggcgagttcaacttcagcgaggtgttcagccccgtggaggaccacctggactgcggcgccggcaaggacagcctggagaagcagtag

SEQ ID NO: 11931 - DNA, 99 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagtag

SEQ ID NO: 11932 - DNA, 132 bp, Artificial Sequence
  Description of Artificial Sequence: Synthetic coding sequence
tgagtgctgggcagccccaagcccgaggagatccccctgacctggatccagcccggcaccaccgtgctgaactgcagccacgacttcctgagcgagagcctgatcatcatcagaagaatggccatcttctag

SEQ ID NO: 11933 - DNA, 339 bp, Artificial Sequence
  Description of Artificial Sequence: Synthetic coding sequence
atgttcgccaagctgaagaagaagatcgccgaggagaccgccgtggcccagagacccggcggcgccaccagaatccccagaagcgtgagcaaggagagcgtggccagcatgggcgccgacagcggcgacgacttcgccagcgacggcagcagcagcagagaggacctgagcagccagctgctgagaagaaacgagcagatcagaaagctggaggccagactgagcgactacgccgagcaggtgagaaacctgcagaagatcaaggagaagctggagatcgccctggagaagcaccaggacagcagcatgagaaagttccaggagcagaacgagacctag

SEQ ID NO: 11934 - DNA, 579 bp, Artificial Sequence; identical to SEQ ID NO: 11225
  Description of Artificial Sequence: Synthetic coding sequence

SEQ ID NO: 11935 - DNA, 1458 bp, Artificial Sequence
  Description of Artificial Sequence: Synthetic coding sequence
atggcccccagactgcagctggagaaggccgcctggagatgggccgagaccgtgagacccgaggaggtgagccaggagcacatcgagaccgcctacagaatctggctggagccctgcatcagaggcgtgtgcagaagaaactgcaagggcaaccccaactgcctggtgggcatcggcgagcacatctggctgggcgagatcgacgagaacagcttccacaacatcgacgaccccaactgcgagagaagaaagaagaacagcttcgtgggcctgaccaacctgggcgccacctgctacgtgaacaccttcctgcaggtgtggttcctgaacctggagctgagacaggccctgtacctgtgccccagcacctgcagcgactacatgctgggcgacggcatccaggaggagaaggactacgagccccagaccatctgcgagcacctgcagtacctgttcgccctgctgcagaacagcaacagaagatacatcgaccccagcggcttcgtgaaggccctgggcctggacaccggccagcagcaggacgcccaggagttcagcaagctgttcatgagcctgctggaggacaccctgagcaagcagaagaaccccgacgtgagaaacatcgtgcagcagcagttctgcggcgagtacgcctacgtgaccgtgtgcaaccagtgcggcagagagagcaagctgctgagcaagttctacgagctggagctgaacatccagggccacaagcagctgaccgactgcatcagcgagttcctgaaggaggagaagctggagggcgacaacagatacttctgcgagaactgccagagcaagcagaacgccaccagaaagatcagactgctgagcctgccctgcaccctgaacctgcagctgatgagattcgtgttcgacagacagaccggccacaagaagaagctgaacacctacatcggcttcagcgagatcctggacatggagccctacgtggagcacaagggcggcagctacgtgtacgagctgagcgccgtgctgatccacagaggcgtgagcgcctacagcggccactacatcgcccacgtgaaggacccccagagcggcgagtggtacaagttcaacgacgaggacatcgagaagatggagggcaagaagctgcagctgggcatcgaggaggacctggccgagcccagcaagagccagaccagaaagcccaagtgcggcaagggcacccactgcagcagaaacgcctacatgctggtgtacagactgcagacccaggagaagcccaacaccaccgtgcaggtgcccgccttcctgcaggagctggtggacagagacaacagcaagttcgaggagtggtgcatcgagatggccgagatgagaaagcagagcgtggacaagggcaaggccaagcacgaggaggtgaaggagctgtaccagagactgcccgccggcgccggcctgtag

SEQ ID NO: 11936 - DNA, 1119 bp, Artificial Sequence; identical to SEQ ID NO: 9937
  Description of Artificial Sequence: Synthetic coding sequence

SEQ ID NO: 11937 - DNA, 1548 bp, Artificial Sequence
  Description of Artificial Sequence: Synthetic coding sequence
atgagcgagggcgagagccagaccagcgtgagcccccccgtgaccagcaccaccagcgccgccagccccgaggaggaggaggagagcgaggacgagagcgagatcctggaggagagcccctgcggcagatggcagaagagaagagaggaggtgaaccagagaaacgtgcccggcatcgacagcgcctacctggccatggacaccgaggagggcgtggaggtggtgtggaacgaggtgcagttcagcgagagaaagaactacaagctgcaggaggagaaggtgagagccgtgttcgacaacctgatccagctggagcacctgaacatcgtgaagttccacaagtactgggccgacatcaaggagaacaaggccagagtgatcttcatcaccgagtacatgagcagcggcagcctgaagcagttcctgaagaagaccaagaagaaccacaagaccatgaacgagaaggcctggaagagatggtgcacccagatcctgagcgccctgagctacctgcacagctgcgacccccccatcatccacggcaacctgacctgcgacaccatcttcatccagcacaacggcctgatcaagatcggcagcgtggcccccgacaccatcaacaaccacgtgaagacctgcagagaggagcagaagaacctgcacttcttcgcccccgagtacggcgaggtgaccaacgtgaccaccgccgtggacatctacagcttcggcatgtgcgccctggagatggccgtgctggagatccagggcaacggcgagagcagctacgtgccccaggaggccatcagcagcgccatccagctgctggaggaccccctgcagagagagttcatccagaagtgcctgcagagcgagcccgccagaagacccaccgccagagagctgctgttccaccccgccctgttcgaggtgcccagcctgaagctgctggccgcccactgcatcgtgggccaccagcacatgatccccgagaacgccctggaggagatcaccaagaacatggacaccagcgccgtgctggccgagatccccgccggccccggcagagagcccgtgcagaccctgtacagccagagccccgccctggagctggacaagttcctggaggacgtgagaaacggcatctaccccctgaccgccttcggcctgcccagaccccagcagccccagcaggaggaggtgaccagccccgtggtgccccccagcgtgaagacccccacccccgagcccgccgaggtggagaccagaaaggtggtgctgatgcagtgcaacatcgagagcgtggaggagggcgtgaagcaccacctgaccctgctgctgaagctggaggacaagctgaacagacacctgagctgcgacctgatgcccaacgagaacatccccgagctggccgccgagctggtgcagctgggcttcatcagcgaggccgaccagagcagactgaccagcctgctggaggagaccctgaacaagttcaacttcgccagaaacagcaccctgaacagcgccgccgtgaccgtgagcagctag

SEQ ID NO: 11938 - DNA, 435 bp, Artificial Sequence
  Description of Artificial Sequence: Synthetic coding sequence
atgagcagccccctggccagcctgagcaagaccagaaaggtgcccctgcccagcgagcccatgaaccccggcagaagaggcatcagaatctacggcgacgaggacgaggtggacatgctgagcgacggctgcggcagcgaggagaagatcagcgtgcccagctgctacggcggcatcggcgcccccgtgagcagacaggtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagtag

SEQ ID NO: 11939 - DNA, 1047 bp, Artificial Sequence
  Description of Artificial Sequence: Synthetic coding sequence
atgcccgcccccccctgcgccagctgccacgccgccagagccgccctgagaagacccctgagcggccaggccctgtgcggcgcctgcttctgcgccgccttcgaggccgaggtgctgcacaccgtgctggccggcagactgctgccccccggcgccgtggtggccgtgggcgccagcggcggcaaggacagcaccgtgctggcccacgtgctgagagccctggcccccagactgggcatcagcctgcagctggtggccgtggacgagggcatcggcggctacagagacgccgccctggccgccgtgagaagacaggccgccagatgggagctgcccctgaccgtggtggcctacgaggacctgttcggcggctggaccatggacgccgtggccagaagcaccgccggcagcggcagaagcagaagctgctgcaccttctgcggcgtgctgagaagaagagccctggaggagggcgccagaagagtgggcgccacccacatcgtgaccggccacaacgccgacgacatggccgagaccgtgctgatgaacttcctgagaggcgacgccggcagactggccagaggcggcggcctgggcagccccggcgagggcggcgccctgcccagatgcagacccctgcagttcgccagccagaaggaggtggtgctgtacgcccacttcagaagactggactacttcagcgaggagtgcgtgtacgcccccgaggccttcagaggccacgccagagacctgctgaagagactggaggccgccagacccagcgccgtgctggacctggtgcacagcgccgagagactggccctggcccccgccgccagaccccccagacccggcgcctgcagcagatgcggcgccctggccagcagagccctgtgccaggcctgcgccctgctggacggcctgaacagaggcagacccagactggccatcggcaagggcagaagaggcctggacgaggaggccacccccggcacccccggcgaccccgccagaccccccgccagcaaggccgtgcccaccttctag

SEQ ID NO: 11940 - DNA, 321 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgccctgcccagcgacgtgcagaccgcctag

SEQ ID NO: 11941 - DNA, 198 bp, Artificial Sequence
  Description of Artificial Sequence: Synthetic coding sequence
atggagctgagatgcggcggcctgctgttcagcagcagattcgacagcggcaacctggcccacgtggagaaggtggagagcctgagcagcgacggcgagggcgtgggcggcggcgccagcgccctgaccagcggcatcgccagcagccccgactacgagttcaacgtgtggaccagacccgactgcgccgagacctag

SEQ ID NO: 11942 - DNA, 1371 bp, Artificial Sequence; identical to SEQ ID NO: 11746
  Description of Artificial Sequence: Synthetic coding sequence

SEQ ID NO: 11943 - DNA, 1275 bp, Artificial Sequence
  Description of Artificial Sequence: Synthetic coding sequence
atggaccagcccagcggcagaagcttcatgcaggtgctgtgcgagaagtacagccccgagaacttcccctacagaagaggccccggcatgggcgtgcacgtgcccgccaccccccagggcagccccatgaaggacagactgaacctgcccagcgtgctggtgctgaacagctgcggcatcacctgcgccggcgacgagaaggagatcgccgccttctgcgcccacgtgagcgagctggacctgagcgacaacaagctggaggactggcacgaggtgagcaagatcgtgagcaacgtgccccagctggagttcctgaacctgagcagcaaccccctgaacctgagcgtgctggagagaacctgcgccggcagcttcagcggcgtgagaaagctggtgctgaacaacagcaaggccagctgggagaccgtgcacatgatcctgcaggagctgcccgacctggaggagctgttcctgtgcctgaacgactacgagaccgtgagctgccccagcatctgctgccacagcctgaagctgctgcacatcaccgacaacaacctgcaggactggaccgagatcagaaagctgggcgtgatgttccccagcctggacaccctggtgctggccaacaaccacctgaacgccatcgaggagcccgacgacagcctggccagactgttccccaacctgagaagcatcagcctgcacaagagcggcctgcagagctgggaggacatcgacaagctgaacagcttccccaagctggaggaggtgagactgctgggcatccccctgctgcagccctacaccaccgaggagagaagaaagctggtgatcgccagactgcccagcgtgagcaagctgaacggcagcgtggtgaccgacggcgagagagaggacagcgagagattcttcatcagatactacgtggacgtgccccaggaggaggtgcccttcagataccacgagctgatcaccaagtacggcaagctggagcccctggccgaggtggacctgagaccccagagcagcgccaaggtggaggtgcacttcaacgaccaggtggaggagatgagcatcagactggaccagaccgtggccgagctgaagaagcagctgaagaccctggtgcagctgcccaccagcaacatgctgctgtactacttcgaccacgaggcccccttcggccccgaggagatgaagtacagcagcagagccctgcacagcttcggcatcagagacggcgacaagatctacgtggagagcaagaccaagtag

SEQ ID NO: 11944 - DNA, 264 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggccgaggtgagcatcaacgaggacggcaccctgttcgacggcagacccatcgagagcctgagcctgatcgacgccgtgtag

SEQ ID NO: 11945 - DNA, 360 bp, Artificial Sequence; identical to SEQ ID NO: 10092
  Description of Artificial Sequence: Synthetic coding sequence

SEQ ID NO: 11946 - DNA, 23907 bp, Artificial Sequence
  Description of Artificial Sequence: Synthetic coding sequence
atggaccagccccagttcagcggcgcccccagattcctgaccagacccaaggccttcgtggtgagcgtgggcaaggacgccaccctgagctgccagatcgtgggcaaccccaccccccaggtgagctgggagaaggaccagcagcccgtggccgccggcgccagattcagactggcccaggacggcgacctgtacagactgaccatcctggacctggccctgggcgacagcggccagtacgtgtgcagagccagaaacgccatcggcgaggccttcgccgccgtgggcctgcaggtggacgccgaggccgcctgcgccgagcaggccccccacttcctgctgagacccaccagcatcagagtgagagagggcagcgaggccaccttcagatgcagagtgggcggcagccccagacccgccgtgagctggagcaaggacggcagaagactgggcgagcccgacggccccagagtgagagtggaggagctgggcgaggccagcgccctgagaatcagagccgccagacccagagacggcggcacctacgaggtgagagccgagaaccccctgggcgccgccagcgccgccgccgccctggtggtggacagcgacgccgccgacaccgccagcagacccggcaccagcaccgccgccctgctggcccacctgcagagaagaagagaggccatgagagccgagggcgcccccgccagcccccccagcaccggcaccagaacctgcaccgtgaccgagggcaagcacgccagactgagctgctacgtgaccggcgagcccaagcccgagaccgtgtggaagaaggacggccagctggtgaccgagggcagaagacacgtggtgtacgaggacgcccaggagaacttcgtgctgaagatcctgttctgcaagcagagcgacagaggcctgtacacctgcaccgccagcaacctggtgggccagacctacagcagcgtgctggtggtggtgagagagcccgccgtgcccttcaagaagagactgcaggacctggaggtgagagagaaggagagcgccaccttcctgtgcgaggtgccccagcccagcaccgaggccgcctggttcaaggaggagaccagactgtgggccagcgccaagtacggcatcgaggaggagggcaccgagagaagactgaccgtgagaaacgtgagcgccgacgacgacgccgtgtacatctgcgagacccccgagggcagcagaaccgtggccgagctggccgtgcagggcaacctgctgagaaagctgcccagaaagaccgccgtgagagtgggcgacaccgccatgttctgcgtggagctggccgtgcccgtgggccccgtgcactggctgagaaaccaggaggaggtggtggccggcggcagagtggccatcagcgccgagggcaccagacacaccctgaccatcagccagtgctgcctggaggacgtgggccaggtggccttcatggccggcgactgccagaccagcacccagttctgcgtgagcgcccccagaaagccccccctgcagccccccgtggaccccgtggtgaaggccagaatggagagcagcgtgatcctgagctggagcccccccccccacggcgagagacccgtgaccatcgacggctacctggtggagaagaagaagctgggcacctacacctggatcagatgccacgaggccgagtgggtggccacccccgagctgaccgtggccgacgtggccgaggagggcaacttccagttcagagtgagcgccctgaacagcttcggccagagcccctacctggagttccccggcaccgtgcacctggcccccaagctggccgtgagaacccccctgaaggccgtgcaggccgtggagggcggcgaggtgaccttcagcgtggacctgaccgtggccagcgccggcgagtggttcctggacggccaggccctgaaggccagcagcgtgtacgagatccactgcgacagaaccagacacaccctgaccatcagagaggtgcccgccagcctgcacggcgcccagctgaagttcgtggccaacggcatcgagagcagcatcagaatggaggtgagagccgcccccggcctgaccgccaacaagccccccgccgccgccgccagagaggtgctggccagactgcacgaggaggcccagctgctggccgagctgagcgaccaggccgccgccgtgacctggctgaaggacggcagaaccctgagccccggccccaagtacgaggtgcaggccagcgccggcagaagagtgctgctggtgagagacgtggccagagacgacgccggcctgtacgagtgcgtgagcagaggcggcagaatcgcctaccagctgagcgtgcagggcctggccagattcctgcacaaggacatggccggcagctgcgtggacgccgtggccggcggccccgcccagttcgagtgcgagaccagcgaggcccacgtgcacgtgcactggtacaaggacggcatggagctgggccacagcggcgagagattcctgcaggaggacgtgggcaccagacacagactggtggccgccaccgtgaccagacaggacgagggcacctacagctgcagagtgggcgaggacagcgtggacttcagactgagagtgagcgagcccaaggtggtgttcgccaaggagcagctggccagaagaaagctgcaggccgaggccggcgccagcgccaccctgagctgcgaggtggcccaggcccagaccgaggtgacctggtacaaggacggcaagaagctgagcagcagcagcaaggtgtgcatggaggccaccggctgcaccagaagactggtggtgcagcaggccggccaggccgacgccggcgagtacagctgcgaggccggcggccagagactgagcttccacctggacgtgaaggagcccaaggtggtgttcgccaaggaccaggtggcccacagcgaggtgcaggccgaggccggcgccagcgccaccctgagctgcgaggtggcccaggcccagaccgaggtgatgtggtacaaggacggcaagaagctgagcagcagcctgaaggtgcacgtggaggccaagggctgcagaagaagactggtggtgcagcaggccggcaagaccgacgccggcgactacagctgcgaggccagaggccagagagtgagcttcagactgcacatcaccgagcccaagatgatgttcgccaaggagcagagcgtgcacaacgaggtgcaggccgaggccggcgccagcgccatgctgagctgcgaggtggcccaggcccagaccgaggtgacctggtacaaggacggcaagaagctgagcagcagcagcaaggtgggcatggaggtgaagggctgcaccagaagactggtgctgccccaggccggcaaggccgacgccggcgagtacagctgcgaggccggcggccagagagtgagcttccacctgcacatcaccgagcccaagggcgtgttcgccaaggagcagagcgtgcacaacgaggtgcaggccgaggccggcaccaccgccatgctgagctgcgaggtggcccagccccagaccgaggtgacctggtacaaggacggcaagaagctgagcagcagcagcaaggtgagaatggaggtgaagggctgcaccagaagactggtggtgcagcaggtgggcaaggccgacgccggcgagtacagctgcgaggccggcggccagagagtgagcttccagctgcacatcaccgagcccaaggccgtgttcgccaaggagcagctggtgcacaacgaggtgagaaccgaggccggcgccagcgccaccctgagctgcgaggtggcccaggcccagaccgaggtgacctggtacaaggacggcaagaagctgagcagcagcagcaaggtgagaatcgaggccgccggctgcatgagacagctggtggtgcagcaggccggccaggccgacgccggcgagtacacctgcgaggccggcggccagagactgagcttccacctggacgtgagcgagcccaaggccgtgttcgccaaggagcagctggcccacagaaaggtgcaggccgaggccggcgccatcgccaccctgagctgcgaggtggcccaggcccagaccgaggtgacctggtacaaggacggcaagaagctgagcagcagcagcaaggtgagaatggaggccgtgggctgcaccagaagactggtggtgcagcaggcctgccaggccgacaccggcgagtacagctgcgaggccggcggccagagactgagcttcagcctggacgtggccgagcccaaggtggtgttcgccaaggagcagcccgtgcacagagaggtgcaggcccaggccggcgccagcaccaccctgagctgcgaggtggcccaggcccagaccgaggtgatgtggtacaaggacggcaagaagctgagcttcagcagcaaggtgagaatggaggccgtgggctgcaccagaagactggtggtgcagcaggccggccaggccgtggccggcgagtacagctgcgaggccggcagccagagactgagcttccacctgcacgtggccgagcccaaggccgtgttcgccaaggagcagcccgccagcagagaggtgcaggccgaggccggcaccagcgccaccctgagctgcgaggtggcccaggcccagaccgaggtgacctggtacaaggacggcaagaagctgagcagcagcagcaaggtgagaatggaggccgtgggctgcaccagaagactggtggtgcaggaggccggccaggccgacgccggcgagtacagctgcaaggccggcgaccagagactgagcttccacctgcacgtggccgagcccaaggtggtgttcgccaaggagcagcccgcccacagagaggtgcaggccgaggccggcgccagcgccaccctgagctgcgaggtggcccaggcccagaccgaggtgacctggtacaaggacggcaagaagctgagcagcagcagcaaggtgagagtggaggccgtgggctgcaccagaagactggtggtgcagcaggccggccaggccgaggccggcgagtacagctgcgaggccggcggccagcagctgagcttcagactgcaggtggccgagctggagccccagatcagcgagagaccctgcagaagagagcccctggtggtgaaggagcacgaggacatcatcctgaccgccaccctggccacccccagcgccgccaccgtgacctggctgaaggacggcgtggagatcagaagaagcaagagacacgagaccgccagccagggcgacacccacaccctgaccgtgcacggcgcccaggtgctggacagcgccatctacagctgcagagtgggcgccgagggccaggacttccccgtgcaggtggaggaggtggccgccaagttctgcagactgctggagcccgtgtgcggcgagctgggcggcaccgtgaccctggcctgcgagctgagccccgcctgcgccgaggtggtgtggagatgcggcaacacccagctgagagtgggcaagagattccagatggtggccgagggccccgtgagaagcctgaccgtgctgggcctgagagccgaggacgccggcgagtacgtgtgcgagagcagagacgaccacaccagcgcccagctgaccgtgagcgtgcccagagtggtgaagttcatgagcggcctgagcaccgtggtggccgaggagggcggcgaggccaccttccagtgcgtggtgagccccagcgacgtggccgtggtgtggttcagagacggcgccctgctgcagcccagcgagaagttcgccatcagccagagcggcgccagccacagcctgaccatcagcgacctggtgctggaggacgccggccagatcaccgtggaggccgagggcgccagcagcagcgccgccctgagagtgagagaggcccccgtgctgttcaagaagaagctggagccccagaccgtggaggagagaagcagcgtgaccctggaggtggagctgaccagaccctggcccgagctgagatggaccagaaacgccaccgccctggcccccggcaagaacgtggagatccacgccgagggcgccagacacagactggtgctgcacaacgtgggcttcgccgacagaggcttcttcggctgcgagacccccgacgacaagacccaggccaagctgaccgtggagatgagacaggtgagactggtgagaggcctgcaggccgtggaggccagagagcagggcaccgccaccatggaggtgcagctgagccacgccgacgtggacggcagctggaccagagacggcctgagattccagcagggccccacctgccacctggccgtgagaggccccatgcacaccctgaccctgagcggcctgagacccgaggacagcggcctgatggtgttcaaggccgagggcgtgcacaccagcgccagactggtggtgaccgagctgcccgtgagcttcagcagacccctgcaggacgtggtgaccaccgagaaggagaaggtgaccctggagtgcgagctgagcagacccaacgtggacgtgagatggctgaaggacggcgtggagctgagagccggcaagaccatggccatcgccgcccagggcgcctgcagaagcctgaccatctacagatgcgagttcgccgaccagggcgtgtacgtgtgcgacgcccacgacgcccagagcagcgccagcgtgaaggtgcagggcagaacctacaccctgatctacagaagagtgctggccgaggacgccggcgagatccagttcgtggccgagaacgccgagagcagagcccagctgagagtgaaggagctgcccgtgaccctggtgagacccctgagagacaagatcgccatggagaagcacagaggcgtgctggagtgccaggtgagcagagccagcgcccaggtgagatggttcaagggcagccaggagctgcagcccggccccaagtacgagctggtgagcgacggcctgtacagaaagctgatcatcagcgacgtgcacgccgaggacgaggacacctacacctgcgacgccggcgacgtgaagaccagcgcccagttcttcgtggaggagcagagcatcaccatcgtgagaggcctgcaggacgtgaccgtgatggagcccgcccccgcctggttcgagtgcgagaccagcatccccagcgtgagaccccccaagtggctgctgggcaagaccgtgctgcaggccggcggcaacgtgggcctggagcaggagggcaccgtgcacagactgatgctgagaagaacctgcagcaccatgaccggccccgtgcacttcaccgtgggcaagagcagaagcagcgccagactggtggtgagcgacatccccgtggtgctgaccagacccctggagcccaagaccggcagagagctgcagagcgtggtgctgagctgcgacttcagacccgcccccaaggccgtgcagtggtacaaggacgacacccccctgagccccagcgagaagttcaagatgagcctggagggccagatggccgagctgagaatcctgagactgatgcccgccgacgccggcgtgtacagatgccaggccggcagcgcccacagcagcaccgaggtgaccgtggaggccagagaggtgaccgtgaccggccccctgcaggacgccgaggccaccgaggagggctgggccagcttcagctgcgagctgagccacgaggacgaggaggtggagtggagcctgaacggcatgcccctgtacaacgacagcttccacgagatcagccacaagggcagaagacacaccctggtgctgaagagcatccagagagccgacgccggcatcgtgagagccagcagcctgaaggtgagcaccagcgccagactggaggtgagagtgaagcccgtggtgttcctgaaggccctggacgacctgagcgccgaggagagaggcaccctggccctgcagtgcgaggtgagcgaccccgaggcccacgtggtgtggagaaaggacggcgtgcagctgggccccagcgacaagtacgacttcctgcacaccgccggcaccagaggcctggtggtgcacgacgtgagccccgaggacgccggcctgtacacctgccacgtgggcagcgaggagaccagagccagagtgagagtgcacgacctgcacgtgggcatcaccaagagactgaagaccatggaggtgctggagggcgagagctgcagcttcgagtgcgtgctgagccacgagagcgccagcgaccccgccatgtggaccgtgggcggcaagaccgtgggcagcagcagcagattccaggccaccagacagggcagaaagtacatcctggtggtgagagaggccgcccccagcgacgccggcgaggtggtgttcagcgtgagaggcctgaccagcaaggccagcctgatcgtgagagagagacccgccgccatcatcaagcccctggaggaccagtgggtggcccccggcgaggacgtggagctgagatgcgagctgagcagagccggcacccccgtgcactggctgaaggacagaaaggccatcagaaagagccagaagtacgacgtggtgtgcgagggcaccatggccatgctggtgatcagaggcgccagcctgaaggacgccggcgagtacacctgcgaggtggaggccagcaagagcaccgccagcctgcacgtggaggagaaggccaactgcttcaccgaggagctgaccaacctgcaggtggaggagaagggcaccgccgtgttcacctgcaagaccgagcaccccgccgccaccgtgacctggagaaagggcctgctggagctgagagccagcggcaagcaccagcccagccaggagggcctgaccctgagactgaccatcagcgccctggagaaggccgacagcgacacctacacctgcgacatcggccaggcccagagcagagcccagctgctggtgcagggcagaagagtgcacatcatcgaggacctggaggacgtggacgtgcaggagggcagcagcgccaccttcagatgcagaatcagccccgccaactacgagcccgtgcactggttcctggacaagacccccctgcacgccaacgagctgaacgagatcgacgcccagcccggcggctaccacgtgctgaccctgagacagctggccctgaaggacagcggcaccatctacttcgaggccggcgaccagagagccagcgccgccctgagagtgaccgagaagcccagcgtgttcagcagagagctgaccgacgccaccatcaccgagggcgaggacctgaccctggtgtgcgagaccagcacctgcgacatccccgtgtgctggaccaaggacggcaagaccctgagaggcagcgccagatgccagctgagccacgagggccacagagcccagctgctgatcaccggcgccaccctgcaggacagcggcagatacaagtgcgaggccggcggcgcctgcagcagcagcatcgtgagagtgcacgccagacccgtgagattccaggaggccctgaaggacctggaggtgctggagggcggcgccgccaccctgagatgcgtgctgagcagcgtggccgcccccgtgaagtggtgctacggcaacaacgtgctgagacccggcgacaagtacagcctgagacaggagggcgccatgctggagctggtggtgagaaacctgagaccccaggacagcggcagatacagctgcagcttcggcgaccagaccaccagcgccaccctgaccgtgaccgccctgcccgcccagttcatcggcaagctgagaaacaaggaggccaccgagggcgccaccgccaccctgagatgcgagctgagcaaggccgcccccgtggagtggagaaagggcagcgagaccctgagagacggcgacagatactgcctgagacaggacggcgccatgtgcgagctgcagatcagaggcctggccatggtggacgccgccgagtacagctgcgtgtgcggcgaggagagaaccagcgccagcctgaccatcagacccatgcccgcccacttcatcggcagactgagacaccaggagagcatcgagggcgccaccgccaccctgagatgcgagctgagcaaggccgcccccgtggagtggagaaagggcagagagagcctgagagacggcgacagacacagcctgagacaggacggcgccgtgtgcgagctgcagatctgcggcctggccgtggccgacgccggcgagtacagctgcgtgtgcggcgaggagagaaccagcgccaccctgaccgtgaaggccctgcccgccaagttcaccgagggcctgagaaacgaggaggccgtggagggcgccaccgccatgctgtggtgcgagctgagcaaggtggcccccgtggagtggagaaagggccccgagaacctgagagacggcgacagatacatcctgagacaggagggcaccagatgcgagctgcagatctgcggcctggccatggccgacgccggcgagtacctgtgcgtgtgcggccaggagagaaccagcgccaccctgaccatcagagccctgcccgccagattcatcgaggacgtgaagaaccaggaggccagagagggcgccaccgccgtgctgcagtgcgagctgaacagcgccgcccccgtggagtggagaaagggcagcgagaccctgagagacggcgacagatacagcctgagacaggacggcaccaagtgcgagctgcagatcagaggcctggccatggccgacaccggcgagtacagctgcgtgtgcggccaggagagaaccagcgccatgctgaccgtgagagccctgcccatcaagttcaccgagggcctgagaaacgaggaggccaccgagggcgccaccgccgtgctgagatgcgagctgagcaagatggcccccgtggagtggtggaagggccacgagaccctgagagacggcgacagacacagcctgagacaggacggcgccagatgcgagctgcagatcagaggcctggtggccgaggacgccggcgagtacctgtgcatgtgcggcaaggagagaaccagcgccatgctgaccgtgagagccatgcccagcaagttcatcgagggcctgagaaacgaggaggccaccgagggcgacaccgccaccctgtggtgcgagctgagcaaggccgcccccgtggagtggagaaagggccacgagaccctgagagacggcgacagacacagcctgagacaggacggcagcagatgcgagctgcagatcagaggcctggccgtggtggacgccggcgagtacagctgcgtgtgcggccaggagagaaccagcgccaccctgaccgtgagagccctgcccgccagattcatcgaggacgtgaagaaccaggaggccagagagggcgccaccgccgtgctgcagtgcgagctgagcaaggccgcccccgtggagtggagaaagggcagcgagaccctgagaggcggcgacagatacagcctgagacaggacggcaccagatgcgagctgcagatccacggcctgagcgtggccgacaccggcgagtacagctgcgtgtgcggccaggagagaaccagcgccaccctgaccgtgagagccccccagcccgtgttcagagagcccctgcagagcctgcaggccgaggagggcagcaccgccaccctgcagtgcgagctgagcgagcccaccgccaccgtggtgtggagcaagggcggcctgcagctgcaggccaacggcagaagagagcccagactgcagggctgcaccgccgagctggtgctgcaggacctgcagagagaggacaccggcgagtacacctgcacctgcggcagccaggccaccagcgccaccctgaccgtgaccgccgcccccgtgagattcctgagagagctgcagcaccaggaggtggacgagggcggcaccgcccacctgtgctgcgagctgagcagagccggcgccagcgtggagtggagaaagggcagcctgcagctgttcccctgcgccaagtaccagatggtgcaggacggcgccgccgccgagctgctggtgagaggcgtggagcaggaggacgccggcgactacacctgcgacaccggccacacccagagcatggccagcctgagcgtgagagtgcccagacccaagttcaagaccagactgcagagcctggagcaggagaccggcgacatcgccagactgtgctgccagctgagcgacgccgagagcggcgccgtggtgcagtggctgaaggagggcgtggagctgcacgccggccccaagtacgagatgagaagccagggcgccaccagagagctgctgatccaccagctggaggccaaggacaccggcgagtacgcctgcgtgaccggcggccagaagaccgccgccagcctgagagtgaccgagcccgaggtgaccatcgtgagaggcctggtggacgccgaggtgaccgccgacgaggacgtggagttcagctgcgaggtgagcagagccggcgccaccggcgtgcagtggtgcctgcagggcctgcccctgcagagcaacgaggtgaccgaggtggccgtgagagacggcagaatccacaccctgagactgaagggcgtgacccccgaggacgccggcaccgtgagcttccacctgggcaaccacgccagcagcgcccagctgaccgtgagagcccccgaggtgaccatcctggagcccctgcaggacgtgcagctgagcgagggccaggacgccagcttccagtgcagactgagcagagccagcggccaggaggccagatgggccctgggcggcgtgcccctgcaggccaacgagatgaacgacatcaccgtggagcagggcaccctgcacctgctgaccctgcacaaggtgaccctggaggacgccggcaccgtgagcttccacgtgggcacctgcagcagcgaggcccagctgaaggtgaccgccaagaacaccgtggtgagaggcctggagaacgtggaggccctggagggcggcgaggccctgttcgagtgccagctgagccagcccgaggtggccgcccacacctggctgctggacgacgagcccgtgcacaccagcgagaacgccgaggtggtgttcttcgagaacggcctgagacacctgctgctgctgaagaacctgagaccccaggacagctgcagagtgaccttcctggccggcgacatggtgaccagcgccttcctgaccgtgagaggctggagactggagatcctggagcccctgaagaacgccgccgtgagagccggcgcccaggcctgcttcacctgcaccctgagcgaggccgtgcccgtgggcgaggccagctggtacatcaacggcgccgccgtgcagcccgacgacagcgactggaccgtgaccgccgacggcagccaccacgccctgctgctgagaagcgcccagccccaccacgccggcgaggtgaccttcgcctgcagagacgccgtggccagcgccagactgaccgtgctgggcctgcccgacccccccgaggacgccgaggtggtggccagaagcagccacaccgtgaccctgagctgggccgcccccatgagcgacggcggcggcggcctgtgcggctacagagtggaggtgaaggagggcgccaccggccagtggagactgtgccacgagctggtgcccggccccgagtgcgtggtggacggcctggcccccggcgagacctacagattcagagtggccgccgtgggccccgtgggcgccggcgagcccgtgcacctgccccagaccgtgagactggccgagccccccaagcccgtgcccccccagcccagcgcccccgagagcagacaggtggccgccggcgaggacgtgagcctggagctggaggtggtggccgaggccggcgaggtgatctggcacaagggcatggagagaatccagcccggcggcagattcgaggtggtgagccagggcagacagcagatgctggtgatcaagggcttcaccgccgaggaccagggcgagtaccactgcggcctggcccagggcagcatctgccccgccgccgccaccttccaggtggccctgagccccgccagcgtggacgaggccccccagcccagcctgccccccgaggccgcccaggagggcgacctgcacctgctgtgggaggccctggccagaaagagaagaatgagcagagagcccaccctggacagcatcagcgagctgcccgaggaggacggcagaagccagagactgccccaggaggccgaggaggtggcccccgacctgagcgagggctacagcaccgccgacgagctggccagaaccggcgacgccgacctgagccacaccagcagcgacgacgagagcagagccggcacccccagcctggtgacctacctgaagaaggccggcagacccggcaccagccccctggccagcaaggtgggcgcccccgccgcccccagcgtgaagccccagcagcagcaggagcccctggccgccgtgagaccccccctgggcgacctgagcaccaaggacctgggcgaccccagcatggacaaggccgccgtgaagatccaggccgccttcaagggctacaaggtgagaaaggagatgaagcagcaggagggccccatgttcagccacaccttcggcgacaccgaggcccaggtgggcgacgccctgagactggagtgcgtggtggccagcaaggccgacgtgagagccagatggctgaaggacggcgtggagctgaccgacggcagacaccaccacatcgaccagctgggcgacggcacctgcagcctgctgatcaccggcctggacagagccgacgccggctgctacacctgccaggtgagcaacaagttcggccaggtgacccacagcgcctgcgtggtggtgagcggcagcgagagcgaggccgagagcagcagcggcggcgagctggacgacgccttcagaagagccgccagaagactgcacagactgttcagaaccaagagccccgccgaggtgagcgacgaggagctgttcctgagcgccgacgagggccccgccgagcccgaggagcccgccgactggcagacctacagagaggacgagcacttcatctgcatcagattcgaggccctgaccgaggccagacaggccgtgaccagattccaggagatgttcgccaccctgggcatcggcgtggagatcaagctggtggagcagggccccagaagagtggagatgtgcatcagcaaggagacccccgcccccgtggtgccccccgagcccctgcccagcctgctgaccagcgacgccgcccccgtgttcctgaccgagctgcagaaccaggaggtgcaggacggctaccccgtgagcttcgactgcgtggtgaccggccagcccatgcccagcgtgagatggttcaaggacggcaagctgctggaggaggacgaccactacatgatcaacgaggaccagcagggcggccaccagctgatcatcaccgccgtggtgcccgccgacatgggcgtgtacagatgcctggccgagaacagcatgggcgtgagcagcaccaaggccgagctgagagtggacctgaccagcaccgactacgacaccgccgccgacgccaccgagagcagcagctacttcagcgcccagggctacctgagcagcagagagcaggagggcaccgagagcaccaccgacgagggccagctgccccaggtggtggaggagctgagagacctgcaggtggcccccggcaccagactggccaagttccagctgaaggtgaagggctaccccgcccccagactgtactggttcaaggacggccagcccctgaccgccagcgcccacatcagaatgaccgacaagaagatcctgcacaccctggagatcatcagcgtgaccagagaggacagcggccagtacgccgcctacatcagcaacgccatgggcgccgcctacagcagcgccagactgctggtgagaggccccgacgagcccgaggagaagcccgccagcgacgtgcacgagcagctggtgccccccagaatgctggagagattcacccccaagaaggtgaagaagggcagcagcatcaccttcagcgtgaaggtggagggcagacccgtgcccaccgtgcactggctgagagaggaggccgagagaggcgtgctgtggatcggccccgacacccccggctacaccgtggccagcagcgcccagcagcacagcctggtgctgctggacgtgggcagacagcaccagggcacctacacctgcatcgccagcaacgccgccggccaggccctgtgcagcgccagcctgcacgtgagcggcctgcccaaggtggaggagcaggagaaggtgaaggaggccctgatcagcaccttcctgcagggcaccacccaggccatcagcgcccagggcctggagaccgccagcttcgccgacctgggcggccagagaaaggaggagcccctggccgccaaggaggccctgggccacctgagcctggccgaggtgggcaccgaggagttcctgcagaagctgaccagccagatcaccgagatggtgagcgccaagatcacccaggccaagctgcaggtgcccggcggcgacagcgacgaggacagcaagacccccagcgccagccccagacacggcagaagcagacccagcagcagcatccaggagagcagcagcgagagcgaggacggcgacgccagaggcgagatcttcgacatctacgtggtgaccgccgactacctgcccctgggcgccgagcaggacgccatcaccctgagagagggccagtacgtggaggtgctggacgccgcccaccccctgagatggctggtgagaaccaagcccaccaagagcagccccagcagacagggctgggtgagccccgcctacctggacagaagactgaagctgagccccgagtggggcgccgccgaggcccccgagttccccggcgaggccgtgagcgaggacgagtacaaggccagactgagcagcgtgatccaggagctgctgagcagcgagcaggccttcgtggaggagctgcagttcctgcagagccaccacctgcagcacctggagagatgcccccacgtgcccatcgccgtggccggccagaaggccgtgatcttcagaaacgtgagagacatcggcagattccacagcagcttcctgcaggagctgcagcagtgcgacaccgacgacgacgtggccatgtgcttcatcaagaaccaggccgccttcgagcagtacctggagttcctggtgggcagagtgcaggccgagagcgtggtggtgagcaccgccatccaggagttctacaagaagtacgccgaggaggccctgctggccggcgaccccagccagcccccccccccccccctgcagcactacctggagcagcccgtggagagagtgcagagataccaggccctgctgaaggagctgatcagaaacaaggccagaaacagacagaactgcgccctgctggagcaggcctacgccgtggtgagcgccctgccccagagagccgagaacaagctgcacgtgagcctgatggagaactaccccggcaccctgcaggccctgggcgagcccatcagacagggccacttcatcgtgtgggagggcgcccccggcgccagaatgccctggaagggccacaacagacacgtgttcctgttcagaaaccacctggtgatctgcaagcccagaagagacagcagaaccgacaccgtgagctacgtgttcagaaacatgatgaagctgagcagcatcgacctgaacgaccaggtggagggcgacgacagagccttcgaggtgtggcaggagagagaggacagcgtgagaaagtacctgctgcaggccagaaccgccatcatcaagagcagctgggtgaaggagatctgcggcatccagcagagactggccctgcccgtgtggagaccccccgacttcgaggaggagctggccgactgcaccgccgagctgggcgagaccgtgaagctggcctgcagagtgaccggcacccccaagcccgtgatcagctggtacaaggacggcaaggccgtgcaggtggacccccaccacatcctgatcgaggaccccgacggcagctgcgccctgatcctggacagcctgaccggcgtggacagcggccagtacatgtgcttcgccgccagcgccgccggcaactgcagcaccctgggcaagatcctggtgcaggtgccccccagattcgtgaacaaggtgagagccagccccttcgtggagggcgaggacgcccagttcacctgcaccatcgagggcgccccctacccccagatcagatggtacaaggacggcgccctgctgaccaccggcaacaagttccagaccctgagcgagcccagaagcggcctgctggtgctggtgatcagagccgccagcaaggaggacctgggcctgtacgagtgcgagctggtgaacagactgggcagcgccagagccagcgccgagctgagaatccagagccccatgctgcaggcccaggagcagtgccacagagagcagctggtggccgccgtggaggacaccaccctggagagagccgaccaggaggtgaccagcgtgctgaagagactgctgggccccaaggcccccggccccagcaccggcgacctgaccggccccggcccctgccccagaggcgcccccgccctgcaggagaccggcagccagccccccgtgaccggcaccagcgaggcccccgccgtgccccccagagtgccccagcccctgctgcacgagggccccgagcaggagcccgaggccatcgccagagcccaggagtggaccgtgcccatcagaatggagggcgccgcctggcccggcgccggcaccggcgagctgctgtgggacgtgcacagccacgtggtgagagagaccacccagagaacctacacctaccaggccatcgacacccacaccgccagaccccccagcatgcaggtgaccatcgaggacgtgcaggcccagaccggcggcaccgcccagttcgaggccatcatcgagggcgacccccagcccagcgtgacctggtacaaggacagcgtgcagctggtggacagcaccagactgagccagcagcaggagggcaccacctacagcctggtgctgagacacgtggccagcaaggacgccggcgtgtacacctgcctggcccagaacaccggcggccaggtgctgtgcaaggccgagctgctggtgctgggcggcgacaacgagcccgacagcgagaagcagagccacagaagaaagctgcacagcttctacgaggtgaaggaggagatcggcagaggcgtgttcggcttcgtgaagagagtgcagcacaagggcaacaagatcctgtgcgccgccaagttcatccccctgagaagcagaaccagagcccaggcctacagagagagagacatcctggccgccctgagccaccccctggtgaccggcctgctggaccagttcgagaccagaaagaccctgatcctgatcctggagctgtgcagcagcgaggagctgctggacagactgtacagaaagggcgtggtgaccgaggccgaggtgaaggtgtacatccagcagctggtggagggcctgcactacctgcacagccacggcgtgctgcacctggacatcaagcccagcaacatcctgatggtgcaccccgccagagaggacatcaagatctgcgacttcggcttcgcccagaacatcacccccgccgagctgcagttcagccagtacggcagccccgagttcgtgagccccgagatcatccagcagaaccccgtgagcgaggccagcgacatctgggccatgggcgtgatcagctacctgagcctgacctgcagcagccccttcgccggcgagagcgacagagccaccctgctgaacgtgctggagggcagagtgagctggagcagccccatggccgcccacctgagcgaggacgccaaggacttcatcaaggccaccctgcagagagccccccaggccagacccagcgccgcccagtgcctgagccacccctggttcctgaagagcatgcccgccgaggaggcccacttcatcaacaccaagcagctgaagttcctgctggccagaagcagatggcagagaagcctgatgagctacaagagcatcctggtgatgagaagcatccccgagctgctgagaggcccccccgacagccccagcctgggcgtggccagacacctgtgcagagacaccggcggcagcagcagcagcagcagcagcagcgacaacgagctggcccccttcgccagagccaagagcctgccccccagccccgtgacccacagccccctgctgcaccccagaggcttcctgagacccagcgccagcctgcccgaggaggccgaggccagcgagagaagcaccgaggcccccgccccccccgccagccccgagggcgccggcccccccgccgcccagggctgcgtgcccagacacagcgtgatcagaagcctgttctaccaccaggccggcgagagccccgagcacggcgccctggcccccggcagcagaagacaccccgccagaagaagacacctgctgaagggcggctacatcgccggcgccctgcccggcctgagagagcccctgatggagcacagagtgctggaggaggaggccgccagagaggagcaggccaccctgctggccaaggcccccagcttcgagaccgccctgagactgcccgccagcggcacccacctggcccccggccacagccacagcctggagcacgacagccccagcacccccagacccagcagcgaggcctgcggcgaggcccagagactgcccagcgcccccagcggcggcgcccccatcagagacatgggccacccccagggcagcaagcagctgcccagcaccggcggccaccccggcaccgcccagcccgagagacccagccccgacagcccctggggccagcccgcccccttctgccaccccaagcagggcagcgccccccaggagggctgcagcccccaccccgccgtggccccctgcccccccggcagcttcccccccggcagctgcaaggaggcccccctggtgcccagcagccccttcctgggccagccccaggccccccccgcccccgccaaggccagcccccccctggacagcaagatgggccccggcgacatcagcctgcccggcagacccaagcccggcccctgcagcagccccggcagcgccagccaggccagcagcagccaggtgagcagcctgagagtgggcagcagccaggtgggcaccgagcccggccccagcctggacgccgagggctggacccaggaggccgaggacctgagcgacagcacccccaccctgcagagaccccaggagcaggccaccatgagaaagttcagcctgggcggcagaggcggctacgccggcgtggccggctacggcaccttcgccttcggcggcgacgccggcggcatgctgggccagggccccatgtgggccagaatcgcctgggccgtgagccagagcgaggaggaggagcaggaggaggccagagccgagagccagagcgaggagcagcaggaggccagagccgagagccccctgccccaggtgagcgccagacccgtgcccgaggtgggcagagcccccaccagaagcagccccgagcccaccccctgggaggacatcggccaggtgagcctggtgcagatcagagacctgagcggcgacgccgaggccgccgacaccatcagcctggacatcagcgaggtggaccccgcctacctgaacctgagcgacctgtacgacatcaagtacctgcccttcgagttcatgatcttcagaaaggtgcccaagagcgcccagcccgagccccccagccccatggccgaggaggagctggccgagttccccgagcccacctggccctggcccggcgagctgggcccccacgccggcctggagatcaccgaggagagcgaggacgtggacgccctgctggccgaggccgccgtgggcagaaagagaaagtggagcagccccagcagaagcctgttccacttccccggcagacacctgcccctggacgagcccgccgagctgggcctgagagagagagtgaaggccagcgtggagcacatcagcagaatcctgaagggcagacccgagggcctggagaaggagggcccccccagaaagaagcccggcctggccagcttcagactgagcggcctgaagagctgggacagagcccccaccttcctgagagagctgagcgacgagaccgtggtgctgggccagagcgtgaccctggcctgccaggtgagcgcccagcccgccgcccaggccacctggagcaaggacggcgcccccctggagagcagcagcagagtgctgatcagcgccaccctgaagaacttccagctgctgaccatcctggtggtggtggccgaggacctgggcgtgtacacctgcagcgtgagcaacgccctgggcaccgtgaccaccaccggcgtgctgagaaaggccgagagacccagcagcagcccctgccccgacatcggcgaggtgtacgccgacggcgtgctgctggtgtggaagcccgtggagagctacggccccgtgacctacatcgtgcagtgcagcctggagggcggcagctggaccaccctggccagcgacatcttcgactgctgctacctgaccagcaagctgagcagaggcggcacctacaccttcagaaccgcctgcgtgagcaaggccggcatgggcccctacagcagccccagcgagcaggtgctgctgggcggccccagccacctggccagcgaggaggagagccagggcagaagcgcccagcccctgcccagcaccaagaccttcgccttccagacccagatccagagaggcagattcagcgtggtgagacagtgctgggagaaggccagcggcagagccctggccgccaagatcatcccctaccaccccaaggacaagaccgccgtgctgagagagtacgaggccctgaagggcctgagacacccccacctggcccagctgcacgccgcctacctgagccccagacacctggtgctgatcctggagctgtgcagcggccccgagctgctgccctgcctggccgagagagccagctacagcgagagcgaggtgaaggactacctgtggcagatgctgagcgccacccagtacctgcacaaccagcacatcctgcacctggacctgagaagcgagaacatgatcatcaccgagtacaacctgctgaaggtggtggacctgggcaacgcccagagcctgagccaggagaaggtgctgcccagcgacaagttcaaggactacctggagaccatggcccccgagctgctggagggccagggcgccgtgccccagaccgacatctgggccatcggcgtgaccgccttcatcatgctgagcgccgagtaccccgtgagcagcgagggcgccagagacctgcagagaggcctgagaaagggcctggtgagactgagcagatgctacgccggcctgagcggcggcgccgtggccttcctgagaagcaccctgtgcgcccagccctggggcagaccctgcgccagcagctgcctgcagtgcccctggctgaccgaggagggccccgcctgcagcagacccgcccccgtgaccttccccaccgccagactgagagtgttcgtgagaaacagagagaagagaagagccctgctgtacaagagacacaacctggcccaggtgagatag

SEQ ID NO: 11947 - DNA, 750 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactggacaccgagaagctgtgcaccttcagccagagattccccctgcccagcatgtacagagccctggtgtggaaggtgctgctgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagagagtgtgggacaaggtggtgagcggcagctgcaagatcctggtgttcgtggccgtggagatcctgctgaccttcaagatcaagtag

SEQ ID NO: 11948 - DNA, 417 bp, Artificial Sequence
  Description of Artificial Sequence: Synthetic coding sequence
atgagcagcctgggcgccagcttcgtgcagatcaagttcgacgacctgcagttcttcgagaactgcggcggcggcagcttcggcagcgtgtacagagccaagtggatcagccaggacaaggaggtggccgtgaagaagctgctgaagatcgagaaggaggccgagatcctgagcgtgctgagccacagaaacatcatccagttctacggcgtgatcctggagccccccaactacggcatcgtgaccgagtacgccagcctgggcagcctgtacgactacatcaacagcaacagaagcgaggagatggacatggaccacatcatgacctgggccaccgacgtggccaagggcatgcactacctgcacatggaggcccccgtgaaggtgatccacagagacctgaagagcagaaactag

SEQ ID NO: 11949 - DNA, 1122 bp, Artificial Sequence
  Description of Artificial Sequence: Synthetic coding sequence
atggccagcagcagcgtgccccccgccaccgtgagcgccgccaccgccggccccggccccggcttcggcttcgccagcaagaccaagaagaagcacttcgtgcagcagaaggtgaaggtgttcagagccgccgaccccctggtgggcgtgttcctgtggggcgtggcccacagcatcaacgagctgagccaggtgcccccccccgtgatgctgctgcccgacgacttcaaggccagcagcaagatcaaggtgaacaaccacctgttccacagagagaacctgcccagccacttcaagttcaaggagtactgcccccaggtgttcagaaacctgagagacagattcggcatcgacgaccaggactacctgtacatcgtgaagtgccacggcaacaccctgctgccccagttcctgggcatgtacagagtgagcgtggacaacgaggacagctacatgctggtgatgagaaacatgttcagccacagactgcccgtgcacagaaagtacgacctgaagggcagcctggtgagcagagaggccagcgacaaggagaaggtgaaggagctgcccaccctgaaggacatggacttcctgaacaagaaccagaaggtgtacatcggcgaggaggagaagaagatcttcctggagaagctgaagagagacgtggagttcctggtgcagctgaagatcatggactacagcctgctgctgggcatccacgacatcatcagaggcagcgagcccgaggaggaggcccccgtgagagaggacgagagcgaggtggacggcgactgcagcctgaccggcccccccgccctggtgggcagctacggcaccagccccgagggcatcggcggctacatccacagccacagacccctgggccccggcgagttcgagagcttcatcgacgtgtacgccatcagaagcgccgagggcgccccccagaaggaggtgtacttcatgggcctgatcgacatcctgacccagtacgacgccaagaagaaggccgcccacgccgccaagaccgtgaagcacggcgccggcgccgagatcagcaccgtgcaccccgagcagtacgccaagagattcctggacttcatcaccaacatcttcgcctag

SEQ ID NO: 11950 - DNA, 549 bp, Artificial Sequence
  Description of Artificial Sequence: Synthetic coding sequence
atggaggagatccccgcccaggaggccgccggcagccccagagtgcagttccagagcctggagacccagagcgagtgcctgagccccgagccccagttcgtgcaggacaccgacatggagcagggcctgaccggcggcttccccatcagcaagcccgacggcatcagccagctggagcaggacctgcaggtgttcgacctggagaccaagaccagagaggtgctgagagacgactgcagcgacggcgagaccagagaggagaacaagctgctgatccccaagcagaagatcagcgaggaggtgcacagctacaaggtgagagtgggcagactgaagcacgacatcacccaggtgcccgagaccagagaggtgtacaagagcgaggacagactggagagactgcaggagatcctgagaaagttcctgtacctggagagagagttcagacagatcaccatcagcaaggagaccttcaccagcgagaagaacaacgagtgccacgagcccgagaagagcttcagcctggacagcaccatcgacgccgactag

SEQ ID NO: 11951 - DNA, 2253 bp, Artificial Sequence
  Description of Artificial Sequence: Synthetic coding sequence
atgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagaacatgcccaacgtgagagaccacgacgccagcgtgtacctgagactgcagggcgacgccctgagcgtgggcggctacgaggccaaccccatcttctgggaggaggtgagcgacaagttcgccttcggcctgttcgacctggactgggaggtgttcacccagcacatcgagggcgccatcaacagagtgcccgtgctggagaagaccggcatcaagagcaccgtgtgcggccccgagagcttcacccccgaccacaagcccctgatgggcgaggcccccgagctgagaggcttcttcctgggctgcggcttcaacagcgccggcatgatgctgggcggcggctgcggccaggagctggcccactggatcatccacggcagacccgagaaggacatgcacggctacgacatcagaagattccaccacagcctgaccgaccaccccagatggatcagagagagaagccacgagagctacgccaagaactacagcgtggtgttcccccacgacgagcccctggccggcagaaacatgagaagagaccccctgcacgaggagctgctgggccagggctgcgtgttccaggagagacacggctgggagagacccggctggttccaccccagaggccccgcccccgtgctggagtacgactactacggcgcctacggcagcagagcccacgaggactacgcctacagaagactgctggccgacgagtacaccttcgccttccccccccaccacgacaccatcaagaaggagtgcctggcctgcagaggcgccgccgccgtgttcgacatgagctacttcggcaagttctacctggtgggcctggacgccagaaaggccgccgactggctgttcagcgccgacgtgagcagaccccccggcagcaccgtgtacacctgcatgctgaaccacagaggcggcaccgagagcgacctgaccgtgagcagactggcccccagccaccaggccagccccctggcccccgccttcgagggcgacggctactacctggccatgggcggcgccgtggcccagcacaactggagccacatcaccaccgtgctgcaggaccagaagagccagtgccagctgatcgacagcagcgaggacctgggcatgatcagcatccagggccccgccagcagagccatcctgcaggaggtgctggacgccgacctgagcaacgaggccttccccttcagcacccacaagctgctgagagccgccggccacctggtgagagccatgagactgagcttcgtgggcgagctgggctgggagctgcacatccccaaggccagctgcgtgcccgtgtacagagccgtgatggccgccggcgccaagcacggcctgatcaacgccggctacagagccatcgacagcctgagcatcgagaagggctacagacactggcacgccgacctgagacccgacgacagccccctggaggccggcctggccttcacctgcaagctgaagagccccgtgcccttcctgggcagagaggccctggagcagcagagagccgccggcctgagaagaagactggtgtgcttcaccatggaggacaaggtgcccatgttcggcctggaggccatctggagaaacggccaggtggtgggccacgtgagaagagccgacttcggcttcgccatcgacaagaccatcgcctacggctacatccacgaccccagcggcggccccgtgagcctggacttcgtgaagagcggcgactacgccctggagagaatgggcgtgacctacggcgcccaggcccacctgaagagccccttcgaccccaacaacaagagagtgaagggcatctactag

SEQ ID NO: 11952 - DNA, 459 bp, Artificial Sequence; identical to SEQ ID NO: 11867
  Description of Artificial Sequence: Synthetic coding sequence

SEQ ID NO: 11953 - DNA, 1620 bp, Artificial Sequence; identical to SEQ ID NO: 10018
  Description of Artificial Sequence: Synthetic coding sequence

SEQ ID NO: 11954 - DNA, 1266 bp, Artificial Sequence
  Description of Artificial Sequence: Synthetic coding sequence
atgatggaggacaacaagcagctggccctgagaatcgacggcgccgtgcagagcgccagccaggaggtgaccaacctgagagccgagctgaccgccaccaacagaagactggccgagctgagcggcggcggcggccccggccccggccccggcgccgccgccagcgccagcgccgccggcgacagcgccgccaccaacatggagaacccccagctgggcgcccaggtgctgctgagagaggaggtgagcagactgcaggaggaggtgcacctgctgagacagatgaaggagatgctggccaaggacctggaggagagccagggcggcaagagcagcgaggtgctgagcgccaccgagctgagagtgcagctggcccagaaggagcaggagctggccagagccaaggaggccctgcaggccatgaaggccgacagaaagagactgaagggcgagaagaccgacctggtgagccagatgcagcagctgtacgccaccctggagagcagagaggagcagctgagagacttcatcagaaactacgagcagcacagaaaggagagcgaggacgccgtgaaggccctggccaaggagaaggacctgctggagagagagaagtgggagctgagaagacaggccaaggaggccaccgaccacgccaccgccctgagaagccagctggacctgaaggacaacagaatgaaggagctggaggccgagctggccatggccaagcagagcctggccaccctgaccaaggacgtgcccaagagacacagcctggccatgcccggcgagaccgtgctgaacggcaaccaggagtgggtggtgcaggccgacctgcccctgaccgccgccatcagacagagccagcagaccctgtaccacagccaccccccccaccccgccgacagacaggccgtgagagtgagcccctgccacagcagacagcccagcgtgatcagcgacgccagcgccgccgagggcgacagaagcagcacccccagcgacatcaacagccccagacacagaacccacagcctgtgcaacggcgacagccccggccccgtgcagaagaacctgcacaaccccatcgtgcagagcctggaggacctggaggaccagaagagaaagaagaagaaggagaagatgggcttcggcagcatcagcagagtgttcgccagaggcaagcagagaaagagcctggaccccggcctgttcgacggcaccgcccccgactactacatcgaggaggacgccgactggtag

SEQ ID NO: 11955 - DNA, 492 bp, Artificial Sequence
  Description of Artificial Sequence: Synthetic coding sequence
atggtgggcggcggcggcgtgggcggcggcctgctggagaacgccaaccccctgatctaccagagaagcggcgagagacccgtgaccgccggcgaggaggacgagcaggtgcccgacagcatcgacgccagagagatcttcgacctgatcagaagcatcaacgaccccgagcaccccctgaccctggaggagctgaacgtggtggagcaggtgagagtgcaggtgagcgaccccgagagcaccgtggccgtggccttcacccccaccatcccccactgcagcatggccaccctgatcggcctgagcatcaaggtgaagctgctgagaagcctgccccagagattcaagatggacgtgcacatcacccccggcacccacgccagcgagcacgccgtgaacaagcagctggccgacaaggagagagtggccgccgccctggagaacacccacctgctggaggtggtgaaccagtgcctgagcgccagaagctag

SEQ ID NO: 11956 - DNA, 207 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggccgaggtgagcatcaacgagtag

SEQ ID NO: 11957 - DNA, 534 bp, Artificial Sequence
  Description of Artificial Sequence: Synthetic coding sequence
atgagcagcaacgagtgcttcaagtgcggcagaagcggccactgggccagagagtgccccaccggcggcggcagaggcagaggcatgagaagcagaggcagaggcggcttcaccagcgacagaggcttccagttcgtgagcagcagcctgcccgacatctgctacagatgcggcgagagcggccacctggccaaggactgcgacctgcaggaggacgcctgctacaactgcggcagaggcggccacatcgccaaggactgcaaggagcccaagagagagagagagcagtgctgctacaactgcggcaagcccggccacctggccagagactgcgaccacgccgacgagcagaagtgctacagctgcggcgagttcggccacatccagaaggactgcaccaaggtgaagtgctacagatgcggcgagaccggccacgtggccatcaactgcagcaagaccagcgaggtgaactgctacagatgcggcgagagcggccacctggccagagagtgcaccatcgaggccaccgcctag

SEQ ID NO: 11958 - DNA, 429 bp, Artificial Sequence
  Description of Artificial Sequence: Synthetic coding sequence
atgacccagctgagacaggtgctggagagcagactgcagagacccctgcccgaggacctggccagactgtggcccgtggtgatcctgtgccagctggccaaccagctgagacccagaagcgtgcccttcatccacgtgcccagccccgccgtgcccaagctgagcgccctgaaggccagaaagaacgtggagagcttcctggaggcctgcagaaagatgggcgtgcccgaggccgacctgtgcagccccagcgacctgctgcagggcaccgccagaggcctgagaaccgccctggaggccgtgaagagagtgggcggcaaggccctgccccccctgtggccccccagcggcctgggcggcttcgtggtgttctacgtggtgctgatgctgctgctgtacgtgacctacaccagactgctgggcagctag

SEQ ID NO: 11959 - DNA, 1296 bp, Artificial Sequence
  Description of Artificial Sequence: Synthetic coding sequence
atggaggacctgaagggccccaccgtgagcagcttcctgagcggcatgaagaccgagctgtaccccggcgtgaccgccatcgacatgatgtacaaggagggcctgcacggcgtggacaacggcatcctgatcttcgacaaggtgagaatccccagagagaacctgctggacaagttcggcagcgtggcccccgacggccagtaccacagccccatcagaaacaagagcgccagattcaacgccatgctggccgccctgacccccagcagactggccgtggccttccaggccatgggcgccatgaagctgggcctgaccatcgccatcagatacagccacagcagaagacagttcggccccaagaccaaggaggaggtgaagatcatcgagcaccagacccagaccctgagactgatgccccacctggccaccgccctggccctgaccttcgtgagcagatacgccggcgccctgctggacgaggacgtgttccagggcaaggagctggtgaacagcagaagcctgcaggccctggtggccggcctgaaggcctacagcacctgggagaacatcagatgcctgcaggactgcagagagtgcaccggcggcatggtggtgggcagagagctgctggcccagtacaccaagcagtacgaggagaagcccctgttcggcctgctgcagaactgggccgagagcgtgggcgacaagctgagaaccagcttcctggccttcaacatggacaccgtggacgacctggccttcctgctgaaggccgtgaagttcagagagagagtgctgcagagaggcctggtggccagaatctactacaaggtgaagaccaagaaggaggacttcttccacgcctggaacagctgcctgcaccacgtggccagcctgagcctggcccacacccacagagtgaccctggagcagttcagcctggccgtgaagagctgccccgaccaggaggaccagaccctgctgatgaagttctgcctgctgtacggcaccaagctggtgttccaggagagagcctggtacctggagcacaagtacctgacccccatggccagcaccagaatcagaaaccagctgctggacctgtgcgacagcgtgaaggacgacgccagaagagtgatcagcaccttcaacatcccccacacctacctgcacgcccccatcgccggcatcagcaaccccagagccgcctgggccttctaccccgcccccctgcagcccagacccagagaggaggccagaagcagaagacccaagctgggcgccaagctgtag

SEQ ID NO: 11960 - DNA, 1443 bp, Artificial Sequence
  Description of Artificial Sequence: Synthetic coding sequence
atggccgagctgcagatgctgctggaggaggagatccccggcggcagaagagccctgttcgacagctacaccaacctggagagagtggccgactactgcgagaacaactacatccagagcgccgacaagcagagagccctggaggagaccaaggcctacaccacccagagcctggccagcgtggcctacctgatcaacaccctggccaacaacgtgctgcagatgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacctggagagacccgtgagatacatcagaaagcccatcgactacaccatcctggacgacatcggccacggcgtgaagtggctgctgagattcaaggtgagcacccagaacatgaagatgggcggcctgcccagaaccaccccccccacccagaagccccccagcccccccatgagcggcaagggcaccctgggcagacacagcccctacagaaccctggagcccgtgagaccccccgtggtgcccaacgactacgtgcccagccccaccagaaacatggcccccagccagcagagccccgtgagaaccgccagcgtgaaccagagaaacagaacctacagcagcagcggcagcagcggcggcagccaccccagcagcagaagcagcagcagagagaacagcggcagcggcagcgtgggcgtgcccatcgccgtgcccacccccagcccccccagcgtgttccccgacgccgccgccggcggcgcccagaccctggccgacggcttcaccagccccaccccccccgtggtgagcagcaccccccccaccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgacggctggtacgagggcgtgatgaacggcgtgaccggcctgttccccggcaactacgtggagagcatcatgcactacagcgagtag

SEQ ID NO: 11961 - DNA, 3102 bp, Artificial Sequence
  Description of Artificial Sequence: Synthetic coding sequence
atggacgaggaggagaaccactacgtgagccagctgagagaggtgtacagcagctgcgacaccaccggcaccggcttcctggacagacaggagctgacccagctgtgcctgaagctgcacctggagcagcagctgcccgtgctgctgcagaccctgctgggcaacgaccacttcgccagagtgaacttcgaggagttcaaggagggcttcgtggccgtgctgagcagcaacgccggcgtgagacccagcgacgaggacagcagcagcctggagagcgccgccagcagcgccatcccccccaagtacgtgaacggcagcaagtggtacggcagaagaagcagacccgagctgtgcgacgccgccaccgaggccagaagagtgcccgagcagcagacccaggccagcctgaagagccacctgtggagaagcgccagcctggagagcgtggagagccccaagagcgacgaggaggccgagagcaccaaggaggcccagaacgagctgttcgaggcccagggccagctgcagacctgggacagcgaggacttcggcagcccccagaagagctgcagccccagcttcgacacccccgagagccagatcagaggcgtgtgggaggagctgggcgtgggcagcagcggccacctgagcgagcaggagctggccgtggtgtgccagagcgtgggcctgcagggcctggagaaggaggagctggaggacctgttcaacaagctggaccaggacggcgacggcaaggtgagcctggaggagttccagctgggcctgttcagccacgagcccgccctgctgctggagagcagcaccagagtgaagcccagcaaggcctggagccactaccaggtgcccgaggagagcggctgccacaccaccaccaccagcagcctggtgagcctgtgcagcagcctgagactgttcagcagcatcgacgacggcagcggcttcgccttccccgaccaggtgctggccatgtggacccaggagggcatccagaacggcagagagatcctgcagagcctggacttcagcgtggacgagaaggtgaacctgctggagctgacctgggccctggacaacgagctgatgaccgtggacagcgccgtgcagcaggccgccctggcctgctaccaccaggagctgagctaccagcagggccaggtggagcagctggccagagagagagacaaggccagacaggacctggagagagccgagaagagaaacctggagttcgtgaaggagatggacgactgccacagcaccctggagcagctgaccgagaagaagatcaagcacctggagcagggctacagagagagactgagcctgctgagaagcgaggtggaggccgagagagagctgttctgggagcaggcccacagacagagagccgccctggagtgggacgtgggcagactgcaggccgaggaggccggcctgagagagaagctgaccctggccctgaaggagaacagcagactgcagaaggagatcgtggaggtggtggagaagctgagcgacagcgagagactggccctgaagctgcagaaggacctggagttcgtgctgaaggacaagctggagccccagagcgccgagctgctggcccaggaggagagattcgccgccgtgctgaaggagtacgagctgaagtgcagagacctgcaggacagaaacgacgagctgcaggccgagctggagggcctgtgggccagactgcccaagaacagacacagccccagctggagccccgacggcagaagaagacagctgcccggcctgggccccgccggcatcagcttcctgggcaacagcgcccccgtgagcatcgagaccgagctgatgatggagcaggtgaaggagcactaccaggacctgagaacccagctggagaccaaggtgaactactacgagagagagatcgccgccctgaagagaaacttcgagaaggagagaaaggacatggagcaggccagaagaagagaggtgagcgtgctggagggccagaaggccgacctggaggagctgcacgagaagagccaggaggtgatctggggcctgcaggagcagctgcaggacaccgccagaggccccgagcccgagcagatgggcctggccccctgctgcacccaggccctgtgcggcctggccctgagacaccacagccacctgcagcagatcagactggagttccacagactgagcgaggagaacaccctgctgaagaacgacctgggcagagtgagacaggagctggaggccgccgagagcacccacgacgcccagagaaaggagatcgaggtgctgaagaaggacaaggagaaggcctgcagcgagatggaggtgctgaacagacagaaccagaactacaaggaccagctgagccagctgaacgtgagagtgctgcagctgggccaggaggccagcacccaccaggcccagaacgaggagcacagagtgaccatccagatgctgacccagagcctggaggaggtggtgagaagcggccagcagcagagcgaccagatccagaagctgagagtggagctggagtgcctgaaccaggagcaccagagcctgcagctgccctggagcgagctgacccagaccctggaggagagccaggaccaggtgcagggcgcccacctgagactgagacaggcccaggcccagcacctgcaggaggtgagactggtgccccaggacagagtggccgagctgcacagactgctgagcctgcagggcgagcaggccagaagaagactggacgcccagagagaggagcacgagaagcagctgaaggccaccgaggagagagtggaggaggccgagatgatcctgaagaacatggagatgctgctgcaggagaaggtggacaagctgaaggagcagttcgagaagaacaccaagagcgacctgctgctgaaggagctgtacgtggagaacgcccacctggtgagagccctgcaggccaccgaggagaagcagagaggcgccgagaagcagagcagactgctggaggagaaggtgagagccctgaacaagctggtgagcagaatcgcccccgccgccctgagcgtgtag

SEQ ID NO: 11962 - DNA, 627 bp, Artificial Sequence
  Description of Artificial Sequence: Synthetic coding sequence
tgctgcggctgcagcggcggctgcggcagcggctgcggcggcagaggcagcggctgcggcggctgcggcagcggctgcggcggctgcggcagcggctgcggcggctgcggcagcggctgcggcggctgcggcggctgcggcagcggctgcgccggctgcggcggctgcaagggcggctgcggcagctgcggcggcagcaagagaggctgcgtgagctgcggcgtgagcaagggcgcctgcggcagctgcggcggcagcaagggcggctgcggcagctgcggcggcagcaagggcggctgcggcagctgcggcggcagcaagggcggctgcggcagctgcggcggcagcaagggcggctgcggcagctacggctgcagccagagcagctgctgcaagccctgctgctgcagcagcggctgcggcagcagctgctgccagagcagctgctgcaagccctactgctgccagagcagctgctgcaagccctactgctgccagagcagctgctgcaagccctgcagctgcttcagcggctgcggcagcagctgctgccagagcagctgctacaagccctgctgctgccagagcagctgctgcgtgcccgtgtgctgccagtgcaagatctag

SEQ ID NO: 11963 - DNA, 642 bp, Artificial Sequence
  Description of Artificial Sequence: Synthetic coding sequence
atggccggcagccccgagctggtggtgctggaccccccctgggacaaggagctggccgccggcaccgagagccaggccctggtgagcgccacccccagagaggacttcagagtgagatgcaccagcaagagagccgtgaccgagatgctgcagctgtgcggcagattcgtgcagaagctgggcgacgccctgcccgaggagatcagagagcccgccctgagagacgcccagtggaccttcgagagcgccgtgcaggagaacatcagcatcaacggccaggcctggcaggaggccagcgacaactgcttcatggacagcgacatcaaggtgctggaggaccagttcgacgagatcatcgtggacatcgccaccaagagaaagcagtaccccagaaagatcctggagtgcgtgatcaagaccatcaaggccaagcaggagatcctgaagcagtaccaccccgtggtgcaccccctggacctgaagtacgaccccgaccccgtgctgaacggcaacgccttcaacttcagccccttcaacatgatgctggccgtggacctgagctacatggtgttcatcaccagcagccccagctacggcaagttcgagatgcagagaggcaacagcagcaagggcgaccagtag

SEQ ID NO: 11964 - DNA, 3720 bp, Artificial Sequence
  Description of Artificial Sequence: Synthetic coding sequence
atgaccatctggcagatgcagaagcaggcccagagaggcagccccgccagaacccacagcatgatgagcctgagcgtgagaccccagagaagactgctgagcgccagagtgaacagaagccagagcttcgccggcgtgctgggcagccacgagagaggccccagaagcttccccgtgttcagcccccccggcccccccagaaagccccccgccctgagcagagtgagcagaatgttcagcgtggcccaccccgccgccaaggtgccccagcccgagagactggacctggtgtacaccgccctgaagagaggcctgaccgcctacctggaggtgcaccagcaggagcaggagaagctgcagggccagatcagagagagcaagagaaacagcagactgggcttcctgtacgacctggacaagcaggtgaagagcatcgagagattcctgagaagactggagttccacgccagcaagatcgacgagctgtacgaggcctactgcgtgcagagaagactgagagacggcgcctacaacatggtgagagcctacaccaccggcagccccggcagcagagaggccagagacagcctggccgaggccaccagaggccacagagagtacaccgagagcatgtgcctgctggagagcgagctggaggcccagctgggcgagttccacctgagaatgaagggcctggccggcttcgccagactgtgcgtgggcgaccagtacgagatctgcatgaagtacggcagacagagatggaagctgagaggcagaatcgagggcagcggcaagcaggtgtgggacagcgaggagaccatcttcctgcccctgctgaccgagttcctgagcatcaaggtgaccgagctgaagggcctggccaaccacgtggtggtgggcagcgtgagctgcgagaccaaggacctgttcgccgccctgccccaggtggtggccgtggacatcaacgacctgggcaccatcaagctgagcctggaggtgacctggagccccttcgacaaggacgaccagcccagcgccgccagcagcgtgaacaaggccagcaccgtgaccaagagattcagcacctacagccagagcccccccgacacccccagcctgagagagcaggccttctacaacatgctgagaagacaggaggagctggagaacggcaccgcctggagcctgagcagcgagagcagcgacgacagcagcagcccccagctgagcggcaccgccagacacagccccgcccccagacccctggtgcagcagcccgagcccctgcccatccaggtggccttcagaagacccgagacccccagcagcggccccctggacgaggagggcgccgtggcccccgtgctggccaacggccacgccccctacagcagaaccctgagccacatcagcgaggccagcgtggacgccgccctggccgaggccagcgtggaggccgtgggccccgagagcctggcctggggccccagcccccccacccaccccgcccccacccacggcgagcaccccagccccgtgccccccgccctggaccccggccacagcgccaccagcagcaccctgggcaccaccggcagcgtgcccaccagcaccgaccccgcccccagcgcccacctggacagcgtgcacaagagcaccgacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccccgtgcagaccaccaccagccccacccacaccatgcccagccccacccacaccaccgccagccccacccacaccagcaccagccccacccacacccccaccagccccacccacaagaccagcatgagcccccccaccaccaccagccccacccccagcggcatgggcctggtgcagaccgccaccagccccacccaccccaccaccagccccacccaccccaccaccagccccatcctgatcaacgtgagccccagcaccagcctggagctggccaccctgagcagccccagcaagcacagcgaccccaccctgcccggcaccgacagcctgccctgcagcccccccgtgagcaacagctacacccaggccgaccccatggcccccagaaccccccaccccagccccgcccacagcagcagaaagcccctgaccagccccgcccccgaccccagcgagagcaccgtgcagagcctgagccccacccccagcccccccacccccgccccccagcacagcgacctgtgcctggccatggccgtgcagacccccgtgcccaccgccgccggcggcagcggcgacagaagcctggaggaggccctgggcgccctgatggccgccctggacgactacagaggccagttccccgagctgcagggcctggagcaggaggtgaccagactggagagcctgctgatgcagagacagggcctgaccagaagcagagccagcagcctgagcatcaccgtggagcacgccctggagagcttcagcttcctgaacgaggacgaggacgaggacaacgacgtgcccggcgacagaccccccagcagccccgaggccggcgccgaggacagcatcgacagccccagcgccagacccctgagcaccggctgccccgccctggacgccgccctggtgagacacctgtaccactgcagcagactgctgctgaagctgggcaccttcggccccctgagatgccaggaggcctgggccctggagagactgctgagagaggccagagtgctggaggccgtgtgcgagttcagcagaagatgggagatccccgccagcagcgcccaggaggtggtgcagttcagcgccagcagacccggcttcctgaccttctgggaccagtgcaccgagagactgagctgcttcctgtgccccgtggagagagtgctgctgaccttctgcaaccagtacggcgccagactgagcctgagacagcccggcctggccgaggccgtgtgcgtgaagttcctggaggacgccctgggccagaagctgcccagaagaccccagcccggccccggcgagcagctgaccgtgttccagttctggagcttcgtggagaccctggacagccccaccatggaggcctacgtgaccgagaccgccgaggaggtgctgctggtgagaaacctgaacagcgacgaccaggccgtggtgctgaaggccctgagactggcccccgagggcagactgagaagagacggcctgagagccctgagcagcctgctggtgcacggcaacaacaaggtgatggccgccgtgagcacccagctgagaagcctgagcctgggccccaccttcagagagagagccctgctgtgcttcctggaccagctggaggacgaggacgtgcagaccagagtggccggctgcctggccctgggctgcatcaaggcccccgagggcatcgagcccctggtgtacctgtgccagaccgacaccgaggccgtgagagaggccgccagacagagcctgcagcagtgcggcgaggagggccagagcgcccacagaagactggaggagagcctggacgccctgcccagaatcttcggccccggcagcatggccagcaccgccttctag

SEQ ID NO: 11965 - DNA, 732 bp, Artificial Sequence
  Description of Artificial Sequence: Synthetic coding sequence
atggtgaccgactacggcgccttcatcaagatccccggctgcagaaagcagggcctggtgcacagaacccacatgagcagctgcagagtggacaagcccagcgagatcgtggacgtgggcgacaaggtgtgggtgaagctgatcggcagagagatgaagaacgacagaatcaaggtgagcctgagcatgaaggtggtgaaccagggcaccggcaaggacctggaccccaacaacgtgatcatcgagcaggaggagagaagaagaagaagcttccaggactacaccggccagaagatcaccctggaggccgtgctgaacaccacctgcaagaagtgcggctgcaagggcagagtgaagcccctgcccttccccagattcagcccctgcggctggaccctgttctggaagaaggaggccgcccagtgccacttcgccaaggactgcttcatgcagcccggcggcaccaagtacagcctgatccccgacgaggaggaggagaaggaggaggccaagagcgccgagttcgagaagcccgaccccaccagaaaccccagcagaaagagaaagaaggagaagaagaagaagaagcacagagacagaaagagcagcgacagcgacagcagcgacagcgagagcgacaccggcaagagagccagacacaccagcaaggacagcaaggccgccaagaagaagaagaagaagaagaagcacaagaagaagcacaaggagtag

SEQ ID NO: 11966 - DNA, 330 bp, Artificial Sequence
  Description of Artificial Sequence: Synthetic coding sequence
atggaggagatccccgcccaggaggccgccggcagccccagagtgcagttccagagcctggagacccagagcgagtgcctgagccccgagccccagttcgtgcaggacaccgacatggagcagggcctgaccggcggcttccccatcagcaagcccgacggcatcagccagctggagcaggacctgcaggtgttcgacctggagaccaagaccagagaggtgctgagagacgactgcagcgacggcgagaccagagaggagaacaagctgctgatccccaagcagaagatcagcgaggaggtgcacagctacaaggtgagagtgggctag

SEQ ID NO: 11967 - DNA, 4134 bp, Artificial Sequence
  Description of Artificial Sequence: Synthetic coding sequence
atgagcctggagagagagctgagacagctgagcaaggccaaggccaaggcccagagagccggccagagaagagaggaggccgccctgtgccaccagctgggcgagctgctggccggccacggcagatacgccgaggccctggagcagcactggcaggagctgcagctgagagagagagccgacgaccccctgggctgcgccgtggcccacagaaagatcggcgagagactggccgagatggaggactaccccgccgccctgcagcaccagcaccagtacctggagctggcccacagcctgagaaaccacaccgagctgcagagagcctgggccaccatcggcagaacccacctggacatctacgaccactgccagagcagagacgccctgctgcaggcccaggccgccttcgagaagagcctggccatcgtggacgaggagctggagggcaccctggcccagggcgagctgaacgagatgagaaccagactgtacctgaacctgggcctgaccttcgagagcctgcagcagaccgccctgtgcaacgactacttcagaaagagcatcttcctggccgagcagaaccacctgtacgaggacctgttcagagccagatacaacctgggcaccatccactggagagccggccagcacagccaggccatgagatgcctggagggcgccagagagtgcgcccacaccatgagaaagagattcatggagagcgagtgctgcgtggtgatcgcccaggtgctgcaggacctgggcgacttcctggccgccaagagagccctgaagaaggcctacagactgggcagccagaagcccgtgcagagagccgccatctgccagaacctgcagcacgtgctggccgtggtgagactgcagcagcagctggaggaggccgagggcagagacccccagggcgccatggtgatctgcgagcagctgggcgacctgttcagcaaggccggcgacttccccagagccgccgaggcctaccagaagcagctgagattcgccgagctgctggacagacccggcgccgagagagccatcatccacgtgagcctggccaccaccctgggcgacatgaaggaccaccacggcgccgtgagacactacgaggaggagctgagactgagaagcggcaacgtgctggaggaggccaagacctggctgaacatcgccctgagcagagaggaggccggcgacgcctacgagctgctggccccctgcttccagaaggccctgagctgcgcccagcaggcccagagaccccagctgcagagacaggtgctgcagcacctgcacaccgtgcagctgagactgcagccccaggaggcccccgagaccgagaccagactgagagagctgagcgtggccgaggacgaggacgaggaggaggaggccgaggaggccgccgccaccgccgagagcgaggccctggaggccggcgaggtggagctgagcgagggcgaggacgacaccgacggcctgaccccccagctggaggaggacgaggagctgcagggccacctgggcagaagaaagggcagcaagtggaacagaagaaacgacatgggcgagaccctgctgcacagagcctgcatcgagggccagctgagaagagtgcaggacctggtgagacagggccaccccctgaaccccagagactactgcggctggacccccctgcacgaggcctgcaactacggccacctggagatcgtgagattcctgctggaccacggcgccgccgtggacgaccccggcggccagggctgcgagggcatcacccccctgcacgacgccctgaactgcggccacttcgaggtggccgagctgctgctggagagaggcgccagcgtgaccctgagaaccagaaaggccagcgccagatggagaagatgcagcagcggcaagctgtacagaagagacctggacctggagaccagacagaaggccagagccatggagatgctgctgcaggccgccgccagcggccaggacccccacagcagccaggccttccacacccccagcagcctgctgttcgaccccgagaccagcccccccctgagcccctgccccgagccccccagcaacagcaccagactgcccgaggccagccaggcccacgtgagagtgagccccggccaggccgcccccgccatggccagacccagaagaagcagacacggccccgccagcagcagcagcagcagcgagggcgaggacagcgccggccccgccagacccagccagaagagacccagatgcagcgccaccgcccagagagtggccgcctggacccccggccccgccagcaacagagaggccgccaccgccagcaccagcagagccgcctaccaggccgccatcagaggcgtgggcagcgcccagagcagactgggccccggcccccccagaggccacagcaaggccctggccccccaggccgccctgatccccgaggaggagtgcctggccggcgactggctggagctggacatgcccctgaccagaagcagaagacccagacccagaggcaccggcgacaacagaagacccagcagcaccagcggcagcgacagcgaggagagcagacccagagccagagccaagcaggtgagactgacctgcatgcagagctgcagcgcccccgtgaacgccggccccagcagcctggccagcgagccccccggcagccccagcacccccagagtgagcgagcccagcggcgacagcagcgccgccggccagcccctgggccccgccccccccccccccatcagagtgagagtgcaggtgcaggaccacctgttcctgatccccgtgccccacagcagcgacacccacagcgtggcctggctggccgagcaggccgcccagagatactaccagacctgcggcctgctgcccagactgaccctgagaaaggagggcgccctgctggccccccaggacctgatccccgacgtgctgcagagcaacgacgaggtgctggccgaggtgaccagctgggacctgccccccctgaccgacagatacagaagagcctgccagagcctgggccagggcgagcaccagcaggtgctgcaggccgtggagctgcagggcctgggcctgagcttcagcgcctgcagcctggccctggaccaggcccagctgacccccctgctgagagccctgaagctgcacaccgccctgagagagctgagactggccggcaacagactgggcgacaagtgcgtggccgagctggtggccgccctgggcaccatgcccagcctggccctgctggacctgagcagcaaccacctgggccccgagggcctgagacagctggccatgggcctgcccggccaggccaccctgcagagcctggaggagctggacctgagcatgaaccccctgggcgacggctgcggccagagcctggccagcctgctgcacgcctgccccctgctgagcaccctgagactgcaggcctgcggcttcggccccagcttcttcctgagccaccagaccgccctgggcagcgccttccaggacgccgagcacctgaagaccctgagcctgagctacaacgccctgggcgcccccgccctggccagaaccctgcagagcctgcccgccggcaccctgctgcacctggagctgagcagcgtggccgccggcaagggcgacagcgacctgatggagcccgtgttcagatacctggccaaggagggctgcgccctggcccacctgaccctgagcgccaaccacctgggcgacaaggccgtgagagacctgtgcagatgcctgagcctgtgccccagcctgatcagcctggacctgagcgccaaccccgagatcagctgcgccagcctggaggagctgctgagcaccctgcagaagagaccccagggcctgagcttcctgggcctgagcggctgcgccgtgcagggccccctgggcctgggcctgtgggacaagatcgccgcccagctgagagagctgcagctgtgcagcagaagactgtgcgccgaggacagagacgccctgagacagctgcagcccagcagacccggccccggcgagtgcaccctggaccacggcagcaagctgttcttcagaagactgtag

SEQ ID NO: 11968 - DNA, 675 bp, Artificial Sequence
  Description of Artificial Sequence: Synthetic coding sequence
atgcccaccctgttcaagggcgtgtggggcgtggtggagcacagcagagccctgggcagattctgccccgcctgcctgcccagcggcccccacctgcacacccagcccgccctgggcaccgccgagatgaccctgctgagcagccagagcagcagcctggtggcccccagcggcagcgtgagcgccgagaaccccgagcagagaatgctggagaagagagccaaggtgatcgaggagctgctgcagaccgagagagactacatcagagacctggagatgtgcatcgagagaatcatggtgcccatgcagcaggcccaggtgcccaacatcgacttcgagggcctgttcggcaacatgcagatggtgatcaaggtgagcaagcagctgctggccgccctggagatcagcgacgccgtgggccccgtgttcctgggccacagagacgagctggagggcacctacaagatctactgccagaaccacgacgaggccatcgccctgctggagatctacgagaaggacgagaagatccagaagcacctgcaggacagcctggccgacctgaagagcctgtacaacgagtggggctgcaccaactacatcaacctgggcagcttcctgatcaagcccgtgcagagagtgatgagataccccctgctgctgatggagctgtag

SEQ ID NO: 11969 - DNA, 354 bp, Artificial Sequence
  Description of Artificial Sequence: Synthetic coding sequence
gtgtgcggcgactacctgctgagcagaatggacgtgaccagctgcatcagctacagaaacttcgccagctgcatgggcgacagcagactgctgaacaaggtggacgcctacatccaggagcacctgctgcagatcagcgaggaggaggagttcctgaagctgcccagactgaagctggaggtgatgctggaggacaacgtgtgcctgcccagcaacggcaagctgtacaccaaggtgatcaactgggtgcagagaagcatctgggagaacggcgacagcctggaggagctgatggaggaggtgagcttcaaggtgaacggcatccagcccttcctgaagatcatcctgctgtag

SEQ ID NO: 11970 - DNA, 285 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgcggcttcatcagcgacagaagcgtgaaggaggtggcctgcggcggcaaccacagcgtgttcctgctggaggacggcgaggtgtacacctgcggcctgaacaccaagggccagctgggccacgagagagagggcaacaagcccgagcagatcggcgccctggccgaccagcacatcatccacgtggcctgcggcgagagctag

SEQ ID NO: 11971 - DNA, 747 bp, Artificial Sequence; identical to SEQ ID NO: 11765
  Description of Artificial Sequence: Synthetic coding sequence

SEQ ID NO: 11972 - DNA, 2814 bp, Artificial Sequence
  Description of Artificial Sequence: Synthetic coding sequence
atggagcccgacatcatcagaatgtacagcagcagccccccccccctggacaacggcgccgaggacgacgacgacgacgagttcggcgagttcggcggcttcagcgaggtgagccccagcggcgtgggcttcgtggacttcgacacccccgactacaccagacccaaggaggagttcgtgcccagcaaccacttcatgcccatccacgagttcagcgagaacgtggacagcctgaccagcttcaagagcatcaagaacggcaacgacaaggacatcaccgccgagctgagcgcccccgtgaagggccagagcgacgtgctgctgagcaccaccagcaaggagatcatcagcagcgagatgctggccaccagcatcgacggcatggagagacccggcaacctgaacaaggtggtggagcagagacagaacgtgggcaccctggagagcttcagccccggcgacttcagaaccaacatgaacgtggtgcaccagaacaagcagctggagagctgcaacggcgagaagcccccctgcctggagatcctgaccaacggcttcgccgtgctggagaccgtgaacccccagggcaccgacgacctggacaacgtggccgacagcaagggcagaaagcccctgagcacccacagcaccgagtacaacctggacagcgtgcccagccccgccgaggagttcgccgacttcgccaccttcagcaagaaggagagaatccagctggaggagatcgagtgcgccgtgctgaacgacagagaggccctgaccatcagagagaacaacaagatcaacagagtgaacgagctgaacagcgtgaaggaggtggccctgggcagaagcctggacaacaagggcgacaccgacggcgaggaccaggtgtgcgtgagcgagatcagcatcgtgaccaacagaggcttcagcgtggagaagcagggcctgcccaccctgcagcaggacgagttcctgcagagcggcgtgcagagcaaggcctggagcctggtggacagcgccgacaacagcgaggccatcagaagagagcagtgcaagaccgaggagaagctggacctgctgaccagcaagtgcgcccacctgtgcatggacagcgtgaagaccagcgacgacgaggtgggcagccccaaggaggagagcagaaagttcaccaacttccagagccccaacatcgaccccaccgaggagaacgacctggacgacagcctgagcgtgaagaacggcgacagcagcaacgacttcgtgacctgcaacgacatcaacgaggacgacttcggcgacttcggcgacttcggcagcgccagcggcagcaccccccccttcgtgaccggcacccaggacagcatgagcgacgccaccttcgaggagagcagcgagcacttcccccacttcagcgagcccggcgacgacttcggcgagttcggcgacatcaacgccgtgagctgccaggaggagaccatcctgaccaagagcgacctgaagcagaccagcgacaacctgagcgaggagtgccagctggccagaaagagcagcggcaccggcaccgagcccgtggccaagctgaagaacggccaggagggcgagatcggccacttcgacagcgtgcccaacatccaggacgactgcaacggcttccaggacagcgacgacttcgccgacttcagcagcgccggccccagccaggtggtggactggaacgccttcgaggacgagcagaaggacagctgcagctgggccgccttcggcgaccagcaggccaccgagagccaccacagaaaggaggcctggcagagccacagaaccgacgagaacatcgacacccccggcacccccaagacccacagcgtgcccagcgccaccagcaagggcgccgtggccagcggccacctgcaggagagcgccaccagcgtgcagaccgccctgctgaacagactggagagaatcttcgaggcctgcttccccagcatcctggtgcccgacgccgaggaggaggtgaccagcctgaagcacctgctggagaccagcaccctgcccatcaagaccagagaggccctgcccgagagcggcgagctgctggacgtgtggaccgagctgcaggacatccacgacgcccacggcctgagataccagtggggcggcagccacagcaacaagaagctgctgagcagcctgggcatcgacaccagaaacatcctgttcaccggcaacaagaagcagcccgtgatcgtgcccatgtacgccgccggcctgggcatgctggagcccaccaaggagcccctgaagcccctgagcgccgccgagaagatcgccagcatcggccagaccgccaccatgagccccgacatgaacacctgcaccagcgaccagttccaggagagcctgccccccgtgcagttcgactggagcagcagcggcctgaccaaccccctggacgccagcggcggcagcaccctgctgaacctggacttcttcggccccgtggacgacagcagcagcagcagcagcaccaccatccccggcgtggaccccgagctgtacgagctgaccaccagcaagctggagatcagcaccagcagcctgaaggtgaccgacgccttcgccagactgatgagcaccgtggagaagaccagcaccagcaccagcagaaagcccaagagagaggagcacctgagcgaggaggccatcaaggtgatcgccggcctgcccgacctgaccttcatgcacgccaaggtgctgatgttccccgccaccctgacccccagcaccagcagccaggagaaggccgacggctag

SEQ ID NO: 11973 - DNA, 114 bp, Artificial Sequence
  Description of Artificial Sequence: Synthetic coding sequence
atggccagcgaggacatcgccaagctggccgagaccctggccaagacccaggtggccggcggccagctgagcttcaagggcaagagcctgaagctgaacaccgccgaggactag

SEQ ID NO: 11974 - DNA, 309 bp, Artificial Sequence
  Description of Artificial Sequence: Synthetic coding sequence
atgcagaccagcagcagcagaagcgtgcacctgagcgagtggcagaagaactacttcgccatcaccagcggcatctgcaccggccccaaggccgacgcctacagagcccagatcctgagaatccagtacgcctgggccaacagcgagatcagccaggtgtgcgccaccaagctgttcaagaagtacgccgagaagtacagcgccatcatcgacagcgacaacgtggagagcggcctgaacaactacgccgagaacatcctgaccctggccggcagccagcagaccgacagcgacaagtggcagagctag

SEQ ID NO: 11975 - DNA, 474 bp, Artificial Sequence; identical to SEQ ID NO: 11812
  Description of Artificial Sequence: Synthetic coding sequence

SEQ ID NO: 11976 - DNA, 348 bp, Artificial Sequence
  Description of Artificial Sequence: Synthetic coding sequence
atggccggcgcccccaccgtgagcctgcccgagctgagaagcctgctggccagcggcagagccagactgttcgacgtgagaagcagagaggaggccgccgccggcaccatccccggcgccctgaacatccccgtgagcgagctggagagcgccctgcagatggagcccgccgccttccaggccctgtacagcgccgagaagcccaagctggaggacgagcacctggtgttcttctgccagatgggcaagagaggcctgcaggccacccagctggccagaagcctgggctacaccggcgccagaaactacgccggcgcctacagagagtggctggagaaggagagctag

SEQ ID NO: 11977 - DNA, 4767 bp, Artificial Sequence; identical to SEQ ID NO: 10006
  Description of Artificial Sequence: Synthetic coding sequence

SEQ ID NO: 11978 - DNA, 381 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagttcagcgccttcgacatgagcgcccccacccccgccagatgctgccccgccatcggcaccctgtacaacaccaacaccctggagagcttcaagaccgccgacaagaagctgctgctggagcaggccgccaacgagatctgggagagcatcaagagcggcaccgccctggagaaccccgtgtag

SEQ ID NO: 11979 - DNA, 1434 bp, Artificial Sequence
  Description of Artificial Sequence: Synthetic coding sequence
atggccgacggccaggtggccgagctgctgctgagaagactggaggccagcgacggcggcctggacagcgccgagctggccgccgagctgggcatggagcaccaggccgtggtgggcgccgtgaagagcctgcaggccctgggcgaggtgatcgaggccgagctgagaagcaccaagcactgggagctgaccgccgagggcgaggagatcgccagagagggcagccacgaggccagagtgttcagaagcatcccccccgagggcctggcccagagcgagctgatgagactgcccagcggcaaggtgggcttcagcaaggccatgagcaacaagtggatcagagtggacaagagcgccgccgacggccccagagtgttcagagtggtggacagcatggaggacgaggtgcagagaagactgcagctggtgagaggcggccaggccgagaagctgggcgagaaggagagaagcgagctgagaaagagaaagctgctggccgaggtgggcagctggagagacagacccttcaagccctacaacttcctggcccacggcgtgctgcccgacagcggccacctgcaccccctgctgaaggtgagaagccagttcagacagatcttcctggagatgggcttcaccgagatgcccaccgacaacttcatcgagagcagcttctggaacttcgacgccctgttccagccccagcagcaccccgccagagaccagcacgacaccttcttcctgagagaccccgccgaggccctgcagctgcccatggactacgtgcagagagtgaagagaacccacagccagggcggctacggcagccagggctacaagtacaactggaagctggacgaggccagaaagaacctgctgagaacccacaccaccagcgccagcgccagagccctgtacagactggcccagaagaagcccttcacccccgtgaagtacttcagcatcgacagagtgttcagaaacgagaccctggacgccacccacctggccgagttccaccagatcgagggcgtggtggccgaccacggcctgaccctgggccacctgatgggcgtgctgagagagttcttcaccaagctgggcatcacccagctgagattcaagcccgcctacaacccctacaccgagcccagcatggaggtgttcagctaccaccagggcctgaagaagtgggtggaggtgggcaacagcggcgtgttcagacccgagatgctgctgcccatgggcctgcccgagaacgtgagcgtgatcgcctggggcctgagcctggagagacccaccatgatcaagtacggcatcaacaacatcagagagctggtgggccacaaggtgaacctgcagatggtgtacgacagccccctgtgcagactggacgccgagcccagacccccccccacccaggaggccgcctag

SEQ ID NO: 11980 - DNA, 3195 bp, Artificial Sequence
  Description of Artificial Sequence: Synthetic coding sequence
atgcccgtgcaggccgcccagtggaccgagttcctgagctgccccatctgctacaacgagttcgacgagaacgtgcacaagcccatcagcctgggctgcagccacaccgtgtgcaagacctgcctgaacaagctgcacagaaaggcctgccccttcgaccagaccgccatcaacaccgacatcgacgtgctgcccgtgaacttcgccctgctgcagctggtgggcgcccaggtgcccgaccaccagagcatcaagctgagcaacctgggcgagaacaagcactacgaggtggccaagaagtgcgtggaggacctggccctgtacctgaagcccctgagcggcggcaagggcgtggccagcctgaaccagagcgccctgagcagacccatgcagagaaagctggtgaccctggtgaactgccagctggtggaggaggagggcagagtgagagccatgagagccgccagaagcctgggcgagagaaccgtgaccgagctgatcctgcagcaccagaacccccagcagctgagcgccaacctgtgggccgccgtgagagccagaggctgccagttcctgggccccgccatgcaggaggaggccctgaagctggtgctgctggccctggaggacggcagcgccctgagcagaaaggtgctggtgctgttcgtggtgcagagactggagcccagattcccccaggccagcaagaccagcatcggccacgtggtgcagctgctgtacagagccagctgcttcaaggtgaccaagagagacgaggacagcagcctgatgcagctgaaggaggagttcagaagctacgaggccctgagaagagagcacgacgcccagatcgtgcacatcgccatggaggccggcctgagaatcagccccgagcagtggagcagcctgctgtacggcgacctggcccacaagagccacatgcagagcatcatcgacaagctgcagagccccgagagcttcgccaagagcgtgcaggagctgaccatcgtgctgcagagaaccggcgaccccgccaacctgaacagactgagaccccacctggagctgctggccaacatcgaccccaaccccgacgccgtgagccccacctgggagcagctggagaacgccatggtggccgtgaagaccgtggtgcacggcctggtggacttcatccagaactacagcagaaagggccacgagaccccccagccccagcccaacagcaagtacaagaccagcatgtgcagagacctgagacagcagggcggctgccccagaggcaccaactgcaccttcgcccacagccaggaggagctggagaagtacagactgagaaacaagaagatcaacgccaccgtgagaaccttccccctgctgaacaaggtgggcgtgaacaacaccgtgaccaccaccgccggcaacgtgatcagcgtgatcggcagcaccgagaccaccggcaagatcgtgcccagcaccaacggcatcagcaacgccgagaacagcgtgagccagctgatcagcagaagcaccgacagcaccctgagagccctggagaccgtgaagaaggtgggcaaggtgggcgccaacggccagaacgccgccggccccagcgccgacagcgtgaccgagaacaagatcggcagcccccccaagacccccgtgagcaacgtggccgccaccagcgccggccccagcaacgtgggcaccgagctgaacagcgtgccccagaagagcagccccttcctgaccagagtgcccgtgtaccccccccacagcgagaacatccagtacttccaggaccccagaacccagatccccttcgaggtgccccagtacccccagaccggctactacccccccccccccaccgtgcccgccggcgtggccccctgcgtgcccagattcgtgagaagcaacaacgtgcccgagagcagcctgccccccgccagcatgccctacgccgaccactacagcaccttcagccccagagacagaatgaacagcagcccctaccagcccccccccccccagccctacggccccgtgccccccgtgcccagcggcatgtacgcccccgtgtacgacagcagaagaatctggagaccccccatgtaccagagagacgacatcatcagaagcaacagcctgccccccatggacgtgatgcacagcagcgtgtaccagaccagcctgagagagagatacaacagcctggacggctactacagcgtggcctgccagccccccagcgagcccagaaccaccgtgcccctgcccagagagccctgcggccacctgaagaccagctgcgaggagcagatcagaagaaagcccgaccagtgggcccagtaccacacccagaaggcccccctggtgagcagcaccctgcccgtggccacccagagccccaccccccccagccccctgttcagcgtggacttcagagccgacttcagcgagagcgtgagcggcaccaagttcgaggaggaccacctgagccactacagcccctggagctgcggcaccatcggcagctgcatcaacgccatcgacagcgagcccaaggacgtgatcgccaacagcaacgccgtgctgatggacctggacagcggcgacgtgaagagaagagtgcacctgttcgagacccagagaagaaccaaggaggaggaccccatcatccccttcagcgacggccccatcatcagcaagtggggcgccatcagcagaagcagcagaaccggctaccacaccaccgaccccgtgcaggccaccgccagccagggcagcgccaccaagcccatcagcgtgagcgactacgtgccctacgtgaacgccgtggacagcagatggagcagctacggcaacgaggccaccagcagcgcccactacgtggagagagacagattcatcgtgaccgacctgagcggccacagaaagcacagcagcaccggcgacctgctgagcctggagctgcagcaggccaagagcaacagcctgctgctgcagagagaggccaacgccctggccatgcagcagaagtggaacagcctggacgagggcagacacctgaccctgaacctgctgagcaaggagatcgagctgagaaacggcgaggtgaagaagctgaacctgagcgccagctgcctgatgtacctgttcagcgccgccgccagctggctgtaccactactag

SEQ ID NO: 11981 - DNA, 1548 bp, Artificial Sequence
  Description of Artificial Sequence: Synthetic coding sequence
tgagccggcggcagccccagcgtggtggactacttccccagcgaggacttctacagatgcggctactgcaagaacgagagcggcagcagaagcaacggcatgtgggcccacagcatgaccgtgcaggactaccaggacctgatcgacagaggctggagaagaagcggcaagtacgtgtacaagcccgtgatgaaccagacctgctgcccccagtacaccatcagatgcagacccctgcagttccagcccagcaagagccacaagaaggtgctgaagaagatgctgaagttcctggccaagggcgaggtgcccaagggcagctgcgaggacgagcccatggacagcaccatggacgacgccgtggccggcgacttcgccctgatcaacaagctggacatccagtgcgacctgaagaccctgagcgacgacatcaaggagagcctggagagcgagggcaagaacagcaagaaggaggagccccaggagctgctgcagagccaggacttcgtgggcgagaagctgggcagcggcgagcccagccacagcgtgaaggtgcacaccgtgcccaagcccggcaagggcgccgacctgagcaagcccccctgcagaaaggccaaggagatcagaaaggagagaaagagactgaagctgatgcagcagaaccccgccggcgagctggagggcttccaggcccagggccacccccccagcctgttcccccccaaggccaagagcaaccagcccaagagcctggaggacctgatcttcgagagcctgcccgagaacgccagccacaagctggaggtgagagtggtgagaagcagcccccccagcagccagttcaaggccaccctgctggagagctaccaggtgtacaagagataccagatggtgatccacaagaacccccccgacacccccaccgagagccagttcaccagattcctgtgcagcagccccctggaggccgagaccccccccaacggccccgactgcggctacggcagcttccaccagcagtactggctggacggcaagatcatcgccgtgggcgtgatcgacatcctgcccaactgcgtgagcagcgtgtacctgtactacgaccccgactacagcttcctgagcctgggcgtgtacagcgccctgagagagatcgccttcaccagacagctgcacgagaagaccagccagctgagctactactacatgggcttctacatccacagctgccccaagatgaagtacaagggccagtacagacccagcgacctgctgtgccccgagacctacgtgtgggtgcccatcgagcagtgcctgcccagcctggagaacagcaagtactgcagattcaaccaggaccccgaggccgtggacgaggacagaagcaccgagcccgacagactgcaggtgttccacaagagagccatcatgccctacggcgtgtacaagaagcagcagaaggaccccagcgaggaggccgccgtgctgcagtacgccagcctggtgggccagaagtgcagcgagagaatgctgctgttcagaaactag

SEQ ID NO: 11982 - DNA, 225 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagcatccccctgggccaggccgaccccagcctggccccctag

SEQ ID NO: 11983 - DNA, 594 bp, Artificial Sequence
  Description of Artificial Sequence: Synthetic coding sequence
atggccgccttcagagacatcgaggaggtgagccagggcctgctgagcctgctgggcgccaacagagccgaggcccagcagagaagactgctgggcagacacgagcaggtggtggagagactgctggagacccaggacggcgccgagaagcagctgagagagatcctgaccatggagaaggaggtggcccagagcctgctgaacgccaaggagcaggtgcaccagggcggcgtggagctgcagcagctggaggccggcctgcaggaggccggcgaggaggacaccagactgaaggccagcctgctgcagctgaccagagagctggaggagctgaaggagatcgaggccgacctggagagacaggagaaggaggtggacgaggacaccaccgtgaccatccccagcgccgtgtacgtggcccagctgtaccaccaggtgagcaagatcgagtgggactacgagtgcgagcccggcatggtgaagggcatccaccacggccccagcgtggcccagcccatccacctggacagcacccagctgagcagaaagttcatcagcgactacctgtggagcctggtggacaccgagtggtag

SEQ ID NO: 11984 - DNA, 2271 bp, Artificial Sequence; identical to SEQ ID NO: 10852
  Description of Artificial Sequence: Synthetic coding sequence

SEQ ID NO: 11985 - DNA, 1941 bp, Artificial Sequence
  Description of Artificial Sequence: Synthetic coding sequence
gcccagggcagcgtgagcttcaacgacgtgaccgtggacttcacccaggaggagtggcagcacctggaccacgcccagaagaccctgtacatggacgtgatgctggagaactactgccacctgatcagcgtgggctgccacatgaccaagcccgacgtgatcctgaagctggagagaggcgaggagccctggaccagcttcgccggccacacctgcctggaggagaactggaaggccgaggacttcctggtgaagttcaaggagcaccaggagaagtacagcagaagcgtggtgagcatcaaccacaagaagctggtgaaggagaagagcaagatctacgagaagaccttcaccctgggcaagaaccccgtgaacagcaagaacctgccccccgagtacgacacccacggcagaatcctgaagaacgtgagcgagctgatcatcagcaacctgaaccccgccagaaagagactgagcgagtacaacggctacggcaagagcctgctgagcaccaagcaggagaccacccaccccgaggtgaagagccacaaccagagcgccagagccttcagccacaacgaggtgctgatgcagtaccagaagaccgagacccccgcccagagcttcggctacaacgactgcgagaagagcttcctgcagagaggcggcctgatcacccacagcagaccctacaagggcgagaaccccagcgtgtacaacaagaagagaagagccaccaacatcgagaagaagcacacctgcaacgagtgcggcaagagcttctgcagaaagagcgtgctgatcctgcaccagggcatccacagcgaggagaagccctaccagtgccaccagtgcggcaacgccttcagaagaaagagctacctgatcgaccaccagagaacccacaccggcgagaagcccttcgtgtgcaacgagtgcggcaagagcttcagactgaagaccgccctgaccgaccaccagagaacccacaccggcgagaagagctacgagtgcctgcagtgcagaaacgccttcagactgaagagccacctgatcagacaccagagaacccacaccggcgagaagccctacgagtgcaacgactgcggcaagagcttcagacagaagaccaccctgagcctgcaccagagaatccacaccggcgagaagccctacatctgcaaggagtgcggcaagagcttccaccagaaggccaacctgaccgtgcaccagagaacccacaccggcgagaagccctacatctgcaacgagtgcggcaagagcttcagccagaagaccaccctggccctgcacgagaagacccacaacgaggagaagccctacatctgcagcgagtgcggcaagagcttcagacagaagaccaccctggtggcccaccagagaacccacaccggcgagaagagctacgagtgcccccactgcggcaaggccttcagaatgaagagctacctgatcgaccaccacagaacccacaccggcgagaagccctacgagtgcaacgagtgcggcaagagcttcagccagaagaccaacctgaacctgcaccagagaatccacaccggcgagaagccctacgtgtgcaacgagtgcggcaagagcttcagacagaaggccaccctgaccgtgcaccagaagatccacaccggccagaagagctacgagtgcccccagtgcggcaaggccttcagcagaaagagctacctgatccaccaccagagaacccacaccggcgagaagccctacaagtgcagcgagtgcggcaagtgcttcagacagaagaccaacctgatcgtgcaccagagaacccacaccggcgagaagccctacgtgtgcaacgagtgcggcaagagcttcagctacaagagaaacctgatcgtgcaccagagaacccacaagggcgagaacatcgagatgcagtag

SEQ ID NO: 11986 - DNA, 594 bp, Artificial Sequence
  Description of Artificial Sequence: Synthetic coding sequence
atgggcggcagaaagagagagagaaaggccgccgtggaggaggacaccagcctgagcgagagcgagggccccagacagcccgacggcgacgaggaggagagcaccgccctgagcatcaacgaggagatgcagagaatgctgaaccagctgagagagtacgacttcgaggacgactgcgacagcctgacctgggaggagaccgaggagaccctgctgctgtgggaggacttcagcggctacgccatggccgccgccgaggcccagggcgagcaggaggacagcctggagaaggtgatcaaggacaccgagagcctgttcaagaccagagagaaggagtaccaggagaccatcgaccagatcgagctggagctggccaccgccaagaacgacatgaacagacacctgcacgagtacatggagatgtgcagcatgaagagaggcctggacgtgcagatggagacctgcagaagactgatcacccagagcggcgacagaaagagccccgccttcaccgccgtgcccctgagcgaccccccccccagacaggccagactgagaacccccatcgccatgagccacctgaccgccccctag

SEQ ID NO: 11987 - DNA, 423 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagcatccccctgggccaggccgaccccagcctggccccctacatcatcgacctgcccagctggacccagttcagacaggacaccggcaccatgagagccgtgagaagacacctgttcccccagcacagcgcccccggcagaggcgtggtgtgggagtggctgagcgacgacggcagctggaccgcctacgaggccagcgtgtgcgactacctggagcagcaggtggccagaggcaactag

SEQ ID NO: 11988 - DNA, 3237 bp, Artificial Sequence
  Description of Artificial Sequence: Synthetic coding sequence
gtgtgcatgcacccccacaacgtgctgagcgacgtggtgaactacaccctgtggctgatggagtgcagccacgccagcggctgctgccacgccaccatgttcttcagcatctgcttcagcttcagagccgtgctggagctgttcgacagatacgacggcctgagaagactggtgaacctgatcagcaccctggagatcctgaacctggaggaccagggcgccctgctgagcgacgacgagatcttcgccagcagacagaccggcaagcacacctgcatggccctgagaaagtacttcgaggcccacctggccatcaagctggagcaggtgaagcagagcctgcagagaaccgagggcggcatcctggtgcacccccagcccccctacaaggcctgcagctacacccacgagcagatcgtggagatgatggagttcctgatcgagtacggccccgcccagctgtactgggagcccgccgaggtgttcctgaagctgagctgcgtgcagctgctgctgcagctgatcagcatcgcctgcaactggaagacctactacgccagaaacgacaccgtgagattcgccctggacgtgctggccatcctgaccgtggtgcccaagatccagctgcagctggccgagagcgtggacgtgctggacgaggccggcagcaccgtgagcaccgtgggcatcagcatcatcctgggcgtggccgagggcgagttcttcatccacgacgccgagatccagaagagcgccctgcagatcatcatcaactgcgtgtgcggccccgacaacagaatcagcagcatcggcaagttcatcagcggcacccccagaagaaagctgccccagaaccccaagagcagcgagcacaccctggccaagatgtggaacgtggtgcagagcaacaacggcatcaaggtgctgctgagcctgctgagcatcaagatgcccatcaccgacgccgaccagatcagagccctggcctgcaaggccctggtgggcctgagcagaagcagcaccgtgagacagatcatcagcaagctgcccctgttcagcagctgccagatccagcagctgatgaaggagcccgtgctgcaggacaagagaagcgaccacgtgaagttctgcaagtacgccgccgagctgatcgagagagtgagcggcaagcccctgctgatcggcaccgacgtgagcctggccagactgcagaaggccgacgtggtggcccagagcagaatcagcttccccgagaaggagctgctgctgctgatcagaaaccacctgatcagcaagggcctgggcgagaccgccaccgtgctgaccaaggaggccgacctgcccatgaccgccgccagccacagcagcgccttcacccccgtgaccgccgccgccagccccgtgagcctgcccagaacccccagaatcgccaacggcatcgccaccagactgggcagccacgccgccgtgggcgccagcgcccccagcgcccccaccgcccacccccagcccagacccccccagggccccctggccctgcccggccccagctacgccggcaacagccccctgatcggcagaatcagcttcatcagagagagacccagcccctgcaacggcagaaagatcagagtgctgagacagaagagcgaccacggcgcctacagccagagccccgccatcaagaagcagctggacagacacctgcccagcccccccaccctggacagcatcatcaccgagtacctgagagagcagcacgccagatgcaagaaccccgtggccacctgcccccccttcagcctgttcaccccccaccagtgccccgagcccaagcagagaagacaggcccccatcaacttcaccagcagactgaacagaagagccagcttccccaagtacggcggcgtggacggcggctgcttcgacagacacctgatcttcagcagattcagacccatcagcgtgttcagagaggccaacgaggacgagagcggcttcacctgctgcgccttcagcgccagagagagattcctgatgctgggcacctgcaccggccagctgaagctgtacaacgtgttcagcggccaggaggaggccagctacaactgccacaacagcgccatcacccacctggagcccagcagagacggcagcctgctgctgaccagcgccacctggagccagcccctgagcgccctgtggggcatgaagagcgtgttcgacatgaagcacagcttcaccgaggaccactacgtggagttcagcaagcacagccaggacagagtgatcggcaccaagggcgacatcgcccacatctacgacatccagaccggcaacaagctgctgaccctgttcaaccccgacctggccaacaactacaagagaaactgcgccaccttcaaccccaccgacgacctggtgctgaacgacggcgtgctgtgggacgtgagaagcgcccaggccatccacaagttcgacaagttcaacatgaacatcagcggcgtgttccaccccaacggcctggaggtgatcatcaacaccgagatctgggacctgagaaccttccacctgctgcacaccgtgcccgccctggaccagtgcagagtggtgttcaaccacaccggcaccgtgatgtacggcgccatgctgcaggccgacgacgaggacgacctgatggaggagagaatgaagagccccttcggcagcagcttcagaaccttcaacgccaccgactacaagcccatcgccaccatcgacgtgaagagaaacatcttcgacctgtgcaccgacaccaaggactgctacctggccgtgatcgagaaccagggcagcatggacgccctgaacatggacaccgtgtgcagactgtacgaggtgggcagacagagactggccgaggacgaggacgaggaggaggaccaggaggaggaggagcaggaggaggaggacgacgacgaggacgacgacgacaccgacgacctggacgagctggacaccgaccagctgctggaggccgagctggaggaggacgacaacaacgagaacgccggcgaggacggcgacaacgacttcagccccagcgacgaggagctggccaacctgctggaggagggcgaggacggcgaggacgaggacagcgacgccgacgaggaggtggagctgatcctgggcgacaccgacagcagcgacaacagcgacctggaggacgacatcatcctgagcctgaacgagtag

SEQ ID NO: 11989 - DNA, 447 bp, Artificial Sequence
  Description of Artificial Sequence: Synthetic coding sequence
atgctgagcgacggctgcggcagcgaggagaagatcagcgtgcccagctgctacggcggcatcggcgcccccgtgagcagacaggtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagccctag

SEQ ID NO: 11990 - DNA, 1755 bp, Artificial Sequence
  Description of Artificial Sequence: Synthetic coding sequence
atgagcctgccccccgagaaggccagcgagctgaagcagctgatccaccagcagctgagcaagatggacgtgcacggcagaatcagagagatcctggccgagaccatcagagaggagctggcccccgaccagcagcacctgagcaccgaggacctgatcaaggccctgagaagaagaggcatcatcgacgacgtgatgaaggagctgaacttcgtgaccgacagcgtggagcaggagctgcccagcagccccaagcagcccatctgcttcgacagacagagcaccctgaagaagagcgacggcaccagaatggccgacagcaccaccatgctgagcatcagcgaccccatccacatggtgctgatcaagaccgacatcttcggcgagaccaccctggtggccagctacttcctggagtggagaagcgtgctgggcagcgagaacggcgtgaccagcctgaccgtggagctgatgggcgtgggcaccgagagcaaggtgagcgtgggcatcctgaacatcaagctggagatgtacccccccctgaaccagaccctgagccaggaggtggtgaacacccagctggccctggagagacagaagaccgccgagaaggagagactgttcctggtgtacgccaagcagtggtggagagagtacctgcagatcagacccagccacaacagcagactggtgaagatcttcgcccaggacgagaacggcatcaacagacccgtgtgcagctacgtgaagcccctgagagccggcagactgctggacacccccagacaggccgccagattcgtgaacgtgctgggctacgagagagcccccgtgatcggcggcggcggcaagcaggagcagtggtgcaccctgctggccttcctgtgcagaaacaagggcgactgcgaggaccacgccaacctgctgtgcagcctgctgctgggctacggcctggaggccttcgtgtgcgtgggcaccaaggccaagggcgtgccccacgcctgggtgatgacctgcggcaccgacggcgccatcaccttctgggagagcctgaccggccacagatacatccacaagcccaccaaccccgacgagccccccgtggccgagcagcccaagcccctgtacccctacagaaccatcggctgcgtgttcaaccaccagatgttcctgggcaactgccagcccagcgacgccgtggagacctgcgtgttcgacctgaacgacgagagcaagtggaagcccatgagcgaggaggccatcaagagcgtgtgcgcccccggcgccaccaccagcctgccccccttcccccccctgtgcgccagcaccatcgacgccagcgtgaccagcaacgagatcgagatgcagctgagactgctggtgagcgagcacagaaaggacctgggcctgaccaccgtgtgggaggaccagctgagctacctgctgagccccgccctggccagctacgagttcgagagaaccaccagcatcagcgccggcaacgaggagttccaggacgccatcagaagagccgtgcccgacggccacaccttcaagggcttccccatccacttcgtgtacagaaacgccagaagagccttcgccacctgcctgagaagccccttctgcgaggagatcatctgctgcagaggcgaccaggtgagactggccgtgagagtgagagtgttcacctaccccgagagcgcctgcgccgtgtggatcatgttcgcctgcaagtacagaagcgtgctgtag

SEQ ID NO: 11991 - DNA, 4515 bp, Artificial Sequence
  Description of Artificial Sequence: Synthetic coding sequence
atggtgagcgagagcgacttcagcaaggacgtggccgtgcaggtgctgcccctggacaagatcgaggagaacaacaagcagaaggccaacgacatcttcatcagccagtacaccatgggccagaaggacgccctgagaaccgtgctgaagcagaacgtgagcctgtgcctgaccggctggagcgaccacagcggcgtgatcaccacccactgcagcctgtacctgctgagactgatgagaagcagccacctgagcctgcccagcagctgggactacagagcccagagcatgcccgtgttcaaggaggtgaaggtgcacctgctggaggacgccggcatcgagaaggacgccgtgacccaggagaccagaatcagccccagcggcatcgacagcgccaccaccgtggccgccgccaccgccgccgccatcgccaccgccgcccccctgatcaaggtgcagagcgacctggaggccaaggtgaacagcgtgaccgagctgctgagcaagctgcaggagaccgacaagcacctgcagagagtgaccgagcagcagaccagcatccagagaaagcaggagaagctgcactgccacgaccacgagaagcagatgaacgtgttcatggagcagcacatcagacacctggagaagctgcagcagcagcagatcgacatccagacccacttcatcagcgccgccctgaagaccagcagcttccagcccgtgagcatgcccagcagcagagccgtggagaagtacagcgtgaagcccgagcaccccaacctgggcagctgcaaccccagcctgtacaacaccttcgccagcaagcaggcccccctgaaggaggtggaggacaccagcttcgacaagcagaagagccccctggagacccccgcccccagaagattcgcccccgtgcccgtgagcagagacgacgagctgagcaagagagagaacctgctggaggagaaggagaacatggaggtgagctgccacagaggcaacgtgagactgctggagcagatcctgaacaacaacgacagcctgaccagaaagagcgagagcagcaacaccaccagcctgaccagaagcaagatcggctggacccccgagaagaccaacagattccccagctgcgaggagctggagaccaccaaggtgaccatgcagaagagcgacgacgtgctgcacgacctgggccagaaggagaaggagaccaacagcatggtgcagcccaaggagagcctgagcatgctgaagctgcccgacctgccccagaacagcgtgaagctgcagaccaccaacaccaccagaagcgtgctgaaggacgccgagaagatcctgagaggcgtgcagaacaacaagaaggtgctggaggagaacctggaggccatcatcagagccaaggacggcgccgccatgtacagcctgatcaacgccctgagcaccaacagagagatgagcgagaagatcagaatcagaaagaccgtggacgagtggatcaagaccatcagcgccgagatccaggacgagctgagcagaaccgactacgagcagaagagattcgaccagaagaaccagagaaccaagaagggccagaacatgaccaaggacatcagaaccaacacccaggacaagaccgtgaacaagagcgtgatccccagaaagcacagccagaagcagatcgaggagcacttcagaaacctgcccatgagaggcatgcccgccagcagcctgcagaaggagagaaaggagggcctgctgaaggccaccaccgtgatccaggacgaggactacatgctgcaggtgtacggcaagcccgtgtaccagggccacagaagcaccctgaagaagggcccctacctgagattcaacagccccagccccaagagcagaccccagagacccaaggtgatcgagagagtgaagggcaccaaggtgaagagcatcagaacccagaccgacttctacgccaccaagcccaagaagatggacagcaagatgaagcacagcgtgcccgtgctgccccacggcgaccagcagtacctgttcagccccagcagagagatgcccaccttcagcggcaccctggagggccacctgatccccatggccatcctgctgggccagacccagagcaacagcgacaccatgccccccgccggcgtgatcgtgagcaagccccaccccgtgaccgtgaccaccagcatcccccccagcagcagaaaggtggagaccggcgtgaagaagcccaacatcgccatcgtggagatgaagagcgagaagaaggaccccccccagctgaccgtgcaggtgctgcccagcgtggacatcgacagcatcagcaacagcagcgccgacgtgctgagccccctgagcagccccaaggaggccagcctgccccccgtgcagacctggatcaagacccccgagatcatgaaggtggacgaggaggaggtgaagttccccggcaccaacttcgacgagatcatcgacgtgatccaggaggaggagaagtgcgacgagatccccgacagcgagcccatcctggagttcaacagaagcgtgaaggccgacagcaccaagtacaacggcccccccttcccccccgtggccagcaccttccagcccaccgccgacatcctggacaaggtgatcgagagaaaggagaccctggagaacagcctgatccagtgggtggagcaggagatcatgagcagaatcatcagcggcctgttccccgtgcagcagcagatcgcccccagcatcagcgtgagcgtgagcgagaccagcgagcccctgaccagcgacatcgtggagggcaccagcagcggcgccctgcagctgttcgtggacgccggcgtgcccgtgaacagcaacgtgatcaagcacttcgtgaacgaggccctggccgagaccatcgccgtgatgctgggcgacagagaggccaagaagcagggccccgtggccaccggcgtgagcggcgacgccagcaccaacgagacctacctgcccgccagagtgtgcacccccctgcccaccccccagcccacccccccctgcagccccagcagccccgccaaggagtgcgtgctggtgaagacccccgacagcagcccctgcgacagcgaccacgacatggccttccccgtgaaggagatctgcgccgagaagggcgacgacatgcccgccatcatgctggtgaacacccccaccgtgacccccaccaccacccccccccccgccgccgccgtgttcacccccaccctgagcgacatcagcatcgacaagctgaaggtgagcagccccgagctgcccaagccctggggcgacggcgacctgcccctggaggaggagaaccccaacagcccccaggaggagctgcaccccagagccatcgtgatgagcgtggccaaggacgaggagcccgagagcatggacttccccgcccagccccccccccccgagcccgtgcccttcatgcccttccccgccggcaccaaggcccccagccccagccagatgcccggcagcgacagcagcaccctggagagcaccctgagcgtgaccgtgaccgagaccgagaccctggacaagcccatcagcgagggcgagatcctgttcagctgcggccagaagctggcccccaagatcctggaggacatcggcctgtacctgaccaacctgaacgacagcctgagcagcaccctgcacgacgccgtggagatggaggacgacccccccagcgagggccaggtgatcagaatgagccacaagaagttccacgccgacgccatcctgagcttcgccaagcagaaccaggagagcgccgtgagccagcaggccgtgtaccacagcgaggacctggagaacagcgtgggcgagctgagcgagggccagagaccccagctgaccgccgccgccgagaacatcctgatgggccacagcctgtacatgcagccccccgtgaccaacacccagagcctggaccagcagtgcgaccccaagcccctgagcagacagttcgacaccgtgagcggcagcatctacgaggacagctgcgccagccacggccccatgagcctgggcgagctggagctggagcccaacagcaagctggtgctgcccaccaccctgctgaccgcccaggagaacgacgtgaacctgcccgtggccgccgaggacttcagccagtaccagctgaagcagaaccaggacgtgaagcaggtggagcacaagcccagccagagctacctgagagtgagaaacaagagcgacatcgcccccagccagcagcaggtgagccccggcgacatggacagaacccagatcgagctgaacccctacctgacctgcgtgttcagcggcggcaaggccgtgcccctgagcgccagccagatgccccccgccaagatgagcgtgatgctgcccagcgtgaacctggaggactgcagccagagcctgagcctgagcaccatgcaggaggacatggagagcagcggcgccgacaccttctag

SEQ ID NO: 11992 - DNA, 2271 bp, Artificial Sequence
  Description of Artificial Sequence: Synthetic coding sequence
atggtggcccccgtgctggagaccagccacgtgttctgctgccccaacagagtgagaggcgtgctgaactggagcagcggccccagaggcctgctggccttcggcaccagctgcagcgtggtgctgtacgaccccctgaagagagtggtggtgaccaacctgaacggccacaccgccagagtgaactgcatccagtggatctgcaagcaggacggcagccccagcaccgagctggtgagcggcggcagcgacaaccaggtgatccactgggagatcgaggacaaccagctgctgaaggccgtgcacctgcagggccacgagggccccgtgtacgccgtgcacgccgtgtaccagagaagaaccagcgaccccgccctgtgcaccctgatcgtgagcgccgccgccgacagcgccgtgagactgtggagcaagaagggccccgagggcagagacctgttcctggccagctgcagccaggactgcctgatcagaatctggaagctgtacatcaagagcaccagcctggagacccaggacgacgacaacatcagactgaaggagaacaccttcaccatcgagaacgagagcgtgaagatcgccttcgccgtgaccctggagaccgtgctggccggccacgagaactgggtgaacgccgtgcactggcagcccgtgttctacaaggacggcgtgctgcagcagcccgtgagactgctgagcgccagcatggacaagaccatgatcctgtgggcccccgacgaggagagcggcgtgtggctggagcaggtgagagtgggcgaggtgggcggcaacaccctgggcttctacgactgccagttcaacgaggacggcagcatgatcatcgcccacgccttccacggcgccctgcacctgtggaagcagaacaccgtgaaccccagagagtggacccccgagatcgtgatcagcggccacttcgacggcgtgcaggacctggtgtgggaccccgagggcgagttcatcatcaccgtgggcaccgaccagaccaccagactgttcgccccctggaagagaaaggaccagagccaggtgacctggcacgagatcgccagaccccagatccacggctacgacctgaagtgcctggccatgatcaacagattccagttcgtgagcggcgccgacgagaaggtgctgagagtgttcagcgcccccagaaacttcgtggagaacttctgcgccatcaccggccagagcctgaaccacgtgctgtgcaaccaggacagcgacctgcccgagggcgccaccgtgcccgccctgggcctgagcaacaaggccgtgttccagggcgacatcgccagccagcccagcgacgaggaggagctgctgaccagcaccggcttcgagtaccagcaggtggccttccagcccagcatcctgaccgagccccccaccgaggaccacctgctgcagaacaccctgtggcccgaggtgcagaagctgtacggccacggctacgagatcttctgcgtgacctgcaacagcagcaagaccctgctggccagcgcctgcaaggccgccaagaaggagcacgccgccatcatcctgtggaacaccaccagctggaagcaggtgcagaacctggtgttccacagcctgaccgtgacccagatggccttcagccccaacgagaagttcctgctggccgtgagcagagacagaacctggagcctgtggaagaagcaggacaccatcagccccgagttcgagcccgtgttcagcctgttcgccttcaccaacaagatcaccagcgtgcacagcagaatcatctggagctgcgactggagccccgacagcaagtacttcttcaccggcagcagagacaagaaggtggtggtgtggggcgagtgcgacagcaccgacgactgcatcgagcacaacatcggcccctgcagcagcgtgctggacgtgggcggcgccgtgaccgccgtgagcgtgtgccccgtgctgcaccccagccagagatacgtggtggccgtgggcctggagtgcggcaagatctgcctgtacacctggaagaagaccgaccaggtgcccgagatcaacgactggacccactgcgtggagaccagccagagccagagccacaccctggccatcagaaagctgtgctggaagaactgcagcggcaagaccgagcagaaggaggccgagggcgccgagtggctgcacttcgccagctgcggcgaggaccacaccgtgaagatccacagagtgaacaagtgcgccctgtag

SEQ ID NO: 11993 - DNA, 345 bp, Artificial Sequence
  Description of Artificial Sequence: Synthetic coding sequence
atgcaggagatcaaccagaacctggccgaggaggccggcctgaacatcacccacatctgcctgccccccgacagcagcgaggccgagatcatcgacgagatcctgaagatcaacgaggacaccagagtgcacggcctggccctgcagatcagcgagaacctgttcagcaacaaggtgctgaacgccctgaagcccgagaaggacgtggacggcgtgaccgacatcaacctgggcaagctggtgagaggcgacgcccacgagtgcttcgtgagccccgtggccaaggccgtgatcgagctgctggagaagagcggcgtgaacctggacggcaagaagatcctgtag

SEQ ID NO: 11994 - DNA, 747 bp, Artificial Sequence; identical to SEQ ID NO: 11765
  Description of Artificial Sequence: Synthetic coding sequence

SEQ ID NO: 11995 - DNA, 1461 bp, Artificial Sequence; identical to SEQ ID NO: 9652
  Description of Artificial Sequence: Synthetic coding sequence

SEQ ID NO: 11996 - DNA, 1710 bp, Artificial Sequence
  Description of Artificial Sequence: Synthetic coding sequence
atggccctgctgagcgagggcctggacgaggtgcccgccgcctgcctgagcccctgcggcccccccaaccccaccgagctgttcagcgagagcagaagactggccctggaggagctggtggccggcggccccgaggccttcgccgccttcctgagaagagagagactggccagattcctgaaccccgacgaggtgcacgccatcctgagagccgccgagagacccggcgaggagggcgccgccgccgccgccgccgccgaggacagcttcggcagcagccacgactgcagcagcggcacctacttccccgagcagagcgacctggagccccccctgctggagctgggctggcccgccttctaccagggcgccggcgagggcggcccctacggctgcaaggacgccctgagacagcagctgagaagcgccagagaggtgatcgccgtggtgatggacgtgttcaccgacatcgacatcttcagagacctgcaggagatctgcagaaagcagggcgtggccgtgtacatcctgctggaccaggccctgctgagccagttcctggacatgtgcatggacctgaaggtgcaccccgagcaggagaagctgatgaccgtgagaaccatcaccggcaacatctactacgccagaagcggcaccaagatcatcggcaaggtgcacgagaagttcaccctgatcgacggcatcagagtggccaccggcagctacagcttcacctggaccgacggcaagctgaacagcagcaacctggtgatcctgagcggccaggtggtggagcacttcgacctggagttcagaatcctgtacgcccagagcaagcccatcagccccaagctgctgagccacttccagagcagcaacaagttcgaccacctgaccaacagaaagccccagagcaaggagctgaccctgggcaacctgctgagaatgagactggccagactgagcagcacccccagaaaggccgacctggaccccgagatgcccgccgagggcaaggccgagagaaagccccacgactgcgagagcagcaccgtgagcgaggaggactacttcagcagccacagagacgagctgcagagcagaaaggccatcgacgccgccacccagaccgagcccggcgaggagatgcccggcctgagcgtgagcgaggtgggcacccagaccagcatcaccaccgcctgcgccggcacccagaccgccgtgatcaccagaatcgccagcagccagaccaccatctggagcagaagcaccaccacccagaccgacatggacgagaacatcctgttccccagaggcacccagagcaccgagggcagccccgtgagcaagatgagcgtgagcagaagcagcagcctgaagagcagcagcagcgtgagcagccagggcagcgtggccagcagcaccggcagccccgccagcatcagaaccaccgacttccacaaccccggctaccccaagtacctgggcaccccccacctggagctgtacctgagcgacagcctgagaaacctgaacaaggagagacagttccacttcgccggcatcagaagcagactgaaccacatgctggccatgctgagcagaagaaccctgttcaccgagaaccacctgggcctgcacagcggcaacttcagcagagtgaacctgctggccgtgagagacgtggccctgtaccccagctaccagtag

SEQ ID NO: 11997 - DNA, 1224 bp, Artificial Sequence
  Description of Artificial Sequence: Synthetic coding sequence
atggtgctgttcagcgacagcagcctgccccactggcagcagcagcccccccagcccgccccccccccccccctgttccccagacagcagcaggtgcaggtgaacaagggcagagtgaactgccaccccagatgcagatacatcaagaccaagccctgccaccagctgagccaccaggtgtgggtgcagcagaagcccagccacagactgctgagcctgcagctgagccccagccccaagcccagccccagcccccagctgagcctgaagttcagactgagcctgaagttcagacccaagcagctgttccaccccatgagcctgctgaagcacaacccccccacccacagccaccccagccccaagctgcagcagagccagccccagagcaacgtgcagggccagagccccgtgagagtgcagagccccagccagaccagaatcagacccagcacccccagccagctgagccccggccagcagagccaggtgcagaccaccaccagccagcccatccccatccagccccacaccagcctgcagatccccagccagggccagccccagagccagccccaggtggtgatgaagcacaacgccgtgatcgagcacctgaagcagaagaagagcatgacccccgccgagagagaggagaaccagagaatgatcgtgtgcaaccaggtgatgaagtacatcctggacaagatcgacaaggaggagaagcaggccgccaagaagagaaagagagaggagagcgtggagcagaagagaagcaagcagaacgccaccaagctgagcgccctgctgttcaagcacaaggagcagctgagagccgagatcctgaagaagagagccctgctggacaaggacctgcagatcgaggtgcaggaggagctgaagagagacctgaagatcaagaaggagaaggacctgatgcagctggcccaggccaccgccgtggccgccccctgcccccccgtgacccccgccccccccgccccccccgcccccccccccagccccccccccccccccgccgtgcagcacaccggcctgctgagcacccccaccctgcccgccgccagccagaagagaaagagagaggaggagaaggacagcagcagcaagagcaagaagaagaagatgatcagcaccaccagcaaggagaccaagaaggacaccaagctgtactgcatctgcaagaccccctacgacgagagctag

SEQ ID NO: 11998 - DNA, 480 bp, Artificial Sequence; identical to SEQ ID NO: 11816
  Description of Artificial Sequence: Synthetic coding sequence

SEQ ID NO: 11999 - DNA, 309 bp, Artificial Sequence
  Description of Artificial Sequence: Synthetic coding sequence
atgaacgaggccgagatcgtggacgtggccctgggcatcctgatcgagagcagaaagcaggagaaggcctgcgagcagcccgccctggccggcgccgacaaccccgagcacagccccccctgcagcgtgagcccccacaccagcagcggcagcagcagcgaggaggaggacagcggcaagcaggccctggcccccggcctgagccccagccagagacccggcggcagcagcagcgcctgcagcagaagccccgaggaggaggaggaggaggacgtgctgaagtacgtgagagagatcttcttcagctag

SEQ ID NO: 12000 - DNA, 345 bp, Artificial Sequence
  Description of Artificial Sequence: Synthetic coding sequence
atgcagttcggcgagctgctggccgccgtgagaaaggcccaggccaacgtgatgctgttcctggaggagaaggagcaggccgccctgagccaggccaacggcatcaaggcccacctggagtacagaagcgccgagatggagaagagcaagcaggagctggagaccatggccgccatcagcaacaccgtgcagttcctggagagaagcatgaccagcgagctgaagtgcctgcccctgttcagcgccaacatcggcctgcccaacctgagccccgcccccggcaacagcagcagcaacatgtgcatgaccagcagaagcaccagaacccagcacaccagcatctag

SEQ ID NO: 12001 - DNA, 579 bp, Artificial Sequence; identical to SEQ ID NO: 9780
  Description of Artificial Sequence: Synthetic coding sequence

SEQ ID NO: 12002 - DNA, 888 bp, Artificial Sequence
  Description of Artificial Sequence: Synthetic coding sequence
atgaagcagtacggcctgggccccaacggcggcatcgtgaccagcctgaacctgttcgccaccagattcgaccaggtgatgaagttcatcgagaaggcccagaacatgagcaagtacgtgctgatcgacacccccggccagatcgaggtgttcacctggagcgccagcggcaccatcatcaccgaggccctggccagcagcttccccaccgtggtgatctacgtgatggacaccagcagaagcaccaaccccgtgaccttcatgagcaacatgctgtacgcctgcagcatcctgtacaagaccaagctgcccttcatcgtggtgatgaacaagaccgacatcatcgaccacagcttcgccgtggagtggatgcaggacttcgaggccttccaggacgccctgaaccaggagaccacctacgtgagcaacctgaccagaagcatgagcctggtgctggacgagttctacagcagcctgagagtggtgggcgtgagcgccgtgctgggcaccggcctggacgagctgttcgtgcaggtgaccagcgccgccgaggagtacgagagagagtacagacccgagtacgagagactgaagaagagcctggccaacgccgagagccagcagcagagagagcagctggagagactgagaaaggacatgggcagcgtggccctggacgccggcaccgccaaggacagcctgagccccgtgctgcaccccagcgacctgatcctgaccagaggcaccctggacgaggaggacgaggaggccgacagcgacaccgacgacatcgaccacagagtgaccgaggagagccacgaggagcccgccttccagaacttcatgcaggagagcatggcccagtactggaagagaaacaacaagtag

SEQ ID NO: 12003 - DNA, 1212 bp, Artificial Sequence
  Description of Artificial Sequence: Synthetic coding sequence
atgcccagcgccgaggccaagctgaagaagaacagatgcgccaactgcttcgactgccccggctgcatgcacaccctgagcaccagagccaccagcatcagcacccagctgcccgacgaccccgccaagaccaccatgaagaaggcctactacctggcctgcggcttctgcagatggaccagcagagacgtgggcatggccgacaagagcgtggccagcggcggctggcaggagcccgagaacccccacacccagagaatgaacaagctgatcgagtactaccagcagctggcccagaaggagaaggtggagagagacagaaagaagctggccagaagaagaaactacatgcccctggccttcagcgacaagtacggcctgggcaccagactgcagagacccagagccggcgccagcatcagcaccctggccggcctgagcctgaaggagggcgaggaccagaaggagatcaagatcgagcccgcccaggccgtggacgaggtggagcccctgcccgaggactactacaccagacccgtgaacctgaccgaggtgaccaccctgcagcagagactgctgcagcccgacttccagcccgtgtgcgccagccagctgtaccccagacacaagcacctgctgatcaagagaagcctgagatgcagaaagtgcgagcacaacctgagcaagcccgagttcaaccccaccagcatcaagttcaagatccagctggtggccgtgaactacatccccgaggtgagaatcatgagcatccccaacctgagatacatgaaggagagccaggtgctgctgaccctgaccaaccccgtggagaacctgacccacgtgaccctgttcgagtgcgaggagggcgaccccgacgacatcaacagcaccgccaaggtggtggtgccccccaaggagctggtgctggccggcaaggacgccgccgccgagtacgacgagctggccgagccccaggacttccaggacgaccccgacatcatcgccttcagaaaggccaacaaggtgggcatcttcatcaaggtgaccccccagagagaggagggcgaggtgaccgtgtgcttcaagatgaagcacgacttcaagaacctggccgcccccatcagacccatcgaggagagcgaccagggcaccgaggtgatctggctgacccagcacgtggagctgagcctgggccccctgctgccctag

SEQ ID NO: 12004 - DNA, 1674 bp, Artificial Sequence; identical to SEQ ID NO: 10192
  Description of Artificial Sequence: Synthetic coding sequence

SEQ ID NO: 12005 - DNA, 462 bp, Artificial Sequence
  Description of Artificial Sequence: Synthetic coding sequence
atggccgagcaggagcagagaaagatccccctggtgcccgagaacctgctgaagaagagaaaggcctaccaggccctgaaggccacccaggccaagcaggccctgctggccaagaaggagcagaagaagggcaagggcctgagattcaagagactggagagcttcctgcacgacagctggagacagaagagagacaaggtgagactgagaagactggaggtgaagccccacgccctggagctgcccgacaagcacagcctggccttcgtggtgagaatcgagagaatcgacggcgtgagcctgctggtgcagagaaccatcgccagactgagactgaagaagatcttcagcggcgtgttcgtgaaggtgaccccccagaacctgaagatgctgagaatcgtggagccctacgtgacctggggcgaggtgtggagacacctgctgggcagaccccacagctag

SEQ ID NO: 12006 - DNA, 2070 bp, Artificial Sequence
  Description of Artificial Sequence: Synthetic coding sequence
atgatcgacagcgtgaagctgagaagagacagcgccgccgacttcttcagccactacgagtacctgtgcgccctgcagaacagcgtgcccctgcccgccgtgagagcctgcctgagagagggcgtgctggacttcaacgccgacagactgagaggcgtggactgggcccccctgctgagcaccctgaagatcaacaaggacctgcccctggtgagcatcaagagcttcttccagccctggctgggcgacaccggcagcgacatgaacaagttctgcagaagcagagtgcccgccatcagatacaaggacgtgaccttccagctgtgcaaggccctgaagggctgcctgagcatcagcagcgtgctgaagaacctggagctgaacggcctgatcctgagagagagagacctgaccatcctggccaagggcctgaacaagagcgccagcctggtgcacctgagcctggccaactgccccatcggcgacggcggcctggagatcatctgccagggcatcaagagcagcatcaccctgaagaccgtgaacttcaccggctgcaacctgacctggcagggcgccgaccacatggccaagatcctgaagtaccagaccatgagaagacacgaggagacctgggccgagagcctgagatacagaagacccgacctggactgcatggccggcctgagaagaatcaccctgaactgcaacaccctgatcggcgacctgggcgcctgcgccttcgccgacagcctgagcgaggacctgtggctgagagccctggacctgcagcagtgcggcctgaccaacgagggcgccaaggccctgctggaggccctggagaccaacaccaccctggtggtgctggacatcagaaagaaccccctgatcgaccacagcatgatgaaggccgtgatcaagaaggtgctgcagaacggcagaagcgccaagagcgagtaccagtggatcaccagccccagcgtgaaggagcccagcaagaccgccaagcagaagagaagaaccatcatcctgggcagcggccacaagggcaaggccaccatcagaatcggcctggccaccaagaagcccgtgagcagcggcagaaagcacagcctgggcaaggagtactacgcccccgcccccctgccccccggcgtgagcggcttcctgccctggagaaccgccgagagagccaagagacacagaggcttccccctgatcaagaccagagacatctgcaaccagctgcagcagcccggcttccccgtgaccgtgaccgtggagagccccagcagcagcgaggtggaggaggtggacgacagcagcgagagcgtgcacgaggtgcccgagaagaccagcatcgagcaggaggccctgcaggagaagctggaggagtgcctgaagcagctgaaggaggagagagtgatcagactgaaggtggacaagagagtgagcgagctggagcacgagaacgcccagctgagaaacatcaacttcagcctgagcgaggccctgcacgcccagagcctgaccaacatgatcctggacgacgagggcgtgctgggcagcatcgagaacagcttccagaagttccacgccttcctggacctgctgaaggacgccggcctgggccagctggccaccatggccggcatcgaccagagcgacttccagctgctgggccacccccagatgaccagcaccgtgagcaacccccccaaggaggagaagaaggccctggaggacgagaagcccgagcccaagcagaacgccctgggccagatgcagaacatccagttccagaagatcaccggcgacgccagaatccccctgcccctggacagcttccccgtgcccgtgagcacccccgagggcctgggcaccagcagcaacaacctgggcgtgcccgccaccgagcagagacaggagagcttcgagggcttcatcgccagaatgtgcagccccagccccgacgccaccagcggcaccggcagccagagaaaggaggaggagctgagcagaaacagcagaagcagcagcgagaagaagaccaagaccgagagccactag

SEQ ID NO: 12007 - DNA, 915 bp, Artificial Sequence
  Description of Artificial Sequence: Synthetic coding sequence
atgaacttcagcgaggtgttcaagctgagcagcctgctgtgcaagttcagccccgacggcaagtacctggccagctgcgtgcagtacagactggtggtgagagacgtgaacaccctgcagatcctgcagctgtacacctgcctggaccagatccagcacatcgagtggagcgccgacagcctgttcatcctgtgcgccatgtacaagagaggcctggtgcaggtgtggagcctggagcagcccgagtggcactgcaagatcgacgagggcagcgccggcctggtggccagctgctggagccccgacggcagacacatcctgaacaccaccgagttccacctgagaatcaccgtgtggagcctgtgcaccaagagcgtgagctacatcaagtaccccaaggcctgcctgcagggcatcaccttcaccagagacggcagatacatggccctggccgagagaagagactgcaaggactacgtgagcatcttcgtgtgcagcgactggcagctgctgagacacttcgacaccgacacccaggacctgaccggcatcgagtgggcccccaacggctgcgtgctggccgtgtgggacacctgcctggaggtgagaatcctgaaccacgtgacctggaagatgatcaccgagttcggccaccccgccgccatcaacgaccccaagatcgtggtgtacaaggaggccgagaagagcccccagctgggcctgggctgcctgagcttccccccccccagagccggcgccggccccctgcccagcagcgagagcaagtacgagatcgccagcgtgcccgtgagcctgcagaccctgaagcccgtgaccgacagagccaaccccaagatcggcatcggcatgctggccttcagccccgacagctacttcctggccaccagaaactag

SEQ ID NO: 12008 - DNA, 483 bp, Artificial Sequence
  Description of Artificial Sequence: Synthetic coding sequence
atgaaggaggtgggcagacccagagaggtgagaggcagacccggcaagagcagaatccagaaggagctggccgacatcaccctggaccccccccccaactgcagcgccggccccaagggcgacaacatctacgagtggagaagcaccatcctgggcccccccggcagcgtgtacgagggcggcgtgttcttcctggacatcaccttcacccccgagtaccccttcaagccccccaaggtgaccttcagaaccagaatctaccactgcaacatcaacagccagggcgtgatctgcctggacatcctgaaggacaactggagccccgccctgaccatcagcaaggtgctgctgagcatctgcagcctgctgaccgactgcaaccccgccgaccccctggtgggcagcatcgccacccagtacatgaccaacagagccgagcacgacagaatggccagacagtggaccaagagatacgccacctag

SEQ ID NO: 12009 - DNA, 516 bp, Artificial Sequence
  Description of Artificial Sequence: Synthetic coding sequence
atgagcagcggcaacgccaagatcggccaccccgcccccaacttcaaggccaccgccgtgatgcccgacggccagttcaaggacatcagcctgagcgactacaagggcaagtacgtggtgttcttcttctaccccctggacttcaccttcgtgtgccccaccgagatcatcgccttcagcgacagagccgaggagttcaagaagctgaactgccaggtgatcggcgccagcgtggacagccacttctgccacctggcctgggtgaacacccccaagaagcagggcggcctgggccccatgaacatccccctggtgagcgaccccaagagaaccatcgcccaggactacggcgtgctgaaggccgacgagggcatcagcttcagaggcctgttcatcatcgacgacaagggcatcctgagacagatcaccgtgaacgacctgcccgtgggcagaagcgtggacgagaccctgagactggtgcaggccttccagttcaccgacaagcacggcgagtag

SEQ ID NO: 12010 - DNA, 603 bp, Artificial Sequence
  Description of Artificial Sequence: Synthetic coding sequence
gtgctgatcttcgcctgcctggtgcccggcttccccgccgtgatgagcagcagaggcccctgcaccctggagaccctgatcaaccccagccccagcgtggccgacgtgaagatctaccccgaggagatcacccccctgctgcccgccatcagcggcgagaagatcgccgaggaccagacctgcttcttcctgcagatcctgctgaagtacatggtgatccaggccgccagcctggagtggaagaacaaggagaaccaggacaccggcttcaagttcctgttcaccctgttcagaaagtactacctgccccacctgttccccagcttcaccaagctgaccaacatctacaagcccgtgctggacatcccccacctgagacccaagcccgtgtacatcaccaccaccagagacaacgagaacatctacagcaccaagatcccctacatggccgccagagtggtgttcatcaagtggatcgtgaccttcttcctggagaagaagtacctgaccgccacccagaacaccaagaacggcgtggacgtgctgcccaagatcatccaggtgtgccaccccagcagcttctacctgctgatgctggtgtag

SEQ ID NO: 12011 - DNA, 576 bp, Artificial Sequence
  Description of Artificial Sequence: Synthetic coding sequence
atgagcagcaccctgggcaagctgagcaaccaggtggaggagaccctgcccctgctgaagaagcccctgaagagagccatcaccaccctgatggccggcatcctgagactggtggtgcagtggccccccggcagactgcagaccgtgaccaagggcgtggagagcctgatctgcaccgactggatcagacacaagttcaccagaagcagaatccccgagaaggtgttccaggccagccccgaggaccacgagaagtacggcggcgacccccagaacccccacaagctgcacatcgtgaccagaatcaagagcaccagaagaagaccctactgggagaaggacatcatcaagatgctgggcctggagaaggcccacaccccccaggtgcacaagaacatccccagcgtgaacgccaagctgaaggtggtgaagcacctgatcagaatcaagcccctgaagctgccccagggcctgcccgccgaggagaacatgagcaacacctgcctgaagagcaccggcgagctggtggtgcagtggcacctgaagcccgtggagcagaaggcccacgagagctag

SEQ ID NO: 12012 - DNA, 483 bp, Artificial Sequence; identical to SEQ ID NO: 10977
  Description of Artificial Sequence: Synthetic coding sequence

SEQ ID NO: 12013 - DNA, 321 bp, Artificial Sequence
  Description of Artificial Sequence: Synthetic coding sequence
accttcctggagcagagcaagaccagattcaacaagaactacaagggcatgagcctgagcaagatcaccaccaccgtgggcctgaacatcggcaccgtggacgtgggcaaggccagactgatgttctgggacctgggcggccaggaggagctgcagagcctgtgggacaaggacaagaccaagtgcggcgacctgggcaccctgcacagcagcaaggtgagcgccagcttcagactgagagacctggccgccgaccaccacagaacccagaagtggcagagacccgacgtgggcaccgccggctggctgcccctgccctag

SEQ ID NO: 12014 - DNA, 1524 bp, Artificial Sequence
  Description of Artificial Sequence: Synthetic coding sequence
atggccgagctgcagatgctgctggaggaggagatccccggcggcagaagagccctgttcgacagctacaccaacctggagagagtggccgactactgcgagaacaactacatccagagcgccgacaagcagagagccctggaggagaccaaggcctacaccacccagagcctggccagcgtggcctacctgatcaacaccctggccaacaacgtgctgcagatgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacctggagagacccgtgagatacatcagaaagcccatcgactacaccatcctggacgacatcggccacggcgtgaaggtgagcacccagaacatgaagatgggcggcctgcccagaaccaccccccccacccagaagccccccagcccccccatgagcggcaagggcaccctgggcagacacagcccctacagaaccctggagcccgtgagaccccccgtggtgcccaacgactacgtgcccagccccaccagaaacatggcccccagccagcagagccccgtgagaaccgccagcgtgaaccagagaaacagaacctacagcagcagcggcagcagcggcggcagccaccccagcagcagaagcagcagcagagagaacagcggcagcggcagcgtgggcgtgcccatcgccgtgcccacccccagcccccccagcgtgttccccgcccccgccggcagcgccggcaccccccccctgcccgccaccagcgccagcgcccccgcccccctggtgcccgccaccgtgcccagcagcaccgcccccgacgccgccgccggcggcgcccagaccctggccgacggcttcaccagccccaccccccccgtggtgagcagcaccccccccaccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgacggctggtacgagggcgtgatgaacggcgtgaccggcctgttccccggcaactacgtggagagcatcatgcactacagcgagtag

SEQ ID NO: 12015 - DNA, 303 bp, Artificial Sequence
  Description of Artificial Sequence: Synthetic coding sequence
atggccagcgccggcacccagcactacagcatcggcctgagacagaagaacagcttcaagcagagcggccccagcggcaccgtgcccgccaccccccccgagaagcccagcgagggcagagtgtggccccaggcccaccagcaggtgaagcccatctggaagctggagaagaagcaggtggagaccctgagcgccggcctgggccccggcctgctgggcgtgcccccccagcccgcctacttcttctgccccagcaccctgtgcagcagcggcaccaccgccgtgatcgccggccacagctag

SEQ ID NO: 12016 - DNA, 1212 bp, Artificial Sequence
  Description of Artificial Sequence: Synthetic coding sequence
atggccagcgccctgagaccccccagagtgcccaagcccaagggcgtgctgcccagccactactacgagagcttcctggagaagaagggcccctgcgacagagactacaagaagttctgggccggcctgcagggcctgaccatctacttctacaacagcaacagagacttccagcacgtggagaagctgaacctgggcgccttcgagaagctgaccgacgagatcccctggggcagcagcagagaccccggcacccacttcagcctgatcctgagagaccaggagatcaagttcaaggtggagaccctggagtgcagagagatgtggaagggcttcatcctgaccgtggtggagctgagagtgcccaccgacctgaccctgctgcccggccacctgtacatgatgagcgaggtgctggccaaggaggaggccagaagagccctggagacccccagctgcttcctgaaggtgagcagactggaggcccagctgctgctggagagataccccgagtgcggcaacctgctgctgagacccagcggcgacggcgccgacggcgtgagcgtgaccaccagacagatgcacaacggcacccacgtggtgagacactacaaggtgaagagagagggccccaagtacgtgatcgacgtggagcagcccttcagctgcaccagcctggacgccgtggtgaactacttcgtgagccacaccaagaaggccctggtgcccttcctgctggacgaggactacgagaaggtgctgggctacgtggaggccgacaaggagaacggcgagaacgtgtgggtggcccccagcgcccccggccccggccccgccccctgcaccggcggccccaagcccctgagccccgccagcagccaggacaagctgccccccctgccccccctgcccaaccaggaggagaactacgtgacccccatcggcgacggccccgccgtggactacgagaaccaggacgtggccagcagcagctggcccgtgatcctgaagcccaagaagctgcccaagccccccgccaagctgcccaagccccccgtgggccccaagcccgagcccaaggtgttcaacggcggcctgggcagaaagctgcccgtgagcagcgcccagcccctgttccccaccgccggcctggccgacatgaccgccgagctgcagaagaagctggagaagagaagagccctggagcactag

SEQ ID NO: 12017 - DNA, 1551 bp, Artificial Sequence
  Description of Artificial Sequence: Synthetic coding sequence
atgctgagaagaggcagccaggccctgagaagattcagcaccggcagagtgtacttcaagaacaagctgaagctggccctgatcggccagagcctgttcggccaggaggtgtacagccacctgagaaaggagggccacagagtggtgggcgtgttcaccgtgcccgacaaggacggcaaggccgaccccctggccctggccgccgagaaggacggcacccccgtgttcaagctgcccaagtggagagtgaagggcaagaccatcaaggaggtggccgaggcctacagaagcgtgggcgccgagctgaacgtgctgcccttctgcacccagttcatccccatggacatcatcgacagccccaagcacggcagcatcatctaccaccccagcatcctgcccagacacagaggcgccagcgccatcaactggaccctgatcatgggcgacaagaaggccggcttcagcgtgttctgggccgacgacggcctggacaccggccccatcctgctgcagagaagctgcgacgtggagcccaacgacaccgtggacgccctgtacaacagattcctgttccccgagggcatcaaggccatggtggaggccgtgcagctgatcgccgacggcaaggcccccagaatcccccagcccgaggagggcgccacctacgagggcatccagaagaaggagaacgccgagatcagctgggaccagagcgccgaggtgctgcacaactggatcagaggccacgacaaggtgcccggcgcctggaccgagatcaacggccagatggtgaccttctacggcagcaccctgctgaacagcagcgtgccccccggcgagcccctggagatcaagggcgccaagaagcccggcctggtgaccaagaacggcctggtgctgttcggcaacgacggcaaggccctgaccgtgagaaacctgcagttcgaggacggcaagatgatccccgccagccagtacttcagcaccggcgagaccagcgtggtggagctgaccgccgaggaggtgaaggtggccgagaccatcaaggtgatctgggccggcatcctgagcaacgtgcccatcatcgaggacagcaccgacttcttcaagagcggcgccagcagcatggacgtggccagactggtggaggagatcagacagaagtgcggcggcctgcagctgcagaacgaggacgtgtacatggccaccaagttcgagggcttcatccagaaggtggtgagaaagctgagaggcgaggaccaggaggtggagctggtggtggactacatcagcaaggaggtgaacgagatcatggtgaagatgccctaccagtgcttcatcaacggccagttcaccgacgccgacgacggcaagacctacgacaccatcaaccccaccgacggcagcaccatctgcaaggtgagctacgccagcctggccgacgtggacaaggccgtggccgccgccaaggacgccttcgagaacggcgagtggggcagaatgaacgccagagagagaggcagactgatgtacagcatgagaatgaactag

SEQ ID NO: 12018 - DNA, 1581 bp, Artificial Sequence
  Description of Artificial Sequence: Synthetic coding sequence
atggaggagatccccgcccaggaggccgccggcagccccagagtgcagttccagagcctggagacccagagcgagtgcctgagccccgagccccagttcgtgcaggacaccgacatggagcagggcctgaccggcggcttccccatcagcaagcccgacggcatcagccagctggagcaggacctgcaggtgttcgacctggagaccaagaccagagaggtgctgagagacgactgcagcgacggcgagaccagagaggagaacaagctgctgatccccaagcagaagatcagcgaggaggtgcacagctacaaggtgagagtgggcagactgaagcacgacatcacccaggtgcccgagaccagagaggtgtacaagagcgaggacagactggagagactgcaggagatcctgagaaagttcctgtacctggagagagagttcagacagatcaccatcagcaaggagaccttcaccagcgagaagaacaacgagtgccacgagcccgagaagagcttcagcctggacagcaccatcgacgccgaccagagagtgctgagaatccagaacaccgacgacaacgacaagtacgacatgagcttcaaccagaacagcgccagcggcaagcacgagcacctgaacctgaccgaggacttccagagcagcgagtgcaaggagagcctgatggacctgagccacctgaacaagtgggagagcatccccaacaccgagaagagctacaagtgcgacgtgtgcggcaagatcttccaccagagcagcgccctgaccagacaccagagaatccacaccagagagaagccctacaagtgcaaggagtgcgagaagagcttcagccagagcagcagcctgagcagacacaagagaatccacaccagagagaagccctacaagtgcgaggccagcgacaagagctgcgaggccagcgacaagagctgcagccccagcagcggcatcatccagcacaagaagatccacaccagagccaagagctacaagtgcagcagctgcgagagagtgttcagcagaagcgtgcacctgacccagcaccagaagatccacaaggagatgccctgcaagtgcaccgtgtgcggcagcgacttctgccacaccagctacctgctggagcaccagagagtgcaccacgaggagaaggcctacgagtacgacgagtacggcctggcctacatcaagcagcagggcatccacttcagagagaagccctacacctgcagcgagtgcggcaaggacttcagactgaacagccacctgatccagcaccagagaatccacaccggcgagaaggcccacgagtgcaacgagtgcggcaaggccttcagccagaccagctgcctgatccagcaccacaagatgcacagaaaggagaagagctacgagtgcaacgagtacgagggcagcttcagccacagcagcgacctgatcctgcagcaggaggtgctgaccagacagaaggccttcgactgcgacgtgtgggagaagaacagcagccagagagcccacctggtgcagcaccagagcatccacaccaaggagaacagctag

SEQ ID NO: 12019 - DNA, 603 bp, Artificial Sequence; identical to SEQ ID NO: 12010
  Description of Artificial Sequence: Synthetic coding sequence

SEQ ID NO: 12020 - DNA, 540 bp, Artificial Sequence
  Description of Artificial Sequence: Synthetic coding sequence
aacatcaagcccggcgagggcctgggcatgtacatcaagagcacctacgacggcctgcacgtgatcaccggcaccaccgagaacgtgggctggcagctgaagaacctggtgaagaagctgagagagaaccccaccggcgtggtgctgctgctgaagaagagacccaccggcagcttcaacttcacccccgcccccctgaagaacctgagatggaagccccccctggtgcagaccagccccccccccgccaccacccagagccccgagagcaccatggacaccagcctgaagaaggagaagagcgccatcctggacctgtacatcccccccccccccgccgtgccctacagccccagagacgagaacggcagcttcgtgtacggcggcagcagcaagtgcaagcagcccctgcccggccccaagggcagcgagagccccaacagcttcctggaccaggagagcagaagaagaagattcaccatcgccgacagcgaccagctgcccggctacagcgtggagaccaacatcctgcccacctag

SEQ ID NO: 12021 - DNA, 1368 bp, Artificial Sequence
  Description of Artificial Sequence: Synthetic coding sequence
atgatgggcgcccccaacctgatcgccgacagcatggagtacggcctgagctacagcgtgatcagctacctgaagaagctgagccagcaggccaagatcgagagcgacagagtgatcggcagcgtgggcaagaaggtggtgcaggagaccggcatcaaggtgagaagcagaagccacggcctgagcatggcctacagaaaggacttccagcagctgctgcagggcatcagcgaggacgtgccccacagactgctggacctgaacatgaaggagtacaccggcttccaggtggccctgctgaacaaggacctgaagccccagaccttcagaaacgcctacgacatccccagaagaaacctgctggaccacctgaccagaatgagaagcaacctgctgaagagcaccagaagattcctgaagggccaggacgaggaccaggtgcacagcgtgcccatcgcccagatgggcaactaccaggagtacctgaagcaggtgcccagccccctgagagagctggaccccgaccagcccagaagactgcacaccttcggcaaccccttcaagctggacaagaagggcatgatgatcgacgaggccgacgagttcgtggccggcccccagaacaagcacaagagacccggcgagcccaacatgcagggcatccccaagagaagaagatgcatgagccccctgctgagaggcagacagcagaaccccgtggtgaacaaccacatcggcggcaagggcccccccgcccccaccacccaggcccagcccgacctgatcaagcccctgcccctgcacaagatcagcgagaccaccaacgacagcatcatccacgacgtggtggagaaccacgtggccgaccagctgagcagcgacatcacccccaacgccatggacaccgagttcagcgccagcagccccgccagcctgctggagagacccaccaaccacatggaggccctgggccacgaccacctgggcaccaacgacctgaccgtgggcggcttcctggagaaccacgaggagcccagagacaaggagcagtgcgccgaggagaacatccccgccagcagcctgaacaagggcaagaagctgatgcactgcagaagccacgaggaggtgaacaccgagctgaaggcccagatcatgaaggagatcagaaagcccggcagaaagtacgagagaatcttcaccctgctgaagcacgtgcagggcagcctgcagaccagactgatcttcctgcagaacgtgatcaaggaggccagcagattcaagaagagaatgctgatcgagcagctggagaacttcctggacgagatccacagaagagccaaccagatcaaccacatcaacagcaactag

SEQ ID NO: 12022 - DNA, 1467 bp, Artificial Sequence
  Description of Artificial Sequence: Synthetic coding sequence
ctggactgcggccccagactgcccgtggaggtgggccccagcctgagcagccccagcagcggctgcggcgagggcagcatcagcgtgggcgagaacgtgagcgacgtggcccccacccagccctggtggcccaacacccccggcgacagcgtgagcgaggagctgggccccggcagaagcggcgacaccgaggacctgagccccaactggcccctgaacagccaggaggacaccgccgcccagagcagccccggcagaggcgaggaggccgaggccagcgccgccgaggcccagggcggcgagcaggcctacctggccggcctggccggccagtaccacctggagagataccccgacagctacgagagcatgagcgagccccccatcgcccacctgctgagacccgtgctgcccagagccttcgccttccccgtggacccccaggtgcagagcgccgccgacgagaccgccgtgcagctgagcgagctgctgaccctgcccgtgctgatgaagagaagcatcaccgcccccctggccgcccacatcagcctggtgaacaaggccgccgtggactacttcttcgtggagctgcacctggaggcccactacgaggccctgagacacttcctgctgatggaggacggcgagttcgcccagagcctgagcgacctgctgttcgagaagctgggcgccggccagacccccggcgagctgctgaaccccctggtgctgaacagcgtgctgagcaaggccctgcagtgcagcctgcacggcgacaccccccacgccagcaacctgagcctggccctgaagtacctgcccgaggtgttcgcccccaacgcccccgacgtgctgagctgcctggagctgagatacaaggtggactggcccctgaacatcgtgatcaccgagggctgcgtgagcaagtacagcggcgtgttcagcttcctgctgcagctgaagctgatgatgtgggccctgaaggacgtgtgcttccacctgaagagaaccgtgcccagcgccgccgccgtgcaggccagagacgccgccttcagagagggccaccccggcctgcacagacagcccgaccccgccagacacctggtgagagtgcagggccaggtgggccacagaggcagacccggcggcgaccccgcctgcgccagaagagtgcccgcccagggcagactgcaggccgcccccgtgatgaacgtgatccacagcatcttcagcctggtgctgaagttcagaagccagctgatcagccaggcctggggcccccccggcggccccagaggcgccgagcaccccaacttcgccctgatgcagcagagctacaacaccttcaagtactacagccacttcctgttcaaggtggtgaccaagctggtgaacagaggctaccagccccacctggaggacttcctgctgagaatcaacttcaacaactactaccaggacgcctag

SEQ ID NO: 12023 - DNA, 3819 bp, Artificial Sequence
  Description of Artificial Sequence: Synthetic coding sequence
atggccaacgacagccccgccaagagcctggtggacatcgacctgagcagcctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagctggagatcaacatgctgaagaagtacagccaccacagaaacatcgccacctactacggcgccttcatcaagaagagcccccccggccacgacgaccagctgtggctggtgatggagttctgcggcgccggcagcatcaccgacctggtgaagaacaccaagggcaacaccctgaaggaggactggatcgcctacatcagcagagagatcctgagaggcctggcccacctgcacatccaccacgtgatccacagagacatcaagggccagaacgtgctgctgaccgagaacgccgaggtgaagctggtggacttcggcgtgagcgcccagctggacagaaccgtgggcagaagaaacaccttcatcggcaccccctactggatggcccccgaggtgatcgcctgcgacgagaaccccgacgccacctacgactacagaagcgacctgtggagctgcggcatcaccgccatcgagatggccgagggcgccccccccctgtgcgacatgcaccccatgagagccctgttcctgatccccagaaaccccccccccagactgaagagcaagaagtggagcaagaagttcttcagcttcatcgagggctgcctggtgaagaactacatgcagagacccagcaccgagcagctgctgaagcaccccttcatcagagaccagcccaacgagagacaggtgagaatccagctgaaggaccacatcgacagaaccagaaagaagagaggcgagaaggacgagaccgagtacgagtacagcggcagcgaggaggaggaggaggaggtgcccgagcaggagggcgagcccagcagcatcgtgaacgtgcccggcgagagcaccctgagaagagacttcctgagactgcagcaggagaacaaggagagaagcgaggccctgagaagacagcagctgctgcaggagcagcagctgagagagcaggaggagtacaagagacagctgctggccgagagacagaagagaatcgagcagcagaaggagcagagaagaagactggaggagcagcagagaagagagagagaggccagaagacagcaggagagagagcagagaagaagagagcaggaggagaagagaagactggaggagctggagagaagaagaaaggaggaggaggagagaagaagagccgaggaggagaagagaagagtggagagagagcaggagtacatcagaagacagctggaggaggagcagagacacctggaggtgctgcagcagcagctgctgcaggagcaggccatgctgctgcacgaccacagaagaccccacccccagcacagccagcagcccccccccccccagcaggagagaagcaagcccagcttccacgcccccgagcccaaggcccactacgagcccgccgacagagccagagaggtggaggacagattcagaaagaccaaccacagcagccccgaggcccagagcaagcagaccggcagagtgctggagccccccgtgcccagcagaagcgagagcttcagcaacggcaacagcgagagcgtgcaccccgccctgcagagacccgccgagccccaggtgcccgtgagaaccaccagcagaagccccgtgctgagcagaagagacagccccctgcagggcagcggccagcagaacagccaggccggccagagaaacagcaccagcatcgagcccagactgctgtgggagagagtggagaagctggtgcccagacccggcagcggcagcagcagcggcagcagcaacagcggcagccagcccggcagccaccccggcagccagagcggcagcggcgagagattcagagtgagaagcagcagcaagagcgagggcagccccagccagagactggagaacgccgtgaagaagcccgaggacaagaaggaggtgttcagacccctgaagcccgccgacctgaccgccctggccaaggagctgagagccgtggaggacgtgagacccccccacaaggtgaccgactacagcagcagcagcgaggagagcggcaccaccgacgaggaggacgacgacgtggagcaggagggcgccgacgagagcaccagcggccccgaggacaccagagccgccagcagcctgaacctgagcaacggcgagaccgagagcgtgaagaccatgatcgtgcacgacgacgtggagagcgagcccgccatgacccccagcaaggagggcaccctgatcgtgagacagagcaccgtggaccagaagagagccagccaccacgagagcaacggcttcgccggcagaatccacctgctgcccgacctgctgcagcagagccacagcagcagcaccagcagcaccagcagcagccccagcagcagccagcccacccccaccatgagcccccagaccccccaggacaagctgaccgccaacgagacccagagcgccagcagcaccctgcagaagcacaagagcagcagcagcttcacccccttcatcgaccccagactgctgcagatcagccccagcagcggcaccaccgtgaccagcgtggtgggcttcagctgcgacggcatgagacccgaggccatcagacaggaccccaccagaaagggcagcgtggtgaacgtgaaccccaccaacaccagaccccagagcgacacccccgagatcagaaagtacaagaagagattcaacagcgagatcctgtgcgccgccctgtggggcgtgaacctgctggtgggcaccgagagcggcctgatgctgctggacagaagcggccagggcaaggtgtaccccctgatcaacagaagaagattccagcagatggacgtgctggagggcctgaacgtgctggtgaccatcagcggcaagaaggacaagctgagagtgtactacctgagctggctgagaaacaagatcctgcacaacgaccccgaggtggagaagaagcagggctggaccaccgtgggcgacctggagggctgcgtgcactacaaggtggtgaagtacgagagaatcaagttcctggtgatcgccctgaagagcagcgtggaggtgtacgcctgggcccccaagccctaccacaagttcatggccttcaagagcttcggcgagctggtgcacaagcccctgctggtggacctgaccgtggaggagggccagagactgaaggtgatctacggcagctgcgccggcttccacgccgtggacgtggacagcggcagcgtgtacgacatctacctgcccacccacatccagtgcagcatcaagccccacgccatcatcatcctgcccaacaccgacggcatggagctgctggtgtgctacgaggacgagggcgtgtacgtgaacacctacggcagaatcaccaaggacgtggtgctgcagtggggcgagatgcccaccagcgtggcctacatcagaagcaaccagaccatgggctggggcgagaaggccatcgagatcagaagcgtggagaccggccacctggacggcgtgttcatgcacaagagagcccagagactgaagttcctgtgcgagagaaacgacaaggtgttcttcgccagcgtgagaagcggcggcagcagccaggtgtacttcatgaccctgggcagaaccagcctgctgagctggtag

SEQ ID NO: 12024 - DNA, 363 bp, Artificial Sequence
  Description of Artificial Sequence: Synthetic coding sequence
gccctgcagatcagcgagaacctgttcagcaacaaggtgctgaacgccctgaagcccgagaaggacgtggacggcgtgaccgacatcaacctgggcaagctggtgagaggcgacgcccacgagtgcttcgtgagccccgtggccaaggccgtgatcgagctgctggagaagagcgtgggcgtgaacctggacggcaagaagatcctggtggtgggcgcccacggcagcctggaggccgccctgcagtgcctgttccagagaaagggcagcatgaccatgagcatccagtggaagaccagacagctgcagagcaagaccgagagcagaagcgtgaccagactggagtgcagaagagtgatctag

SEQ ID NO: 12025 - DNA, 1866 bp, Artificial Sequence
  Description of Artificial Sequence: Synthetic coding sequence
atggtgagcatcctgagcagcttcgagagcagactgatgaagctggagaacagcatcatccccgtgcacaagcagaccgagaacctgcagagactgcaggagaacgtggagaagaccctgagctgcctggaccacgtgatcagctactaccacgtggccagcgacaccgagaagatcatcagagagggccccaccggcagactggaggagtacctgggcagcatggccaagatccagaaggccgtggagtacttccaggacaacagccccgacagccccgagctgaacaaggtgaagctgctgttcgagagaggcaaggaggccctggagagcgagttcagaagcctgatgaccagacacagcaaggtggtgagccccgtgctgatcctggacctgatcagcggcgacgacgacctggaggcccaggaggacgtgaccctggagcacctgcccgagagcgtgctgcaggacgtgatcagaatcagcagatggctggtggagtacggcagaaaccaggacttcatgaacgtgtactaccagatcagaagcagccagctggacagaagcatcaagggcctgaaggagcacttccacaagagcagcagcagcagcggcgtgccctacagccccgccatccccaacaagagaaaggacacccccaccaagaagcccgtgaagagacccggcaccatcagaaaggcccagaacctgctgaagcagtacagccagcacggcctggacggcaagaagggcggcagcaacctgatccccctggagggcagagacgacatgctggacgtggagaccgacgcctacatccactgcgtgagcgccttcgtgaagctggcccagagcgagtaccagctgctggccgacatcatccccgagcaccaccagaagaagaccttcgacagcctgatccaggacgccctggacggcctgatgctggagggcgagaacatcgtgagcgccgccagaaaggccatcgtgagacacgacttcagcaccgtgctgaccgtgttccccatcctgagacacctgaagcagaccaagcccgagttcgaccaggtgctgcagggcaccgccgccagcaccaagaacaagctgcccggcctgatcaccagcatggagaccatcggcgccaaggccctggaggacttcgccgacaacatcaagaacgaccccgacaaggagtacaacatgcccaaggacggcaccgtgcacgagctgaccagcaacgccatcctgttcctgcagcagctgctggacttccaggagaccgccggcgccatgctggccagccagggcaaggtgctgggcaacctgcagctgaacctgctgagcaagagcaaggtgtacgaggaccccgccctgagcgccatcttcctgcacaacaactacaactacatcctgaagagcctggagaagagcgagctgatccagctggtggccgtgacccagaagaccgccgagagaagctacagagagcacatcgagcagcagatccagacctaccagagaagctggctgaaggtgaccgactacatcgccgagaagaacctgcccgtgttccagcccggcgtgaagctgagagacaaggagagacagatcatcaaggagagattcaagggcttcaacgacggcctggaggagctgtgcaagatccagaaggcctgggccatccccgacaccgagcagagagacagaatcagacaggcccagaagaccatcgtgaaggagacctacggcgccttcctgcagaagttcggcagcgtgcccttcaccaagaaccccgagaagtacatcaagtacggcgtggagcaggtgggcgacatgatcgacagactgttcgacaccagcgcctag

SEQ ID NO: 12026 - DNA, 1344 bp, Artificial Sequence
  Description of Artificial Sequence: Synthetic coding sequence
atggacttcctgctgggcaaccccttcagcagccccgtgggccagagaatcgagaaggccaccgacggcagcctgcagagcgaggactgggccctgaacatggagatctgcgacatcatcaacgagaccgaggagggccccaaggacgccctgagagccgtgaagaagagaatcgtgggcaacaagaacttccacgaggtgatgctggccctgaccgtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggcatgaacctgggcagcagcagcgtgagagccggcctgcagagcctggaggccagcggcagactggaggacgagttcgacatgttcgccctgaccagaggcagcagcctggccgaccagagaaaggaggtgaagtacgaggccccccaggccaccgacggcctggccggcgccctggacgccagacagcagagcaccggcgccatccccgtgacccaggcctgcctgatggaggacatcgagcagtggctgagcaccgacgtgggcaacgacgccgaggagcccaagggcgtgaccagcgaggagttcgacaagttcctggaggagagagccaaggccgccgacagactgcccaacctgagcagccccagcgccgagggcccccccggcccccccagcggccccgcccccagaaagaagacccaggagaaggacgacgacatgctgttcgccctgtag

SEQ ID NO: 12027 - DNA, 2103 bp, Artificial Sequence
  Description of Artificial Sequence: Synthetic coding sequence
atggccaccatgatcccccccgtgaagctgaagtggctggagcacctgaacagcagctggatcaccgaggacagcgagagcatcgccaccagagagggcgtggccgtgctgtacagcaagctggtgagcaacaaggaggtggtgcccctgccccagcaggtgctgtgcctgaagggcccccagctgcccgacttcgagagagagagcctgagcagcgacgagcaggaccactacctggacgccctgctgagcagccagctggccctggccaagatggtgtgcagcgacagccccttcgccggcgccctgagaaagagactgctggtgctgcagagagtgttctacgccctgagcaacaagtaccacgacaagggcaaggtgaagcagcagcagcacagccccgagagcagcagcggcagcgccgacgtgcacagcgtgagcgagagacccagaagcagcaccgacgccctgatcgagatgggcgtgagaaccggcctgagcctgctgttcgccctgctgagacagagctggatgatgcccgtgagcggccccggcctgagcctgtgcaacgacgtgatccacaccgccatcgaggtggtgagcagcctgccccccctgagcctggccaacgagagcaagatcccccccatgggcctggactgcctgagccaggtgaccaccttcctgaagggcgtgaccatccccaacagcggcgccgacaccctgggcagaagactggccagcgagctgctgctgggcctggccgcccagagaggcagcctgagatacctgctggagtggatcgagatggccctgggcgccagcgccgtggtgcacaccatggagaagggcaagctgctgagcagccaggagggcatgatcagcttcgactgcttcatgaccatcctgatgcagatgagaagaagcctgatcagcgagaaccaggacagcgccgacgtggacccccaggagcacagcttcaccagaaccatcgacgaggaggccgagatggaggagcaggccgagagagacagagaggagggccaccccgagcccgaggacgaggaggaggagagagagcacgaggtgatgaccgccggcaagatcttccagtgcttcctgagcgccagagaggtggccagaagcagagacagagacagaatgaacagcggcgccggcagcggcgccagagccgacgacccccccccccagagccagcaggagagaagagtgagcaccgacctgcccgagggccaggacgtgtacaccgccgcctgcaacagcgtgatccacagatgcgccctgctgatcctgggcgtgagccccgtgatcgacgagctgcagaagagaagagaggagggccagctgcagcagcccagcaccagcgccagcgagggcggcggcctgatgaccagaagcgagagcctgaccgccgagagcagactggtgcacaccagccccaactacagactgatcaagagcagaagcgagagcgacctgagccagcccgagagcgacgaggagggctacgccctgagcggcagaagaaacgtggacctggacctggccgccagccacagaaagagaggccccatgcacagccagctggagagcctgagcgacagctgggccagactgaagcacagcagagactggctgtgcaacagcagctacagcttcgagagcgacttcgacctgaccaagagcctgggcgtgcacaccctgatcgagaacgtggtgagcttcgtgagcggcgacgtgggcaacgcccccggcttcaaggagcccgaggagagcatgagcaccagcccccaggccagcatcatcgccatggagcagcagcagctgagagccgagctgagactggaggccctgcaccagatcctggtgctgctgagcggcatggaggagaagggcagcatcagcctggccggcagcagactgagcagcggcttccagagcagcaccctgctgaccagcgtgagactgcagttcctggccggctgcttcggcctgggcaccgtgggccacaccggcggcaagggcgagagcggcagactgcaccactaccaggacggcatcagagccgccagaggctactag

SEQ ID NO: 12028 - DNA, 537 bp, Artificial Sequence
  Description of Artificial Sequence: Synthetic coding sequence
atggccgacagagccgccgccgagagagcctgcaaggaccccaaccccatcatcgacggcagaaaggccaacgtgaacctggcctacctgggcgccaagcccagaatcatgcagcccggcttcgccttcggcgtgcagcagctgcaccccgccctgatccagagacccttcggcatccccgcccactacgtgtacccccaggccttcgtgcagcccggcgtggtgatcccccacgtgcagcccaccgccgccgccgccagcaccaccccctacatcgactacaccggcgccgcctacgcccagtacagcgccgccgccgccgccgccgccgccgccgccgcctacgaccagtacccctacgccgccagccccgccgccgccggctacgtgaccgccggcggctacggctacgccgtgcagcagcccatcaccgccgccgcccccggcaccgccgccgccgccgccgccgccgccgccgccgccgccgccttcggccagtaccagccccagcagctgcagaccgacagaatgcagtag

SEQ ID NO: 12029 - DNA, 579 bp, Artificial Sequence; identical to SEQ ID NO: 11225
  Description of Artificial Sequence: Synthetic coding sequence

SEQ ID NO: 12030 - DNA, 555 bp, Artificial Sequence
  Description of Artificial Sequence: Synthetic coding sequence
atgaacagaagccagcccggcctgctgagaaccgaccccgtgcccgaggagggcgaggacgtggccgccaccatcagcgccaccgagaccctgagcgaggaggagcaggaggagctgagaagagagctggccaaggtggaggaggagatccagaccctgagccaggtgctggccgccaaggagaagcacctggccgagatcaagagaaagctgggcatcaacagcctgcaggagctgaagcagaacatcgccaagggctggcaggacgtgaccgccaccagcgcctacaagaagaccagcgagaccctgagccaggccggccagaaggccagcgccgccttcagcagcgtgggcagcgtgatcaccaagaagctggaggacgtgaagaacagccccaccttcaagagcttcgaggagaaggtggagaacctgaagagcaaggtgggcggcaccaagcccgccggcggcgacttcggcgaggtgctgaacagcgccgccaacgccagcgccaccaccaccgagcccctgcccgagaagacccaggagagcctgtag

SEQ ID NO: 12031 - DNA, 1620 bp, Artificial Sequence; identical to SEQ ID NO: 10018
  Description of Artificial Sequence: Synthetic coding sequence

SEQ ID NO: 12032 - DNA, 612 bp, Artificial Sequence
  Description of Artificial Sequence: Synthetic coding sequence
atggagccccccatggagcccagcggcggcgagcaggagcccggcgccgtgagattcctggacctgccctgggaggacgtgctgctgccccacgtgctgaacagagtgcccctgagacagctgctgagactgcagagagtgagcagagccttcagaagcctggtgcagctgcacctggccggcctgagaagattcgacgccgcccaggtgggcccccagatccccagagccgccctggccagactgctgagagacgccgagggcctgcaggagctggccctggccccctgccacgagtggctgagcgacgaggacctggtgcccgtgctggccagaaacccccagctgagaagcgtggccctgggcggctgcggccagctgagcagaagagccctgggcgccctggccgagggctgccccagactgcagagactgagcctggcccactgcgactgggtggacggcctggccctgagaggcctggccgacagatgccccgccctggaggagctggacctgaccgcctgcagacagctgaaggacgaggccatcgtgtacctggcccagagaagaggcgccggcctgagaagcctgagcctggccgtgaactag

SEQ ID NO: 12033 - DNA, 1824 bp, Artificial Sequence
  Description of Artificial Sequence: Synthetic coding sequence
atggccagaggcctgggcaaggccagcggcttccccgccggccccagcggcgccgagctgcccgccagcggcagaagaagaggccccctgatcagcctgttccccgccgtgctggccagcgaggccgccatgagctaccccgccgacgactacgagagcgaggccgcctacgacccctacgcctaccccagcgactacgacatgcacaccggcgaccccaagcaggacctggcctacgagagacagtacgagcagcagacctaccaggtgatccccgaggtgatcaagaacttcatccagtacttccacaagaccgtgagcgacctgatcgaccagaaggtgtacgagctgcaggccagcagagtgagcagcgacgtgatcgaccagaaggtgtacgagatccaggacatctacgagaacagctggaccaagctgaccgagagattcttcaagaacaccccctggcccgaggccgaggccatcgccccccaggtgggcaacgacgccgtgttcctgatcctgtacaaggagctgtactacagacacatctacgccaaggtgagcggcggccccagcctggagcagagattcgagagctactacaactactgcaacctgttcaactacatcctgaacgccgacggccccgcccccctggagctgcccaaccagtggctgtgggacatcatcgacgagttcatctaccagttccagagcttcagccagtacagatgcaagaccgccaagaagagcgaggaggagatcgacttcctgagaagcaaccccaagatctggaacgtgcacagcgtgctgaacgtgctgcacagcctggtggacaagagcaacatcaacagacagctggaggtgtacaccagcggcggcgaccccgagagcgtggccggcgagtacggcagacacagcctgtacaagatgctgggctacttcagcctggtgggcctgctgagactgcacagcctgctgggcgactactaccaggccatcaaggtgctggagaacatcgagctgaacaagaagagcatgtacagcagagtgcccgagtgccaggtgaccacctactactacgtgggcttcgcctacctgatgatgagaagataccaggacgccatcagagtgttcgccaacatcctgctgtacatccagagaaccaagagcatgttccagagaaccacctacaagtacgagatgatcaacaagcagaacgagcagatgcacgccctgctggccatcgccctgaccatgtaccccatgagaatcgacgagagcatccacctgcagctgagagagaagtacggcgacaagatgctgagaatgcagaagggcgacccccaggtgtacgaggagctgttcagctacagctgccccaagttcctgagccccgtggtgcccaactacgacaacgtgcaccccaactaccacaaggagcccttcctgcagcagctgaaggtgttcagcgacgaggtgcagcagcaggcccagctgagcaccatcagaagcttcctgaagctgtacaccaccatgcccgtggccaagctggccggcttcctggacctgaccgagcaggagttcagaatccagctgctggtgttcaagcacaagatgaagaacctggtgtggaccagcggcatcagcgccctggacggcgagttccagagcgccagcgaggtggacttctacatcgacaaggacatgatccacatcgccgacaccaaggtggccagaagatacggcgacttcttcatcagacagatccacaagttcgaggagctgaacagaaccctgaagaagatgggccagagaccctag

SEQ ID NO: 12034 - DNA, 1308 bp, Artificial Sequence
  Description of Artificial Sequence: Synthetic coding sequence
atggccgccagcagcctggagcagaagctgagcagactggaggccaagctgaagcaggagaacagagaggccagaagaagaatcgacctgaacctggacatcagcccccagagacccagacccatcatcgtgatcaccctgagccccgcccccgcccccagccagagagccgccctgcagctgcccctggccaacgacggcggcagcagaagccccagcagcgagagcagcccccagcaccccaccccccccgccagacccagacacatgctgggcctgcccagcaccctgttcacccccagaagcatggagagcatcgagatcgaccagaagctgcaggagatcatgaagcagaccggctacctgaccatcggcggccagagataccaggccgagatcaacgacctggagaacctgggcgagatgggcagcggcacctgcggccaggtgtggaagatgagattcagaaagaccggccacgtgatcgccgtgaagcagatgagaagaagcggcaacaaggaggagaacaagagaatcctgatggacctggacgtggtgctgaagagccacgactgcccctacatcgtgcagtgcttcggcaccttcatcaccaacaccgacgtgttcatcgccatggagctgatgggcacctgcgccgagaagctgaagaagagaatgcagggccccatccccgagagaatcctgggcaagatgaccgtggccatcgtgaaggccctgtactacctgaaggagaagcacggcgtgatccacagagacgtgaagcccagcaacatcctgctggacgagagaggccagatcaagctgtgcgacttcggcatcagcggcagactggtggacagcaaggccaagaccagaagcgccggctgcgccgcctacatggcccccgagagaatcgacccccccgaccccaccaagcccgactacgacatcagagccgacgtgtggagcctgggcatcagcctggtggagctggccaccggccagttcccctacaagaactgcaagaccgacttcgaggtgctgaccaaggtgctgcaggaggagccccccctgctgcccggccacatgggcttcagcggcgacttccagagcttcgtgaaggactgcctgaccaaggaccacagaaagagacccaagtacaacaagctgctggagcacagcttcatcaagagatacgagaccctggaggtggacgtggccagctggttcaaggacgtgatggccaagaccgagagccccagaaccagcggcgtgctgagccagccccacctgcccttcttcagatag

SEQ ID NO: 12035 - DNA, 3006 bp, Artificial Sequence
  Description of Artificial Sequence: Synthetic coding sequence
atggccagcagccccctgcccggccccaacgacatcctgctggccagccccagcagcgccttccagcccgacaccctgagccagcccagacccggccacgccaacctgaagcccaaccaggtgggccaggtgatcctgtacggcatccccatcgtgagcctggtgatcgacggccaggagagactgtgcctggcccagatcagcaacaccctgctgaagaacttcagctacaacgagatccacaacagaagagtggccctgggcatcacctgcgtgcagtgcacccccgtgcagctggagatcctgagaagagccggcgccatgcccatcagcagcagaagatgcggcatgatcaccaagagagaggccgagagactgtgcaagagcttcctgggcgagaacagaccccccaagctgcccgacaacttcgccttcgacgtgagccacgagtgcgcctggggctgcagaggcagcttcatccccgccagatacaacagcagcagagccaagtgcatcaagtgcagctactgcaacatgtacttcagccccaacaagttcatcttccacagccacagaacccccgacgccaagtacacccagcccgacgccgccaacttcaacagctggagaagacacctgaagctgaccgacaagagcccccaggacgagctggtgttcgcctgggaggacgtgaaggccatgttcaacggcggcagcagaaagagagccctgccccagcccggcgcccaccccgcctgccaccccctgagcagcgtgaaggccgccgccgtggccgccgccgccgccgtggccggcggcggcggcctgctgggcccccacctgctgggcgccccccccccccccccccccccccccccccccctggccgagctggccggcgccccccacgcccaccacaagagacccagattcgacgacgacgacgacagcctgcaggaggccgccgtggtggccgccgccagcctgagcgccgccgccgccagcctgagcgtggccgccgccagcggcggcgccggcaccggcggcggcggcgccggcggcggctgcgtggccggcgtgggcgtgggcgccggcgccggcgccggcgccggcgccggcgccaagggccccagaagctaccccgtgatccccgtgcccagcaagggcagcttcggcggcgtgctgcagaagttccccggctgcggcggcctgttcccccacccctacaccttccccgccgccgccgccgccttcagcctgtgccacaagaaggaggacgccggcgccgccgccgaggccctgggcggcgccggcgccggcggcgccggcgccgcccccaaggccggcctgagcggcctgttctggcccgccggcagaaaggacgccttctacccccccttctgcatgttctggccccccagaacccccggcggcctgcccgtgcccacctacctgcagccccccccccagccccccagcgccctgggctgcgccctgggcgagagccccgccctgctgagacaggccttcctggacctggccgagcccggcggcgccgccggcagcgccgaggccgcccccccccccggccagcccccccaggtggtggccaacggccccggcagcggcccccccccccccgccggcggcgccggcagcagagacgccctgttcgagagcccccccggcggcagcggcggcgactgcagcgccggcagcaccccccccgccgacagcgtggccgccgccggcgccggcgccgccgccgccggcagcggccccgccggcagcagagtgcccgccccccaccacccccacctgctggagggcagaaaggccggcggcggcagctaccaccacagcagcgccttcagacccgtgggcggcaaggacgacgccgagagcctggccaagctgcacggcgccagcgccggcgccccccacagcgcccagacccacccccaccaccaccaccacccccaccaccaccaccaccaccaccaccccccccagccccccagccccctgctgctgctgcccccccagcccgacgagcccggcagcgagagacaccaccccgccccccccccccccccccccccccccccccccccccccctggcccagcacccccaccacagaggcctgctgagccccggcggcaccagctgctgctaccccagcgaggacagcagcgaggacgaggacgacgaggaggaggagcaggaggtggacgtggagggccacaagccccccgagggcgaggaggaggaggagggcagagaccccgacgacgacgaggaggaggacgaggagaccgaggtgctgctgggcgaccccctggtgggcggcggcagattcctgcagggcagaggccccagcgagaagggcagcagcagagacagagcccccgccgtggccggcgccttccccctgggcctgaacagcagcagactgctgcaggaggacggcaagctgggcgaccccggcagcgacctgcccccccccccccccccccccctggccccccagaaggccagcggcggcggcagcagcagccccggcagccccgtgcaccaccccagcctggaggagcagcccagctacaaggacagccagaagaccaaggagaacaaccaggtgatcgtgagcaccaaggacgacaacagcttcagcgacaagaacaaggagcacagcttcttcatcaccgacagcgacgccagcggcggcgacttctggagagagagaagcggcgagcacacccaggagaccaacagcccccacagcctgaagaaggacgtggagaacatgggcaaggaggagctgcagaaggtgctgttcgagcagatcgacctgagaagaagactggagcaggagttccaggtgctgaagggcaacaccagcttccccgtgttcaacaacttccaggaccagatgaagagagagctggcctacagagaggagatggtgcagcagctgcagatcgtgagctgcatcagcacctag

SEQ ID NO: 12036 - DNA, 198 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagcatccccctgtag

SEQ ID NO: 12037 - DNA, 1041 bp, Artificial Sequence
  Description of Artificial Sequence: Synthetic coding sequence
atgatcagcagacccgcctggctgtggggcgccgagatgggcgccaacgagcacggcgtgtgcatcgccaacgaggccatcaacaccagagagcccgccgccgagatcgaggccctgctgggcatggacctggtgagactgggcctggagagaggcgagaccgccaaggaggccctggacgtgatcgtgagcctgctggaggagcacggccagggcggcaactacttcgaggacgccaacagctgccacagcttccagagcgcctacctgatcgtggacagagacgaggcctgggtgctggagaccatcggcaagtactgggccgccgagaaggtgaccgagggcgtgagatgcatctgcagccagctgagcctgaccaccaagatggacgccgagcaccccgagctgagaagctacgcccagagccagggctggtggaccggcgagggcgagttcaacttcagcgaggtgttcagccccgtggaggaccacctggactgcggcgccggcaaggacagcctggagaagcaggaggagagcatcaccgtgcagaccatgatgaacaccctgagagacaaggccagcggcgtgtgcatcgacagcgagttcttcctgaccaccgccagcggcgtgagcgtgctgccccagaacagaagcagcccctgcatccactacttcaccggcacccccgaccccagcagaagcatcttcaagcccttcatcttcgtggacgacgtgaagctggtgcccaagacccagagcccctgcttcggcgacgacgaccccgccaagaaggagcccagattccaggagaagcccgacagaagacacgagctgtacaaggcccacgagtgggccagagccatcatcgagagcgaccaggagcagggcagaaagctgagaagcaccatgctggagctggagaagcagggcctggaggccatggaggagatcctgaccagcagcgagcccctggaccccgccgaggtgggcgacctgttctacgactgcgtggacaccgagatcaagttcttcaagtag

SEQ ID NO: 12038 - DNA, 1620 bp, Artificial Sequence; identical to SEQ ID NO: 10018
  Description of Artificial Sequence: Synthetic coding sequence

SEQ ID NO: 12039 - DNA, 390 bp, Artificial Sequence; identical to SEQ ID NO: 10956
  Description of Artificial Sequence: Synthetic coding sequence

SEQ ID NO: 12040 - DNA, 1740 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcagagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccagcagccccttccaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 12041 - DNA, 831 bp, Artificial Sequence
  Description of Artificial Sequence: Synthetic coding sequence
atgtacgccagctggaccaaggcctgcagaggcctggaggagctgatcaacctgaccagactgaacgtgagctacaaccacatcgacgacctgagcggcctgatccccctgcacggcatcaagcacaagctgagatacatcgacctgcacagcaacagaatcgacagcatccaccacctgctgcagtgcatggtgggcctgcacttcctgaccaacctgatcctggagaaggacggcgacgacaaccccgtgtgcagactgcccggctacagagccgtgatcctgcagaccctgccccagctgagaatcctggactgcaagaacatcttcggcgagcccgtgaacctgaccgagatcaacagcagccagctgcagtgcctggagggcctgctggacaacctggtgagcagcgacagccccctgaacatcagcgaggacgagatcatcgacagaatgcccgtgatcaccgcccccatcgacgagctggtgcccctggagcagttcgccagcacccccagcgacgccgtgctgaccagcttcatgagcgtgtgccagagcagcgagcccgagaagaacaaccacgagaacgacctgcagaacgagatcaagctgcagaagctggacgaccagatcctgcagctgctgaacgagaccagcaacagcatcgacaacgtgctggagaaggaccccagacccaagagagacaccgacatcaccagcgagagcgactacggcaacagcagaaagaacggcgagaccaagaaggccgccgccggcagcaccgacaagaccgaccccagaggcggcacccagagcttcagctgcagatag

SEQ ID NO: 12042 - DNA, 1995 bp, Artificial Sequence
  Description of Artificial Sequence: Synthetic coding sequence
atgggcgacgacggcagcccccccgccaagaagatgatcaccgacatccacgccaacggcaagaccatcaacaaggtgcccaccgtgaagaaggagcacctggacgactacggcgaggcccccgtggagaccgacggcgagcacgtgaagagaacctgcaccagcgtgcccgagaccctgcacctgaaccccagcctgaagcacaccctggcccagttccacctgagcagccagagcagcctgggcggccccgccgccttcagcgccagacacagccaggagagcatgagccccaccgtgttcctgcccctgcccagcccccaggtgctgcccggccccctgctgatccccagcgacagcagcaccgagctgacccagaccgtgctggagggcgagagcatcagctgcttccaggtgggcggcgagaagagactgtgcctgccccaggtgctgaacagcgtgctgagagagttcaccctgcagcagatcaacaccgtgtgcgacgagctgtacatctactgcagcagatgcaccagcgaccagctgcacatcctgaaggtgctgggcatcctgcccttcaacgcccccagctgcggcctgatcaccctgaccgacgcccagagactgtgcaacgccctgctgagacccagaaccttcccccagaacggcagcgtgctgcccgccaagagcagcctggcccagctgaaggagaccggcagcgccttcgaggtggagcacgagtgcctgggcaagtgccagggcctgttcgccccccagttctacgtgcagcccgacgccccctgcatccagtgcctggagtgctgcggcatgttcgccccccagaccttcgtgatgcacagccacagaagccccgacaagagaacctgccactggggcttcgagagcgccaagtggcactgctacctgcacgtgaaccagaagtacctgggcacccccgaggagaagaagctgaagatcatcctggaggagatgaaggagaagttcagcatgagaagcggcaagagaaaccagagcaagaccgacgcccccagcggcatggagctgcagagctggtaccccgtgatcaagcaggagggcgaccacgtgagccagacccacagcttcctgcaccccagctactacctgtacatgtgcgacaaggtggtggcccccaacgtgagcctgaccagcgccgtgagccagagcaaggagctgaccaagaccgaggccagcaagagcatcagcagacagagcgagaaggcccacagcagcggcaagctgcagaagaccgtgagctaccccgacgtgagcctggaggagcaggagaagatggacctgaagaccagcagagagctgtgcagcagactggacgccagcatcagcaacaacagcaccagcaagagaaagagcgagagcgccacctgcaacctggtgagagacatcaacaaggtgggcatcggcctggtggccgccgccagcagccccctgctggtgaaggacgtgatctgcgaggacgacaagggcaagatcatggaggaggtgatgagaacctacctgaagcagcaggagaagctgaacctgatcctgcagaagaagcagcagctgcagatggaggtgaagatgctgagcagcagcaagagcatgaaggagctgaccgaggagcagcagaacctgcagaaggagctggagagcctgcagaacgagcacgcccagagaatggaggagttctacgtggagcagaaggacctggagaagaagctggagcagatcatgaagcagaagtgcacctgcgacagcaacctggagaaggacaaggaggccgagtacgccggccagctggccgagctgagacagagactggaccacgccgaggccgacagacaggagctgcaggacgagctgagacaggagagagaggccagacagaagctggagatgatgatcaaggagctgaagctgcagatcctgaagagcagcaagaccgccaaggagtag

SEQ ID NO: 12043 - DNA, 1068 bp, Artificial Sequence
  Description of Artificial Sequence: Synthetic coding sequence
atgggcagaagagacctggtgagcggcggcagcaacgagggcaacggcaaggaggactgggccatgaagaccgtgagcctgagatggaccaagctgccccccgtgaagagcgccatcagaggccaggcccccgtggtgccctacatgagatacggccacagcaccgtgctgatcgacgacaccgtgctgctgtggggcggcagaaacgacaccgagggcgcctgcaacgtgctgtacgccttcgacgtgaacacccacaagtggttcacccccagagtgagcggcaccgtgcccggcgccagagacggccacagcgcctgcgtgctgggcaagatcatgtacatcttcggcggctacgagcagcaggccgactgcttcagcaacgacatccacaagctggacaccagcaccatgacctggaccctgatctgcaccaagggcagccccgccagatggagagacttccacagcgccaccatgctgggcagccacatgtacgtgttcggcggcagagccgacagattcggccccttccacagcaacaacgagatctactgcaacagaatcagagtgttcgacaccagaaccgaggcctggctggactgcccccccacccccgtgctgcccgagggcagaagaagccacagcgccttcggctacaacggcgagctgtacatcttcggcggctacaacgccagactgaacagacacttccacgacctgtggaagttcaaccccgtgagcttcacctggaagaagatcgagcccaagggcaagggcccctgccccagaagaagacagtgctgctgcatcgtgggcgacaagatcgtgctgttcggcggcaccagccccagccccgaggagggcctgggcgacgagttcgacctgatcgaccacagcgacctgcacatcctggacttcagccccagcctgaagaccctgtgcaagctggccgtgatccagtacaacctggaccagagctgcctgccccacgacatcagatgggagctgaacgccatgaccaccaacagcaacatcagcagacccatcgtgagcagccacggctag

SEQ ID NO: 12044 - DNA, 1245 bp, Artificial Sequence; identical to SEQ ID NO: 9295
  Description of Artificial Sequence: Synthetic coding sequence

SEQ ID NO: 12045 - DNA, 1200 bp, Artificial Sequence
  Description of Artificial Sequence: Synthetic coding sequence
atggccaccggcgacctgaagagaagcctgagaaacctggagcaggtgctgagactgctgaactaccccgaggaggtggactgcgtgggcctgatcaagggcgaccccgccgccagcctgcccatcatcagctacagcttcaccagctacagcccctacgtgaccgagctgatcatggagagcaacgtggagctgatcgccaagaacgacctgagattcatcgacgccgtgtacaagctgctgagagaccagttcaactacaagcccatcctgaccaagaagcagttcatccagtgcggcttcgccgagtggaagatccagatcgtgtgcgacatcctgaactgcgtgatgaagaagcacaaggagctgagcagcctgcagaagatccccagccagcagagaaagaagatcagcagcggcaagagcgagccccccctgggcaacgagaagatcagcgccgaggccgtgggcgtggacatcagcggcagattcatgaccagcggcaagaagaaggccgtggtgatcagacacctgtacaacgaggacaacgtggacatcagcgaggacaccctgagccccatcaccgacgtgaacgaggccgtggacgtgagcgacctgaacgccaccgagatcaagatgcccgaggtgaaggtgcccgagatcaaggccgagcagcaggacgtgaacgtgaaccccgagatcaccgccctgcagaccatgctggccgagtgccaggagaacctgaagaagctgaccagcatcgagaagagactggactgcctggagcagaagatgaagggcaaggtgatggtggacgagaacacctggaccaacctgctgagcagagtgaccctgctggagaccgagatgctgctgagcaagaagaacgacgagttcatcgagttcaacgaggtgagcgaggactacgccagctgcagcgacatggacctgctgaacccccacagaaagagcgaggtggagagacccgccagcatccccctgagcagcggctacagcaccgccagcagcgacagcacccccagagccagcaccgtgaactactgcggcctgaacgagatcagcgagaacttccccgcctggagcgccaccagcagctgcagcagcctgagctggctgctgagaggccacaccagctacctgagcagccagagcttcgcctggcccctgagctgcgtgtag

SEQ ID NO: 12046 - DNA, 1317 bp, Artificial Sequence
  Description of Artificial Sequence: Synthetic coding sequence
tgatgcgccggcgccgagagacccagaagaagaggcagactgtgggacagcagcggcgtgccccagagacagaagagacccggcccctggagaacccagacccaggagcagatgagcagagacgtgtgcatccacacctggccctgcacctactacctggagcccaagagaagatgggtgaccggccagctgagcctgaccagcctgagcctgagattcatgaccgacagcaccggcgagatcctggtgagcttccccctgagcagcatcgtggagatcaagaaggaggccagccacttcatcttcagcagcatcaccatcctggagaagggccacgccaagcactggttcagcagcctgagacccagcagaaacgtggtgttcagcatcatcgagcacttctggagagagctgctgctgagccagcccggcgccgtggccgacgccagcgtgcccagaaccagaggcgaggagctgaccggcctgatggccggcagccagaagagactggaggacaccgccagagtgctgcaccaccagggccagcagctggacagcgtgatgagaggcctggacaagatggagagcgacctggaggtggccgacagactgctgaccgagctggagagccccgcctggtggcccttcagcagcaagctgtggaagaccccccccgagaccaagcccagagaggacgtgagcatgaccagctgcgagcccttcggcaaggagggcatcctgatcaagatccccgccgtgatcagccacagaaccgagagccacgtgaagcccggcagactgaccgtgctggtgagcggcctggagatccacgacagcagcagcctgctgatgcacagattcgagagagaggacgtggacgacatcaaggtgcacagcccctacgagatcagcatcagacagagattcatcggcaagcccgacatggcctacagactgatcagcgccaagatgcccgaggtgatccccatcctggaggtgcagttcagcaagaagatggagctgctggaggacgccctggtgctgagaagcgccagaaccagcagccccgccgagaagagctgcagcgtgtggcacgccgccagcggcctgatgggcagaaccctgcacagagagccccccgccggcgaccaggagggcaccgccctgcacctgcagaccagcctgcccgccctgagcgaggccgacacccaggagctgacccagggcttcagacccatgagcctgagcacccagaccgtgctggtgatgctgtgcagcgagagcgccggcgccctgtggagacagagactgagctag

SEQ ID NO: 12047 - DNA, 711 bp, Artificial Sequence
  Description of Artificial Sequence: Synthetic coding sequence
atgaccggctacgaggccagactgatcaccttcggcacctggatgtacagcgtgaacaaggagcagctggccagagccggcttctacgccatcggccaggaggacaaggtgcagtgcttccactgcggcggcggcctggccaactggaagcccaaggaggacccctgggagcagcacgccaagtggtaccccggctgcaagtacctgctggaggagaagggccacgagtacatcaacaacatccacctgaccagaagcctggagggcgccctggtgcagaccaccaagaagacccccagcctgaccaagagaatcagcgacaccatcttccccaaccccatgctgcaggaggccatcagaatgggcttcgacttcaaggacgtgaagaagatcatggaggagagaatccagaccagcggcagcaactacaagaccctggaggtgctggtggccgacctggtgagcgcccagaaggacaccaccgagaacgagctgaaccagaccagcctgcagagagagatcagccccgaggagcccctgagaagactgcaggaggagaagctgtgcaagatctgcatggacagacacatcgccgtggtgttcatcccctgcggccacctggtgacctgcaagcagtgcgccgaggccgtggacagatgccccatgtgcagcgccgtgatcgacttcaagcagagagtgttcatgagctag

SEQ ID NO: 12048 - DNA, 285 bp, Artificial Sequence
  Description of Artificial Sequence: Synthetic coding sequence
atgaaccccaccaaccccttcagcggccagcagcccagcgccttcagcgccagcagcagcaacgtgggcaccctgcccagcaagccccccttcagattcggccagcccagcctgttcggccagaacagcaccctgagcggcaagagcagcggcttcagccaggtgagcagcttccccgccagcagcggcgtgagccacagcagcagcgtgcagaccctgggcttcacccagaccagcagcgtgggccccttcagcggcctggagcacaccagcaccttcgtgtag

SEQ ID NO: 12049 - DNA, 723 bp, Artificial Sequence
  Description of Artificial Sequence: Synthetic coding sequence
atggccatcgtgcagaccctgcccgtgcccctggagcccgcccccgaggccgccaccgccccccaggcccccgtgatgggcagcgtgagcagcctgatcagcggcagaccctgccccggcggccccgccccccccagacaccacggcccccccggccccaccttcttcagacagcaggacggcctgctgagaggcggctacgaggcccaggagcccctgtgccccgccgtgccccccagaaaggccgtgcccgtgaccagcttcacctacatcaacgaggacttcagaaccgagagcccccccagccccagcagcgacgtggaggacgccagagagcagagagcccacaacgcccacctgagaggccccccccccaagctgatccccgtgagcggcaagctggagaagaacatggagaagatcctgatcagacccaccgccttcaagcccgtgctgcccaagcccagaggcgcccccagcctgcccagcttcatgggccccagagccaccggcctgagcggcagccagggcagcctgacccagctgttcggcggccccgccagcagcagcagcagcagcagcagcagcagcgccgccgacaagcccctggccttcagcggctgggccagcggctgccccagcggcaccctgagcgacagcggcagaaacagcctgagcagcctgcccacctacagcaccggcggcgccgagcccaccacctag

SEQ ID NO: 12050 - DNA, 1317 bp, Artificial Sequence; identical to SEQ ID NO: 9899
  Description of Artificial Sequence: Synthetic coding sequence

SEQ ID NO: 12051 - DNA, 678 bp, Artificial Sequence
  Description of Artificial Sequence: Synthetic coding sequence
atggaggaggaggagatgaacgacggcagccagatggtgagaagccaggagagcctgaccttccaggacgtggccgtggacttcaccagagaggagtgggaccagctgtaccccgcccagaagaacctgtacagagacgtgatgctggagaactacagaaacctggtggccctgggctaccagctgtgcaagcccgaggtgatcgcccagctggagctggaggaggagtgggtgatcgagagagacagcctgctggacacccaccccggcgaccagagccacgtgatgagcgtggtgagaagcagcgtgcacgccagatggatcgtgggcaaggtgatcggcaccaagatgcagaagaccgccaaggtgagagtgaccagactggtgctggacccctacctgctgaagtacttcaacaagagaaagacctacttcgcccacgacgccctgcagcagtgcaccgtgggcgacatcgtgctgctgagagccctgcccgtgcccagagccaagcacgtgaagcacgagctggccgagatcgtgttcaaggtgggcaaggtgatcgaccccgtgaccggcaagccctgcgccggcaccacctacctggagagccccctgagcagcgagaccacccagctgagcaagaacctggaggagctgaacatcagcagcgcccagtag

SEQ ID NO: 12052 - DNA, 753 bp, Artificial Sequence
  Description of Artificial Sequence: Synthetic coding sequence
atgaccaccaagaacctggagaccaaggtgaccgtgaccagcagccccatcagaggcgccggcgacggcatggagaccgaggagccccccaagagcgtggaggtgaccagcggcgtgcagagcagaaagcaccacagcctgcagagcccctggaagaaggccgtgcccagcgagagccccggcgtgctgcagctgggcaagatgctgaccgagaaggccatggaggtgaaggccgtgagaatcctggtgcccaaggccgccatcacccacgacatccccaacaagaacaccaaggtgaagagcctgggccaccacaagggcgagttcctgggccagagcgagggcgtgatcgagcccaacaaggagctgagcgaggtgaagaacgtgctggagaagctgaagaacagcgagagaagactgctgcaggacaaggagggcctgagcaaccagctgagagtgcagaccgaggtgaacagagagctgaagaagctgctggtggccagcgtgggcgacgacctgcagtaccacttcgagagactggccagagagaagaaccagctgatcctggagaacgaggccctgggcagaaacaccgcccagctgagcgagcagctggagagaatgagcatccagtgcgacgtgtggagaagcaagttcctggccagcagagtgatggccgacgagctgaccaacagcagagccgccctgcagagacagaacagagacgcccacggcgccatccaggacctgtag

SEQ ID NO: 12053 - DNA, 387 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgcggcttcatcagcgacagaagcgtgaaggaggtggcctgcggcggcaaccacagcgtgttcctgctggaggacggcgaggtgtacacctgcggcctgaacaccaagggccagctgggccacgagagagagggcaacaagcccgagcagatcggcgccctggccgaccagcacatcatccacgtggcctgcggcgagagccacagcctggccctgagcgacagaggccagctgttcagctggggcgccggcagcgacggccagctgggcctgatgaccaccgaggacagcgtggccgtgccctag

SEQ ID NO: 12054 - DNA, 1617 bp, Artificial Sequence
  Description of Artificial Sequence: Synthetic coding sequence
atggacgtggacaaggagctgggcatggagagcgtgaaggccggcgccagcggcaagcccgagatgagactgggcacccaggaggagaccagcgagggcgacgccaacgagagcagcctgctggtgctgagcagcaacgtgcccctgctggccctggagttcctggagatcgcccaggccaaggagaaggccttcctgcccatggtgagccacaccttccacatgagaaccgaggagagcgacgccagccaggagggcgacgacctgcccaagagcagcgccaacaccagccaccccaagcaggacgacagccccaagagcagcgaggagaccatccagcccaaggagggcgacatccccaaggcccccgaggagaccatccagagcaagaaggaggacctgcccaagagcagcgagaaggccatccagcccaaggagagcaacatccccaagagcagcgccaagcccatccagcccaagctgggcaacatccccaaggccagcgtgaagcccagccagcccaaggagggcgacatccccaaggcccccgaggagaccatccagagcaagaaggaggacctgcccaagagcagcgaggaggccatccagcccaaggagggcgacatccccaagagcagcgccaagcccatccagcccaagctgggcaacatcgccaagaccagcgtgaagcccagccagcccaaggagagcgacatccccaagagccccgaggagaccatccagcccaaggagggcgacatccccaagagcagcgccaagcccatccagcccaagctgggcaacatccccaaggccagcgtgaagcccagccagcccaaggagggcgacatcagcaagagccccgaggaggccatccagcccaaggagggcgacctgcccaagagcctggaggaggccatccagcccaaggagggcgacatccccaagagcctggaggaggccatccagcccaaggagggcgacatccccaagagccccgaggagaccatccagcccaagaagggcgacatccccaagagccccgaggaggccatccagcccaaggagggcgacatccccaagagccccaagcaggccatccagcccaaggagggcgacatccccaagagcctggaggaggccatcccccccaaggagatcgacatccccaagagccccgaggagaccatccagcccaaggaggacgacagccccaagagcctggaggaggccacccccagcaaggagggcgacatcctgaagcccgaggaggagaccatggagttccccgagggcgacaaggtgaaggtgatcctgagcaaggaggacttcgaggccagcctgaaggaggccggcgagagactggtggccgtggacttcagcgccacctggtgcggcccctgcagaaccatcagacccttcttccacgccctgagcgtgaagcacgaggacgtggtgttcctggaggtggacgccgacaactgcgaggaggtggtgagagagtgcgccatcatgtgcgtgcccaccttccagttctacaagaaggaggagaaggtggacgagctgtgcggcgccctgaaggagaagctggaggccgtgatcgccgagctgaagtag

SEQ ID NO: 12055 - DNA, 153 bp, Artificial Sequence
  Description of Artificial Sequence: Synthetic coding sequence
atggccagcgaggagctgcagaaggacctggaggaggtgaaggtgctgctggagaaggccaccagaaagagagtgagagacgccctgaccgccgagaagagcaagatcgagaccgagatcaagaacaagatgcagcagaagagccagaagtag

SEQ ID NO: 12056 - DNA, 1527 bp, Artificial Sequence; identical to SEQ ID NO: 9879
  Description of Artificial Sequence: Synthetic coding sequence

SEQ ID NO: 12057 - DNA, 3846 bp, Artificial Sequence
  Description of Artificial Sequence: Synthetic coding sequence
atgaccttctacagctggatcccctaccacagacaggcccccctgaaccacagaagagtgtgcagcgccgagggcgccggcagccccggccccgccctggaccccagatggctgcccaccgaggcccacctgctggaggcccacagactgctgctgcagagcgtgctgtgcgacagacccagagagagcatccagctgcacttcagactgagcatggccagccagctgcaggtgttcagcccccccagcgtgagcagcagcgccttctgcagcgccaagaagctgaagatcgagcccagcggctgggacgtgagcggccagagcagcaacgacaagtactacacccacagcaagaccctgcccgccacccagggccaggccaacagcagccaccaggtggccaacttcaacatccccgcctacgaccagggcctgctgctgcccgcccccgccgtggagcacatcgtggtgaccgccgccgacagcagcggcagcgccgccaccagcaccttccagagcagccagaccctgacccacagaagcaacgtgagcctgctggagccctaccagaagtgcggcctgaagagaaagagcgaggaggtggacagcaacggcagcgtgcagatcatcgaggagcacccccccctgatgctgcagaacagaaccgtggtgggcgccgccgccaccaccaccaccgtgaccaccaagagcagcagcagcagcggcgagggcgactaccagctggtgcagcacgagatcctgtgcagcatgaccaacagctacgaggtgctggagttcctgggcagaggcaccttcggccaggtggccaagtgctggaagagaagcaccaaggagatcgtggccatcaagatcctgaagaaccaccccagctacgccagacagggccagatcgaggtgagcatcctgagcagactgagcagcgagaacgccgacgagtacaacttcgtgagaagctacgagtgcttccagcacaagaaccacacctgcctggtgttcgagatgctggagcagaacctgtacgacttcctgaagcagaacaagttcagccccctgcccctgaagtacatcagacccatcctgcagcaggtggccaccgccctgatgaagctgaagagcctgggcctgatccacgccgacctgaagcccgagaacatcatgctggtggaccccgtgagacagccctacagagtgaaggtgatcgacttcggcagcgccagccacgtgagcaaggccgtgtgcagcacctacctgcagagcagatactacagagcccccgagatcatcctgggcctgcccttctgcgaggccatcgacatgtggagcctgggctgcgtgatcgccgagctgttcctgggctggcccctgtaccccggcgccagcgagtacgaccagatcagatacatcagccagacccagggcctgcccgccgagtacctgctgagcgccggcaccaagaccaccagattcttcaacagagaccccaacctgggctaccccctgtggagactgaagacccccgaggagcacgagctggagaccggcatcaagagcaaggaggccagaaagtacatcttcaactgcctggacgacatggcccaggtgaacatgagcaccgacctggagggcaccgacatgctggccgagaaggccgacagaagagagtacatcgacctgctgaagaagatgctgaccatcgacgccgacaagagaatcacccccctgaagaccctgaaccaccagttcgtgaccatgacccacctgctggacttcccccacagcaaccacgtgaagagctgcttccagaacatggagatctgcaagagaagagtgcacatgtacgacaccgtgagccagatcaagagccccttcaccacccacgtggcccccaacaccagcaccaacctgaccatgagcttcagcaaccagctgaacaccgtgcacaaccaggccagcgtgctggccagcagcagcaccgccgccgccgccaccctgagcctggccaacagcgacgtgagcctgctgaactaccagagcgccctgtaccccagcagcgccgcccccgtgcccggcgtggcccagcagggcgtgagcctgcagcccggcaccacccagatctgcacccagaccgaccccttccagcagaccttcatcgtgtgcccccccgccttccagaccggcctgcaggccaccaccaagcacagcggcttccccgtgagaatggacaacgccgtgcccatcgtgccccaggcccccgccgcccagcccctgcagatccagagcggcgtgctgacccagggcagctgcacccccctgatggtggccaccctgcacccccaggtggccaccatcaccccccagtacgccgtgcccttcaccctgagctgcgccgccggcagacccgccctggtggagcagaccgccgccgtgctgcaggcctggcccggcggcacccagcagatcctgctgcccagcacctggcagcagctgcccggcgtggccctgcacaacagcgtgcagcccaccgccatgatccccgaggccatgggcagcggccagcagctggccgactggagaaacgcccacagccacggcaaccagtacagcaccatcatgcagcagcccagcctgctgaccaaccacgtgaccctggccaccgcccagcccctgaacgtgggcgtggcccacgtggtgagacagcagcagagcagcagcctgcccagcaagaagaacaagcagagcgcccccgtgagcagcaagagcagcctggacgtgctgcccagccaggtgtacagcctggtgggcagcagccccctgagaaccaccagcagctacaacagcctggtgcccgtgcaggaccagcaccagcccatcatcatccccgacacccccagcccccccgtgagcgtgatcaccatcagaagcgacaccgacgaggaggaggacaacaagtacaagcccagcagcagcggcctgaagcccagaagcaacgtgatcagctacgtgaccgtgaacgacagccccgacagcgacagcagcctgagcagcccctacagcaccgacaccctgagcgccctgagaggcaacagcggcagcgtgctggagggccccggcagagtggtggccgacggcaccggcaccagaaccatcatcgtgccccccctgaagacccagctgggcgactgcaccgtggccacccaggccagcggcctgctgagcaacaagaccaagcccgtggccagcgtgagcggccagagcagcggctgctgcatcacccccaccggctacagagcccagagaggcggcaccagcgccgcccagcccctgaacctgagccagaaccagcagagcagcgccgcccccaccagccaggagagaagcagcaaccccgcccccagaagacagcaggccttcgtggcccccctgagccaggccccctacaccttccagcacggcagccccctgcacagcaccggccacccccacctggcccccgcccccgcccacctgcccagccaggcccacctgtacacctacgccgcccccaccagcgccgccgccctgggcagcaccagcagcatcgcccacctgttcagcccccagggcagcagcagacacgccgccgcctacaccacccaccccagcaccctggtgcaccaggtgcccgtgagcgtgggccccagcctgctgaccagcgccagcgtggcccccgcccagtaccagcaccagttcgccacccagagctacatcggcagcagcagaggcagcaccatctacaccggctaccccctgagccccaccaagatcagccagtacagctacctgtag

SEQ ID NO: 12058 - DNA, 1071 bp, Artificial Sequence; identical to SEQ ID NO: 10895
  Description of Artificial Sequence: Synthetic coding sequence

SEQ ID NO: 12059 - DNA, 2748 bp, Artificial Sequence
  Description of Artificial Sequence: Synthetic coding sequence
atgcagggccccgacgcccccctgctgctgagcgccagagagctgggccccggcagaagaggcagcgccagctggtacagacaggagggcggcgccgtgtgcaactggctgagaaagccccagcccctggagcccagaaccagcttccccagcgccagaagaagcgagttcagaccccccagaagactgccctgggccggccccgccagcgcccagagcgaggagggccacgccggcggcagatgccaggccggcagccccgcccccgccagaagactgagcggcgccttcaagaccctggtgcccggcacccacgcccagggcgccagcgacacccaccccctgggccccccccacacccccgtgctggaccccagcccccaggacggcttccccgtgctgtggagaggcagcagcaaggccagccacatgaacagactgagaaacgccaagatctacgtggagagagccgtgaagcagaagaagatcttcaccatccagggctgctaccccgtgatcagatgcctgctgagaagaagaggctgggtggagaagaagatggtgcacagaagcggccccaccctgctgcccccccagaaggacctggacagcagcgccatgggcgacagcgacaccaccgaggacgaggacgaggacgaggacgaggagttccagcccagccagctgttcgacttcgacgacctgctgaagttcgacgacctggacggcacccacgccctgatggtgggcctgtgcctgaacctgagaaacctgccctggttcgacgaggtggacgccaacagcttcttccccagatgctactgcctgggcgccgaggacgacaagaaggccttcatcgaggacttctggctgaccgccgccagaaacgtgctgaagctggtggtgaagagcgagtggaagagctaccccatccaggccgtggaggaggaggccagcggcgacaagcagcccaagaagcaggagaagaaccccgtgctggtgagccccgagttcgtggacgaggccctgtgcgcctgcgaggagtacctgagcaacctggcccacatggacatcgacaaggacctggaggcccccctgtacctgacccccgagggctggagcctgttcctgcagagatactaccaggtggtgcacgagggcgccgagctgagacacctggacacccaggtgcagagatgcgaggacatcctgcagcagctgcaggccgtggtgccccagatcgacatggagggcgacagaaacatctggatcgtgaagcccggcgccaagagcagaggcagaggcatcatgtgcatggaccacctggaggagatgctgaagctggtgaacggcaaccccgtggtgatgaaggacggcaagtgggtggtgcagaagtacatcgagagacccctgctgatcttcggcaccaagttcgacctgagacagtggttcctggtgaccgactggaaccccctgaccgtgtggttctacagagacagctacatcagattcagcacccagcccttcagcctgaagaacctggacaacagcgtgcacctgtgcaacaacagcatccagaagcacctggagaacagctgccacagacaccccctgctgccccccgacaacatgtggagcagccagagattccaggcccacctgcaggagatgggcgcccccaacgcctggagcaccatcatcgtgcccggcatgaaggacgccgtgatccacgccctgcagaccagccaggacaccgtgcagtgcagaaaggccagcttcgagctgtacggcgccgacttcgtgttcggcgaggacttccagccctggctgatcgagatcaacgccagccccaccatggcccccagcaccgccgtgaccgccagactgtgcgccggcgtgcaggccgacaccctgagagtggtgatcgacagaatgctggacagaaactgcgacaccggcgccttcgagctgatctacaagcagcccgccgtggaggtgccccagtacgtgggcatcagactgctggtggagggcttcaccatcaagaagcccatggccatgtgccacagaagaatgggcgtgagacccgccgtgcccctgctgacccagagaggcagcggcgaggccagacaccacttccccagcctgcacaccaaggcccagctgcccagcccccacgtgctgagacaccagggccaggtgctgagaagacagcacagcaagctggtgggcaccaaggccctgagcaccaccggcaaggccctgagaaccctgcccaccgccaaggtgttcatcagcctgccccccaacctggacttcaaggtggcccccagcatcctgaagcccagaaaggcccccgccctgctgtgcctgagaggcccccagctggaggtgccctgctgcctgtgccccctgaagagcgagcagttcctggcccccgtgggcagaagcagacccaaggccaacagcagacccgactgcgacaagcccagagccgaggcctgccccatgaagagactgagccccctgaagcccctgcccctggtgggcaccttccagagaagaagaggcctgggcgacatgaagctgggcaagcccctgctgagattccccaccgccctggtgctggaccccacccccaacaagaagaagcaggtgaagtacctgggcctggacagcatcgccgtgggcggcagcagagtggacggcgccagaccctgcacccccggcagcaccgccagagcctag

SEQ ID NO: 12060 - DNA, 2463 bp, Artificial Sequence
  Description of Artificial Sequence: Synthetic coding sequence
atgagaatcagcagctgcagcgacgagagcagcaacagcaacagcagcagaaagagcgacaaccacagccccgccgtggtgaccaccaccgtgagcagcaagaagcagcccagcgtgctggtgaccttccccaaggaggagagaaagagcgtgagcggcaaggccagcatcaagctgagcgagaccatcagcgagggcaccagcaacagcctgagcacctgcaccaagagcggccccagccccctgagcagccccaacggcaagctgaccgtggccagccccaagagaggccagaagagagaggagggctggaaggaggtggtgagaagaagcaagaaggtgagcgtgcccagcaccgtgatcagcagagtgatcggcagaggcggctgcaacatcaacgccatcagagagttcaccggcgcccacatcgacatcgacaagcagaaggacaagaccggcgacagaatcatcaccatcagaggcggcaccgagagcaccagacaggccacccagctgatcaacgccctgatcaaggaccccgacaaggagatcgacgagctgatccccaagaacagactgaagagcagcagcgccaacagcaagatcggcagcagcgcccccaccaccaccgccgccaacaccagcctgatgggcatcaagatgaccaccgtggccctgagcagcaccagccagaccgccaccgccctgaccgtgcccgccatcagcagcgccagcacccacaagaccatcaagaaccccgtgaacaacgtgagacccggcttccccgtgagcctgcccctggcctacccccccccccagttcgcccacgccctgctggccgcccagaccttccagcagatcagaccccccagactgcccatgacccacttcggcggcaccttcccccccgcccagagcacctggggccccttccccgtgagacccctgagccccgccagagccaccaacagccccaagccccacatggtgcccagacacagcaaccagaacagcagcggcagccaggtgaacagcgccggcagcctgaccagcagccccaccaccaccaccagcagcagcgccagcaccgtgcccggcaccagcaccaacggcagccccagcagccccagcgtgagaagacagctgttcgtgaccgtggtgaagaccagcaacgccaccaccaccaccgtgaccaccaccgccagcaacaacaacaccgcccccaccaacgccacctaccccatgcccaccgccaaggagcactaccccgtgagcagccccagcagccccagcccccccgcccagcccggcggcgtgagcagaaacagccccctggactgcggcagcgccagccccaacaaggtggccagcagcagcgagcaggaggccggcagcccccccgtggtggagaccaccaacaccagaccccccaacagcagcagcagcagcggcagcagcagcgcccacagcaaccagcagcagccccccggcagcgtgagccaggagcccagaccccccctgcagcagagccaggtgcccccccccgaggtgagaatgaccgtgccccccctggccaccagcagcgcccccgtggccgtgcccagcaccgcccccgtgacctaccccatgccccagacccccatgggctgcccccagcccacccccaagatggagacccccgccatcagaccccccccccacggcaccaccgccccccacaagaacagcgccagcgtgcagaacagcagcgtggccgtgctgagcgtgaaccacatcaagagaccccacagcgtgcccagcagcgtgcagctgcccagcaccctgagcacccagagcgcctgccagaacagcgtgcaccccgccaacaagcccatcgcccccaacttcagcgcccccctgcccttcggccccttcagcaccctgttcgagaacagccccaccagcgcccacgccttctggggcggcagcgtggtgagcagccagagcacccccgagagcatgctgagcggcaagagcagctacctgcccaacagcgaccccctgcaccagagcgacaccagcaaggcccccggcttcagaccccccctgcagagacccgcccccagccccagcggcatcgtgaacatggacagcccctacggcagcgtgacccccagcagcacccacctgggcaacttcgccagcaacatcagcggcggccagatgtacggccccggcgcccccctgggcggcgcccccgccgccgccaacttcaacagacagcacttcagccccctgagcctgctgaccccctgcagcagcgccagcaacgacagcagcgcccagagcgtgagcagcggcgtgagagcccccagccccgcccccagcagcgtgcccctgggcagcgagaagcccagcaacgtgagccaggacatcgtggccagcggccccctgaagggcctggtggccatcaagaccaagtag

SEQ ID NO: 12061 - DNA, 6033 bp, Artificial Sequence
  Description of Artificial Sequence: Synthetic coding sequence
atggagaaggccaccgtgcccgtggccgccgccaccgccgccgagggcgagggcagcccccccgccgtggccgccgtggccggcccccccgccgccgccgaggtgggcggcggcgtgggcggcagcagcagagccagaagcgccagcagccccagaggcatggtgagagtgtgcgacctgctgctgaagaagaagcccccccagcagcagcaccacaaggccaagagaaacagaacctgcagaccccccagcagcagcgagagcagcagcgacagcgacaacagcggcggcggcggcggcggcggcggcggcggcggcggcggcggcggcaccagcagcaacaacagcgaggaggaggaggacgacgacgacgaggaggaggaggtgagcgaggtggagagcttcatcctggaccaggacgacctggagaaccccatgctggagaccgccagcaagctgctgctgagcggcaccgccgacggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgagagccgagagcaccgccaacgccggccagagcgacaacagaagcctggccgaggcctgcagcgagggcgacgtgaacgccgtgagaaagctgctgatcgagggcagaagcgtgaacgagcacaccgaggagggcgagagcctgctgtgcctggcctgcagcgccggctactacgagctggcccaggtgctgctggccatgcacgccaacgtggaggacagaggcatcaagggcgacatcacccccctgatggccgccgccaacggcggccacgtgaagatcgtgaagctgctgctggcccacaaggccgacgtgaacgcccagagcagcaccggcaacaccgccctgacctacgcctgcgccggcggctacgtggacgtggtgaaggtgctgctggagagcggcgccagcatcgaggaccacaacgagaacggccacacccccctgatggaggccggcagcgccggccacgtggaggtggccagactgctgctggagaacggcgccggcatcaacacccacagcaacgagttcaaggagagcgccctgaccctggcctgctacaagggccacctggagatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccagcctggaggaggtgaacgacgagggctacacccccctgatggaggccgccagagagggccacgaggagatggtggccctgctgctgggccagggcgccaacatcaacgcccagaccgaggagacccaggagaccgccctgaccctggcctgctgcggcggcttcctggaggtggccgacttcctgatcaaggccggcgccgacatcgagctgggctgcagcacccccctgatggaggccgcccaggagggccacctggagctggtgaagtacctgctggccgccggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacgtgtgcaccgtgcagttcctgatcagcaagggcgccaacgtgaacagaaccaccgccaacaacgaccacaccgtgctgagcctggcctgcgccggcggccacctggccgtggtggagctgctgctggcccacggcgccgaccccacccacagactgaaggacggcagcaccatgctgatcgaggccgccaagggcggccacaccagcgtggtgtgctacctgctggactaccccaacaacctgctgagcgcccccccccccgacgtgacccagctgaccccccccagccacgacctgaacagagcccccagagtgcccgtgcaggccctgcccatggtggtgcccccccaggagcccgacaagccccccgccaacgtggccaccaccctgcccatcagaaacaaggccgccagcaagcagaagagcagcagccacctgcccgccaacagccaggacgtgcagggctacatcaccaaccagagccccgagagcatcgtggaggaggcccagggcaagctgaccgagctggagcagagaatcaaggaggccatcgagaagaacgcccagctgcagagcctggagctggcccacgccgaccagctgaccaaggagaagatcgaggagctgaacaagaccagagaggagcagatccagaagaagcagaagatcctggaggagctgcagaaggtggagagagagctgcagctgaagacccagcagcagctgaagaagcagtacctggaggtgaaggcccagagaatccagctgcagcagcagcagcagcagagctgccagcacctgggcctgctgacccccgtgggcgtgggcgagcagctgagcgagggcgactacgccagactgcagcaggtggaccccgtgctgctgaaggacgagccccagcagaccgccgcccagatgggcttcgcccccatccagcccctggccatgccccaggccctgcccctggccgccggccccctgccccccggcagcatcgccaacctgaccgagctgcaggtgctgagcagcctgctgcagccctgcttcctgagcaccctgcccctgatcctgatgcacagactgagagtgatcatgaccagacccaagagcagcagcaccagcgagagcggcgacagcgacaacatgagaatcagcagctgcagcgacgagagcagcaacagcaacagcagcagaaagagcgacaaccacagccccgccgtggtgaccaccaccgtgagcagcaagaagcagcccagcgtgctggtgaccttccccaaggaggagagaaagagcgtgagcggcaaggccagcatcaagctgagcgagaccatcagcgagggcaccagcaacagcctgagcacctgcaccaagagcggccccagccccctgagcagccccaacggcaagctgaccgtggccagccccaagagaggccagaagagagaggagggctggaaggaggtggtgagaagaagcaagaaggtgagcgtgcccagcaccgtgatcagcagagtgatcggcagaggcggctgcaacatcaacgccatcagagagttcaccggcgcccacatcgacatcgacaagcagaaggacaagaccggcgacagaatcatcaccatcagaggcggcaccgagagcaccagacaggccacccagctgatcaacgccctgatcaaggaccccgacaaggagatcgacgagctgatccccaagaacagactgaagagcagcagcgccaacagcaagatcggcagcagcgcccccaccaccaccgccgccaacaccagcctgatgggcatcaagatgaccaccgtggccctgagcagcaccagccagaccgccaccgccctgaccgtgcccgccatcagcagcgccagcacccacaagaccatcaagaaccccgtgaacaacgtgagacccggcttccccgtgagcctgcccctggcctacccccccccccagttcgcccacgccctgctggccgcccagaccttccagcagatcagaccccccagactgcccatgacccacttcggcggcaccttcccccccgcccagagcacctggggccccttccccgtgagacccctgagccccgccagagccaccaacagccccaagccccacatggtgcccagacacagcaaccagaacagcagcggcagccaggtgaacagcgccggcagcctgaccagcagccccaccaccaccaccagcagcagcgccagcaccgtgcccggcaccagcaccaacggcagccccagcagccccagcgtgagaagacagctgttcgtgaccgtggtgaagaccagcaacgccaccaccaccaccgtgaccaccaccgccagcaacaacaacaccgcccccaccaacgccacctaccccatgcccaccgccaaggagcactaccccgtgagcagccccagcagccccagcccccccgcccagcccggcggcgtgagcagaaacagccccctggactgcggcagcgccagccccaacaaggtggccagcagcagcgagcaggaggccggcagcccccccgtggtggagaccaccaacaccagaccccccaacagcagcagcagcagcggcagcagcagcgcccacagcaaccagcagcagccccccggcagcgtgagccaggagcccagaccccccctgcagcagagccaggtgcccccccccgaggtgagaatgaccgtgccccccctggccaccagcagcgcccccgtggccgtgcccagcaccgcccccgtgacctaccccatgccccagacccccatgggctgcccccagcccacccccaagatggagacccccgccatcagaccccccccccacggcaccaccgccccccacaagaacagcgccagcgtgcagaacagcagcgtggccgtgctgagcgtgaaccacatcaagagaccccacagcgtgcccagcagcgtgcagctgcccagcaccctgagcacccagagcgcctgccagaacagcgtgcaccccgccaacaagcccatcgcccccaacttcagcgcccccctgcccttcggccccttcagcaccctgttcgagaacagccccaccagcgcccacgccttctggggcggcagcgtggtgagcagccagagcacccccgagagcatgctgagcggcaagagcagctacctgcccaacagcgaccccctgcaccagagcgacaccagcaaggcccccggcttcagaccccccctgcagagacccgcccccagccccagcggcatcgtgaacatggacagcccctacggcagcgtgacccccagcagcacccacctgggcaacttcgccagcaacatcagcggcggccagatgtacggccccggcgcccccctgggcggcgcccccgccgccgccaacttcaacagacagcacttcagccccctgagcctgctgaccccctgcagcagcgccagcaacgacagcagcgcccagagcgtgagcagcggcgtgagagcccccagccccgcccccagcagcgtgcccctgggcagcgagaagcccagcaacgtgagccaggacagaaaggtgcccgtgcccatcggcaccgagagaagcgccagaatcagacagaccggcaccagcgcccccagcgtgatcggcagcaacctgagcaccagcgtgggccacagcggcatctggagcttcgagggcatcggcggcaaccaggacaaggtggactggtgcaaccccggcatgggcaaccccatgatccacagacccatgagcgaccccggcgtgttcagccagcaccaggccatggagagagacagcaccggcatcgtgacccccagcggcaccttccaccagcacgtgcccgccggctacatggacttccccaaggtgggcggcatgcccttcagcgtgtacggcaacgccatgatcccccccgtggcccccatccccgacggcgccggcggccccatcttcaacggcccccacgccgccgaccccagctggaacagcctgatcaagatggtgagcagcagcaccgagaacaacggcccccagaccgtgtggaccggcccctgggccccccacatgaacagcgtgcacatgaaccagctgggctag

SEQ ID NO: 12062 - DNA, 1446 bp, Artificial Sequence
  Description of Artificial Sequence: Synthetic coding sequence
atggccagcgccgccagcgtgaccagcctggccgacgaggtgaactgccccatctgccagggcaccctgagagagcccgtgaccatcgactgcggccacaacttctgcagagcctgcctgaccagatactgcgagatccccggccccgacctggaggagagccccacctgccccctgtgcaaggagcccttcagacccggcagcttcagacccaactggcagctggccaacgtggtggagaacatcgagagactgcagctggtgagcaccctgggcctgggcgaggaggacgtgtgccaggagcacggcgagaagatctacttcttctgcgaggacgacgagatgcagctgtgcgtggtgtgcagagaggccggcgagcacgccacccacaccatgagattcctggaggacgccgccgccccctacagagagcagatccacaagtgcctgaagtgcctgagaaaggagagagaggagatccaggagatccagagcagagagaacaagagaatgcaggtgctgctgacccaggtgagcaccaagagacagcaggtgatcagcgagttcgcccacctgagaaagttcctggaggagcagcagagcatcctgctggcccagctggagagccaggacggcgacatcctgagacagagagacgagttcgacctgctggtggccggcgagatctgcagattcagcgccctgatcgaggagctggaggagaagaacgagagacccgccagagagctgctgaccgacatcagaagcaccctgatcagatgcgagaccagaaagtgcagaaagcccgtggccgtgagccccgagctgggccagagaatcagagacttcccccagcaggccctgcccctgcagagagagatgaagatgttcctggagaagctgtgcttcgagctggactacgagcccgcccacatcagcctggacccccagaccagccaccccaagctgctgctgagcgaggaccaccagagagcccagttcagctacaagtggcagaacagccccgacaacccccagagattcgacagagccacctgcgtgctggcccacaccggcatcaccggcggcagacacacctgggtggtgagcatcgacctggcccacggcggcagctgcaccgtgggcgtggtgagcgaggacgtgcagagaaagggcgagctgagactgagacccgaggagggcgtgtgggccgtgagactggcctggggcttcgtgagcgccctgggcagcttccccaccagactgaccctgaaggagcagcccagacaggtgagagtgagcctggactacgaggtgggctgggtgaccttcaccaacgccgtgaccagagagcccatctacaccttcaccgccagcttcaccagaaaggtgatccccttcttcggcctgtggggcagaggcagcagcttcagcctgagcagctag

SEQ ID NO: 12063 - DNA, 1566 bp, Artificial Sequence
  Description of Artificial Sequence: Synthetic coding sequence
atgcccagcccccagctgctggtgctgttcggcagccagaccggcaccgcccaggacgtgagcgagagactgggcagagaggccagaagaagaagactgggctgcagagtgcaggccctggacagctaccccgtggtgaacctgatcaacgagcccctggtgatcttcgtgtgcgccaccaccggccagggcgacccccccgacaacatgaagaacttctggagattcatcttcagaaagaacctgcccagcaccgccctgtgccagatggacttcgccgtgctgggcctgggcgacagcagctacgccaagttcaacttcgtggccaagaagctgcacagaagactgctgcagctgggcggcagcgccctgctgcccgtgtgcctgggcgacgaccagcacgagctgggcctgcccagcaagttcaccctgctgttcctgcaggaggcccccagcaccggcagcgagggccagagagtggcccaccccggcagccaggagccccccagcgagagcaagcccttcctggcccccatgatcagcaaccagagagtgaccggccccagccacttccaggacgtgagactgatcgagttcgacatcctgggcagcggcatcagcttcgccgccggcgacgtggtgctgatccagcccagcaacagcgccgcccacgtgcagagattctgccaggtgctgggcctggaccccgaccagctgttcatgctgcagcccagagagcccgacgtgagcagccccaccagactgccccagccctgcagcatgagacacctggtgagccactacctggacatcgccagcgtgcccagaagaagcttcttcgagctgctggcctgcctgagcctgcacgagctggagagagagaagctgctggagttcagcagcgcccagggccaggaggagctgttcgagtactgcaacagacccagaagaaccatcctggaggtgctgtgcgacttcccccacaccgccgccgccatcccccccgactacctgctggacctgatccccgtgatcagacccagagccttcagcatcgccagcagcctgctgacccaccccagcagactgcagatcctggtggccgtggtgcagttccagaccagactgaaggagcccagaagaggcctgtgcagcagctggctggccagcctggaccccggccagggccccgtgagagtgcccctgtgggtgagacccggcagcctggccttccccgagacccccgacacccccgtgatcatggtgggccccggcaccggcgtggcccccttcagagccgccatccaggagagagtggcccagggccagaccggcaacttcctgttcttcggctgcagatggagagaccaggacttctactgggaggccgagtggcaggagctggagaagagagactgcctgaccctgatccccgccttcagcagagagcaggagcagaaggtgtacgtgcagcacagactgagagagctgggcagcctggtgtgggagctgctggacagacaggccacccccagcccctgccagagaaccagcagaaagccctag

SEQ ID NO: 12064 - DNA, 753 bp, Artificial Sequence
  Description of Artificial Sequence: Synthetic coding sequence
tgacagcccagccccgtggagcccagaggccccttctacttctgcagactgctgctggacgacctgggcatgaacagctgggacagaagaaagaacttccacctgctgaagaagaacagcaagctgctgagagagctgaagaacctggacagcagacagtgcagagagacccacaagatcgccgtgttctacatcgccgagggccaggaggacaagtgcagcatcctgagcaacgagagaggcagccaggcctacgaggacttcgtggccggcctgggctgggaggtggacctgagcacccactgcggcttcatgggcggcctgcagagaaacggcagcaccggccagaccgccccctactacgccaccagcaccgtggaggtgatcttccacgtgagcaccagaatgcccagcgacagcgacgacagcctgaccaagaagctgagacacctgggcaacgacgaggtgcacatcgtgtggagcgagcacagcagagactacagaagaggcatcatccccaccgccttcggcgacgtgagcatcatcatctaccccatgaagaaccacatgttcttcatcgccatcaccaagaagcccgaggtgcccttcttcggccccctgttcgacggcgccatcgtgagcggcaagctgctgcccagcctggtgtgcgccacctgcatcaacgccagcagagccgtgaagtgcctgatccccctgtaccagagcctgtacctgttcgccctgaacgtgtag

SEQ ID NO: 12065 - DNA, 345 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctgccacagagccgtgctgagcgcctgcagcagctacttcagagccatgttctgcaacgaccacagagagagcagagagatgctggtggagatcaacggcatcctggcctag

SEQ ID NO: 12066 - DNA, 1830 bp, Artificial Sequence
  Description of Artificial Sequence: Synthetic coding sequence
atggccagcctgagcagagccctgagagtggccgccgcccaccccagacagagccccaccagaggcatgggcccctgcaacctgagcagcgccgccggccccaccgccgagaagagcgtgccctaccagagaaccctgaaggagggccagggcaccagcgtggtggcccagggccccagcagacccctgcccagcaccgccaacgtggtggtgatcggcggcggcagcctgggctgccagaccctgtaccacctggccaagctgggcatgagcggcgccgtgctgctggagagagagagactgaccagcggcaccacctggcacaccgccggcctgctgtggcagctgagacccagcgacgtggaggtggagctgctggcccacaccagaagagtggtgagcagagagctggaggaggagaccggcctgcacaccggctggatccagaacggcggcctgttcatcgccagcaacagacagagactggacgagtacaagagactgatgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagaacatgcccaacgtgagagaccacgacgccagcgtgtacctgagactgcagggcgacgccctgagcgtgggcggctacgaggccaaccccatcttctgggaggaggtgagcgacaagttcgccttcggcctgttcgacctggactgggaggtgttcacccagcacatcgagggcgccatcaacagagtgcccgtgctggagaagaccggcatcaagagcaccgtgtgcggccccgagagcttcacccccgaccacaagcccctgatgggcgaggcccccgagctgagaggcttcttcctgggctgcggcttcaacagcgccggcatgatgctgggcggcggctgcggccaggagctggcccactggatcatccacggcagacccgagaaggacatgcacggctacgacatcagaagattccaccacagcctgaccgaccaccccagatggatcagagagagaagccacgagagctacgccaagaactacagcgtggtgttcccccacgacgagcccctggccggcagaaacatgagaagagaccccctgcacgaggagctgctgggccagggctgcgtgttccaggagagacacggctgggagagacccggctggttccaccccagaggccccgcccccgtgctggagtacgactactacggcgcctacggcagcagagcccacgaggactacgcctacagaagactgctggccgacgagtacaccttcgccttccccccccaccacgacaccatcaagaaggagtgcctggcctgcagaggcgccgccgccgtgttcgacatgagctacttcggcaagttctacctggtgggcctggacgccagaaaggccgccgactggctgttcagcgccgacgtgagcagaccccccggcctgcacagagtgcacgtgtag

SEQ ID NO: 12067 - DNA, 129 bp, Artificial Sequence
  Description of Artificial Sequence: Synthetic coding sequence
atggacaacatgagccccagactgagagccttcctgagcgagcccatcggcgagaaggacgtgtgctgggtggacggcatcagccacgagctggccatcaacctggtgaccaagggcatcaacaagtag

SEQ ID NO: 12068 - DNA, 3120 bp, Artificial Sequence
  Description of Artificial Sequence: Synthetic coding sequence
atggtgagcagcgcccagatgggcttcaacctgcaggccctgctggagcagctgagccaggacgagctgagcaagttcaagtacctgatcaccaccttcagcctggcccacgagctgcagaagatcccccacaaggagatggccagcctgcaggtgttcgagaagatgcacagaatggacctgagcgagagagccaaggacgaggtgagagaggccgccctgaagagcttcaacaagagaaagcccctgagcctgggcatcaccagaaaggagagaccccccctggacgtggacgagatgctggagagattcaagaccgaggcccaggccttcaccgagaccaagggcaacgtgatctgcctgggcaaggaggtgttcaagggcaagaagcccgacaaggacaacagatgcagatacatcctgaagaccaagttcagagagatgtggaagagctggcccggcgacagcaaggaggtgcaggtgatggccgagagatacaagatgctgatccccttcagcaaccccagagtgctgcccggccccttcagctacaccgtggtgctgtacggccccgccggcctgggcaagaccaccctggcccagaagctgatgctggactgggccgaggacaacctgatccacaagttcaagtacgccttctacctgagctgcagagagctgagcagactgggcccctgcagcttcgccgagctggtgttcagagactggcccgagctgcaggacgacatcccccacatcctggcccaggccagaaagatcctgttcgtgatcgacggcttcgacgagctgggcgccgcccccggcgccctgatcgaggacatctgcggcgactgggagaagaagaagcccgtgcccgtgctgctgggcagcctgctgaacagagtgatgctgcccaaggccgccctgctggtgaccaccagacccagagccctgagagacctgagaatcctggccgaggagcccatctacatcagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagaccagcgtgctgcacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacaccctggagaaggaggaggaggaggacagagacggccacacctgggacatcggcgacgtgcagaagctgctgagcggcgtggagagactgagaaaccccgacctgatccaggccggctactacagcttcggcctggccaacgagaagagagccaaggagctggaggccaccttcggctgcagaatgagccccgacatcaagcaggagctgctgagatgcgacatcagctgcaagggcggccacagcaccgtgaccgacctgcaggagctgctgggctgcctgtacgagagccaggaggaggagctggtgaaggaggtgatggcccagttcaaggagatcagcctgcacctgaacgccgtggacgtggtgcccagcagcttctgcgtgaagcactgcagaaacctgcagaagatgagcctgcaggtgatcaaggagaacctgcccgagaacgtgaccgccagcgagagcgacgccgaggtggagagaagccaggacgaccagcacatgctgcccttctggaccgacctgtgcagcatcttcggcagcaacaaggacctgatgggcctggccatcaacgacagcttcctgagcgccagcctggtgagaatcctgtgcgagcagatcgccagcgacacctgccacctgcagagagtggtgttcaagaacatcagccccgccgacgcccacagaaacctgtgcctggccctgagaggccacaagaccgtgacctacctgaccctgcagggcaacgaccaggacgacatgttccccgccctgtgcgaggtgctgagacaccccgagtgcaacctgagatacctgggcctggtgagctgcagcgccaccacccagcagtgggccgacctgagcctggccctggaggtgaaccagagcctgacctgcgtgaacctgagcgacaacgagctgctggacgagggcgccaagctgctgtacaccaccctgagacaccccaagtgcttcctgcagagactgagcctggagaactgccacctgaccgaggccaactgcaaggacctggccgccgtgctggtggtgagcagagagctgacccacctgtgcctggccaagaaccccatcggcaacaccggcgtgaagttcctgtgcgagggcctgagataccccgagtgcaagctgcagaccctggtgctgtggaactgcgacatcaccagcgacggctgctgcgacctgaccaagctgctgcaggagaagagcagcctgctgtgcctggacctgggcctgaaccacatcggcgtgaagggcatgaagttcctgtgcgaggccctgagaaagcccctgtgcaacctgagatgcctgtggctgtggggctgcagcatcccccccttcagctgcgaggacctgtgcagcgccctgagctgcaaccagagcctggtgaccctggacctgggccagaaccccctgggcagcagcggcgtgaagatgctgttcgagaccctgacctgcagcagcggcaccctgagaaccctgagactgaagatcgacgacttcaacgacgagctgaacaagctgctggaggagatcgaggagaagaacccccagctgatcatcgacaccgagaagcaccacccctgggccgagagacccagcagccacgacttcatgatctag

SEQ ID NO: 12069 - DNA, 1899 bp, Artificial Sequence; identical to SEQ ID NO: 9855
  Description of Artificial Sequence: Synthetic coding sequence

SEQ ID NO: 12070 - DNA, 189 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggcctag

SEQ ID NO: 12071 - DNA, 417 bp, Artificial Sequence
  Description of Artificial Sequence: Synthetic coding sequence
atggagcccagcgcccagcagctgcagctggccgccagcctgcccgccaacctgagcaacttctgccagggcagcgagatgcccaccaccagcagacccgccctggacgtgaagggcggcaccagccccgccaaggaggacgccaaccaggagatgagcagcgtggcctacagcaacctggccgtgaaggacagaaaggccgtggccatcctgcactaccccggcgtggccagcaacggcaccaaggccagcggcgcccccaccagcagcagcggcagccccatcggcagccccaccaccaccccccccaccaagccccccagcttcaacctgcaccccgccccccacctgctggccagcatgcacctgcagaagctgaacagccagtaccagggcatggccgccgccaccccctag

SEQ ID NO: 12072 - DNA, 1473 bp, Artificial Sequence; identical to SEQ ID NO: 9885
  Description of Artificial Sequence: Synthetic coding sequence

SEQ ID NO: 12073 - DNA, 357 bp, Artificial Sequence
  Description of Artificial Sequence: Synthetic coding sequence
atggccagcagcgccagagagcacctgctgttcgtgagaagaagaaacccccagatgagatacaccctgagccccgagaacctgcagagcctggccgcccagagcagcatgcccgagaacatgaccctgcagagagccaacagcgacaccgacctggtgaccagcgagagcagaagcagcctgaccgccagcatgtacgagtacaccctgggccaggcccagaacctgatcatcttctgggacatcaaggaggaggtggaccccagcgactggatcggcctgtaccacatcgacgagaacagccccgccaacttctgggacagcaagaacagaggcgtgaccggcacccagaagtag

SEQ ID NO: 12074 - DNA, 1620 bp, Artificial Sequence; identical to SEQ ID NO: 10018
  Description of Artificial Sequence: Synthetic coding sequence

SEQ ID NO: 12075 - DNA, 270 bp, Artificial Sequence; identical to SEQ ID NO: 11466
  Description of Artificial Sequence: Synthetic coding sequence

SEQ ID NO: 12076 - DNA, 909 bp, Artificial Sequence; identical to SEQ ID NO: 9334
  Description of Artificial Sequence: Synthetic coding sequence

SEQ ID NO: 12077 - DNA, 1521 bp, Artificial Sequence
  Description of Artificial Sequence: Synthetic coding sequence
atgagcgtgctgagccccggcgacctgaagcccaagagaggcagcccccacagaggcagcctggacagaaccgacgccagcaccgacctggccatgagaagctggcccagcgagctgggcagcagaacctgcagcaccagcgccaccaccaccgcccccagcaacagcacccccatcgccagacaccccggcagaaccaagggctacaacagcgacgacaacctgtgcgagcccagcctggagttcgaggtgcccaaccacagacagtacgtgagcagacccagcagcctggagagcagcagaaacaccagcagcaacagcagccccctgaacctgaagggcagcagcgagcagctgcacggcagaagcgagagcttcagcagcgaggacctgatccccagcagagacctggccaccctgcccagagaggccagcacccccggcagaaacgccctgggcagacacgagtaccccctgcccagaaacggccccctgccccaggagggcgcccagaagagaggcaccgcccccccctacgtgggcgtgagaccctgcagcgccagccccagcagcgagatggtgaccctggaggagttcctggaggagagcaacagaagcagccccacccacgacacccccagctgcagagacgacctgctgagcgactacttcagaaaggccagcgacccccccgccatcggcggccagcccggcccccccgccaagaaggagggcgccaagatgcccaccaacttcgtggcccccaccgtgaagatggccgcccccaccagcgagggcagacccctgaagcccggccagtacgtgaagcccaacttcagactgaccgaggccgaggccccccccagcgtggcccccagacaggcccagcccccccagagcctgagcctgggcagacccagacaggcccccgaggccctgggcggcagagagaccggcagccacaccctgcagagccccgccccccccagcagccacagcctggccagagagagaacccccctggtgggcaaggccggcagcagctgccagggccccggccccagaagcagacccctggacaccagaagattcagcctggccccccccaaggaggagagactggcccccctgcaccagagcgccaccgcccccgccatcgccaccgccggcgccggcgccgccgccgccggcagcggcagcaacagccagctgctgcacttcagccccgccgccgcccccgccgccagaaccaagcccaaggccccccccagaagcggcgaggtggccaccatcacccccgtgagagccggcctgagcctgagcgagggcgacggcgtgcccggccagggctgcagcgagggcctgcccgccaagagccccggcagaagccccgacctggccccccacctgggcagagccctggaggactgcagcagaggcagcgtgagcaagagcagccccgccagccccgagcccggcggcgacccccagaccgtgtggtacgagtacggctgcgtgtag

SEQ ID NO: 12078 - DNA, 678 bp, Artificial Sequence
  Description of Artificial Sequence: Synthetic coding sequence
atggcccagaccgtgcccccctgcgagctgccctgcaaggagtacgacgtggccagaaacaccggcgcctacaccagcagcggcctggccaccgccagcttcagaaccagcaagtacctgctggaggagtggttccagaactgctacgccagataccaccaggccttcgccgacagagaccagagcgagagacagagacacgagagccagcagctggccaccgagacccaggccctggcccagagaacccagcaggacagcaccagaaccgtgggcgagagactgcaggacacccacagctggaagagcgagctgcagagagagatggaggccctggccgccgagaccaacctgctgctggcccagaagcagagactggagagagccctggacgccaccgaggtgcccttcagcatcaccaccgacaacctgcagtgcagagagagaagagagcaccccaacctggtgagagaccacgtggagaccgagctgctgaaggccctgccccccgccctgagccagtgcctgaagaacagctgcagcagcagaaagctgagcgccagaaacaagggcacctgccagctgatggagaccctgaccgtgcacggcgaggccaaccccggcatcgagggcagaagaaccagagccctggcccacaaggaggtgcccagcggctag

SEQ ID NO: 12079 - DNA, 309 bp, Artificial Sequence
  Description of Artificial Sequence: Synthetic coding sequence
atggccaacgacagccccgccaagagcctggtggacatcgacctgagcagcctgagagaccccgccggcatcttcgagctggtggaggtggtgggcaacggcacctacggccaggtgtacaagggcagacacgtgaagaccggccagctggccgccatcaaggtgatggacgtgaccgaggacgaggaggaggagatcaagctggagatcaacatgctgaagaagtacagccaccacagaaacatcgccacctactacggcgccttcatcaagaagagcccccccggccacgacgaccagctgtggtag

SEQ ID NO: 12080 - DNA, 369 bp, Artificial Sequence
  Description of Artificial Sequence: Synthetic coding sequence
atggccaccagcgcccccctgagaagcctggaggaggaggtgacctgcagcatctgcctggactacctgagagaccccgtgaccatcgactgcggccacgtgttctgcagaagctgcaccaccgacgtgagacccatcagcggcagcagacccgtgtgccccctgtgcaagaagcccttcaagaaggagaacatcagacccgtgtggcagctggccagcctggtggagaacatcgagagactgaaggtggacaagggcagacagcccggcgaggtgaccagagagcagcaggacgccaagctgtgcgagagacacagagagaagctgcactactactgcgaggacgacggcaagctgctgtgcgtgtag

SEQ ID NO: 12081 - DNA, 312 bp, Artificial Sequence
  Description of Artificial Sequence: Synthetic coding sequence
atgagcggcggcctgctgaaggccctgagaagcgacagctacgtggagctgagccagtacagagaccagcacttcagaggcgacaacgaggagcaggagaagctgctgaagaagagctacgccgagaacgccatgagatacatcaacggcaccagactggacgacagaatcatcagaaccgactgggacgccggcttcaaggagggcagacagtacggcagaggcagaagcggcggccaggtgagagacgagtacagacaggactacgacgccggcagaggcggctacggcaagctggcccagaaccagtag

SEQ ID NO: 12082 - DNA, 894 bp, Artificial Sequence
  Description of Artificial Sequence: Synthetic coding sequence
atgtggcccttccccagcagaagcctgttccccccccccacccaggcctggctgcagaccgtgagcagcgaccccgaggcccagggctggggcgcctggaacgagaccaaggagatcctgggccccgagggcggcgagggcaaggaggagaaggaggaggaggaggacgccgaggaggaccaggacggcgacgccggcttcctgctgagcctgctggagcaggagaacctggccgagtgccccctgcccgaccaggagctggaggccatcaagatgaaggtgtgcgccatggagcaggccgagggcacccccagaccccccggcgtgcagcagcaggccgaggaggaggagggcaccgccgccggccagctgctgagccccgagaccgtgggctgccccctgagcggcacccccgaggagaaggtggaggccgaccacagaagcgtgtacgtgggcaacctgtgcctgcacagagtgtgccaccagggcctgagagccggcagaagaggcgccggccccgagcccctgcccggccccggccaccagggcgccgccgagaagaaccagctgccctgggaccagctgcacagacccagaggccccagcagaacccccagactgcagggcggcaccctgcccccccagagaccccccggccaggcccccgcccagaccaccagagccgagcccggcccctggaagatcctgaccatggtgttcaccgtgctgaagggcagacccgacttcgagagaggcgccggcgcctggatcagaagcaagcccctggtgctgcaccccggcgccggcgccggcagcggcgccggcgccagacccgaggagagaggcgtgcagagcagccactggccccccctgggcggcggcatggcccagtag

SEQ ID NO: 12083 - DNA, 1059 bp, Artificial Sequence; identical to SEQ ID NO: 11224
  Description of Artificial Sequence: Synthetic coding sequence

SEQ ID NO: 12084 - DNA, 363 bp, Artificial Sequence
  Description of Artificial Sequence: Synthetic coding sequence
atggagctggacctgttcctgggcctggacgacgtgttccccagactgctgcacggcctgctgcacagagccttcagcgtgttcctgttcaacaccgagaacaagctgctgctgcagcagagaagcgacgccaagatcaccttccccggctgcttcaccaacacctgctgcagccaccccctgagcaaccccgccgagctggaggagagcgacgccctgggcgtgagaagagccgcccagagaagactgaaggccgagctgggcatccccctggaggaggtgaccagcagccccacccagccctacaagctgaagcccaagcacaccatcaagagattcctgatcaagttcctgaacagctag

SEQ ID NO: 12085 - DNA, 339 bp, Artificial Sequence
  Description of Artificial Sequence: Synthetic coding sequence
atggaggagatccccgcccaggaggccgccggcagccccagagtgcagttccagagcctggagacccagagcgagtgcctgagccccgagccccagttcgtgcaggacaccgacatggagcagggcctgaccggcggcttccccatcagcaagcccgacggcatcagccagctggagcaggacctgcaggtgttcgacctggagaccaagaccagagaggtgctgagagacgactgcagcgacggcgagaccagagaggagaacaagctgctgatccccaagcagaagatcagcgaggaggtgcacagctacaaggtgagagtgggcagactgaagtag

SEQ ID NO: 12086 - DNA, 1818 bp, Artificial Sequence
  Description of Artificial Sequence: Synthetic coding sequence
atgagcgagatcctgaagcagaaggacaccgagcccaccaacttcaaggtggccgccggcaccctggacgccagcaccaagatctacgccgtgagagtggacgccgtgcacgccgacgtgtacagagtgctgggcggcctgggcaaggacgcccccagcctggaggaggtggagggccacgtggccgacggcagcgccaccgagatgggcaccaccaagaaggccgtgaagcccaagaagaagcacctgcacagaaccatcgagcagaacatcaacaacctgaacgtgagcgaggccgacagaaagtgcgagatcgaccccatgttccagaagaccgccgccagcttcgacgagtgcagcaccgccggcgtgttcctgagcaccctgcactgccaggactacagaagcgagctgctgttccccagcgacgtgcagaccctgagcaccggcgagcccctggagctgcccgagctgggctgcgtggagatgaccgacctgaaggcccccctgcagcagtgcgccgaggacagacagatctgccccagcctggccggcttccagttcacccagtgggacagcgagacccacaacgagagcgtgagcgccctggtggacaagttcaagaagaacgaccaggtgttcgacatcaacgccgaggtggacgagagcgactgcggcgacttccccgacggcagcctgggcgacgacttcgacgccaacgacgagcccgaccacaccgccgtgggcgaccacgaggagttcagaagctggaaggagccctgccaggtgcagagctgccaggaggagatgatcagcctgggcgacggcgacatcagaaccatgtgccccctgctgagcatgaagcccggcgagtacagctacttcagccccagaaccatgagcatgtgggccggccccgaccactggagattcagacccagaagaaagcaggacgcccccagccagagcgagaacaagaagaagagcaccaagaaggacttcgagatcgacttcgaggacgacatcgacttcgacgtgtacttcagaaagaccaaggccgccaccatcctgaccaagagcaccctggagaaccagaactggagagccaccaccctgcccaccgacttcaactacaacgtggacaccctggtgcagctgcacctgaagcccggcaccagactgctgaagatggcccagggccacagagtggagaccgagcactacgaggagatcgaggactacgactacaacaaccccaacgacaccagcaacttctgccccggcctgcaggccgccgacagcgacgacgaggacctggacgacctgttcgtgggccccgtgggcaacagcgacctgagcccctacccctgccacccccccaagaccgcccagcagaacggcgacacccccgaggcccagggcctggacatcaccacctacggcgagagcaacctggtggccgagccccagaaggtgaacaagatcgagatccactacgccaagaccgccaagaagatggacatgaagaagctgaagcagagcatgtggagcctgctgaccgccctgagcggcaaggaggccgacgccgaggccaaccacagagaggccggcaaggaggccgccctggccgaggtggccgacgagaagatgctgagcggcctgaccaaggacctgcagagaagcctgccccccgtgatggcccagaacctgagcatccccctggccttcgcctgcctgctgcacctggccaacgagaagaacctgaagctggagggcaccgaggacctgagcgacgtgctggtgagacagggcgactag

SEQ ID NO: 12087 - DNA, 2253 bp, Artificial Sequence
  Description of Artificial Sequence: Synthetic coding sequence
atgagcagcagccccgtgaacgtgaagaagctgaaggtgagcgagctgaaggaggagctgaagaagagaagactgagcgacaagggcctgaaggccgagctgatggagagactgcaggccgccctggacgacgaggaggccggcggcagacccgccatggagcccggcaacggcgacgaccagggcttccaggagggcgaggacgagctgggcgacgaggaggagggcgccggcgacgagaacggccacggcgagcagcagccccagccccccgccacccagcagcagcagccccagcagcagagaggcgccgccaaggaggccgccggcaagagcagcggccccaccagcctgttcgccgtgaccgtggccccccccggcgccagacagggccagcagcaggccggcggcaagaagaaggccgagggcggcggcggcggcggcagacccggcgcccccgccgccggcgacggcaagaccgagcagaagggcggcgacaagaagagaggcgtgaagagacccagagaggaccacggcagaggctacttcgagtacatcgaggagaacaagtacagcagagccaagagcccccagccccccgtggaggaggaggacgagcacttcgacgacaccgtggtgtgcctggacacctacaactgcgacctgcacttcaagatcagcagagacagactgagcgccagcagcctgaccatggagagcttcgccttcctgtgggccggcggcagagccagctacggcgtgagcaagggcaaggtgtgcttcgagatgaaggtgaccgagaagatccccgtgagacacctgtacaccaaggacatcgacatccacgaggtgagaatcggctggagcctgaccaccagcggcatgctgctgggcgaggaggagttcagctacggctacagcctgaagggcatcaagacctgcaactgcgagaccgaggactacggcgagaagttcgacgagaacgacgtgatcacctgcttcgccaacttcgagagcgacgaggtggagctgagctacgccaagaacggccaggacctgggcgtggccttcaagatcagcaaggaggtgctggccggcagacccctgttcccccacgtgctgtgccacaactgcgccgtggagttcaacttcggccagaaggagaagccctacttccccatccccgaggagtacaccttcatccagaacgtgcccctggaggacagagtgagaggccccaagggccccgaggagaagaaggactgcgaggtggtgatgatgatcggcctgcccggcgccggcaagaccacctgggtgaccaagcacgccgccgagaaccccggcaagtacaacatcctgggcaccaacaccatcatggacaagatgatggtggccggcttcaagaagcagatggccgacaccggcaagctgaacaccctgctgcagagagccccccagtgcctgggcaagttcatcgagatcgccgccagaaagaagagaaacttcatcctggaccagaccaacgtgagcgccgccgcccagagaagaaagatgtgcctgttcgccggcttccagagaaaggccgtggtggtgtgccccaaggacgaggactacaagcagagaacccagaagaaggccgaggtggagggcaaggacctgcccgagcacgccgtgctgaagatgaagggcaacttcaccctgcccgaggtggccgagtgcttcgacgagatcacctacgtggagctgcagaaggaggaggcccagaagctgctggagcagtacaaggaggagagcaagaaggccctgccccccgagaagaagcagaacaccggcagcaagaagagcaacaagaacaagagcggcaagaaccagttcaacagaggcggcggccacagaggcagaggcggcttcaacatgagaggcggcaacttcagaggcggcgcccccggcaacagaggcggctacaacagaagaggcaacatgccccagagaggcggcggcggcggcggcagcggcggcatcggctacccctaccccagagcccccgtgttccccggcagaggcagctacagcaacagaggcaactacaacagaggcggcatgcccaacagaggcaactacaaccagaacttcagaggcagaggcaacaacagaggctacaagaaccagagccagggctacaaccagtggcagcagggccagttctggggccagaagccctggagccagcactaccaccagggctactactag

SEQ ID NO: 12088 - DNA, 804 bp, Artificial Sequence
  Description of Artificial Sequence: Synthetic coding sequence
atgtgggaccagagactggtgaagctggccctgctgcagcacctgagagccttctacggcatcaaggtgaagggcgtgagaggccagtgcgacagaagaagacacgagaccgccgccaccgagatcggcggcaagatcttcggcgtgcccttcaacgccctgccccacagcgccgtgcccgagtacggccacatccccagcttcctggtggacgcctgcaccagcctggaggagcacatccacaccgagggcctgttcagaaagagcggcagcgtgatcagactgaaggccctgaagaacaaggtggaccacggcgagggctgcctgagcagcgcccccccctgcgacatcgccggcctgctgaagcagttcttcagagagctgcccgagcccatcctgcccgccgacctgcacgaggccctgctgaaggcccagcagctgggcaccgaggagaagaacaaggccatcctgctgctgagctgcctgctggccgaccacaccgtgcacgtgctgagatacttcttcaacttcctgagaaacgtgagcctgagaagcagcgagaacaagatggacagcagcaacctggccgtgatcttcgcccccaacctgctgcagaccagcgagggccacgagaagatgagcagcaacgccgagaagaagggcgtgtaccagaccctgagctggaagagataccagccctgctgggtgctgatggtgagcgtgctgctgcaccactggaaggccctgaagaaggtgaacatgaagctgctggtgaacatcagagagagagaggacaacgtgtag

SEQ ID NO: 12089 - DNA, 600 bp, Artificial Sequence
  Description of Artificial Sequence: Synthetic coding sequence
atgccccacaagatcggcttcgtggtggtgagcagcagcggccacgaggacggcttcagcgccagagagctgatgatccacgcccccaccgtgagcggctggagaagccccagctacgtgagcctgtgcgacaacgagaagaccggctgcaaggccagagagctgaagagcgtgtacgtggacgccgtgggccagttcctgaagctgatcttccaccagaaccacgtgaacaagtacaacatctacaaccaggtggccctggtggccatcaacatcatcggcgaccccgccgacttcagcgacgagagcaacaccgccagcagagagaagctgatcgaccactacctgggccacaacagcgaggaccccgccctggagggcacctacgccagaaagagcgactacatcagccccctggacgacctggccttcgacatgtaccaggaccccgaggtggcccagatcatcagaaagctggacgagagaaagagagaggccgtgcagaaggagagatacgactacgccaagaagctgaagcaggccatcgccgacctgcagaaggtgggcgagagactgggcagatacgaggtggagaagtag

SEQ ID NO: 12090 - DNA, 471 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactggacaccgagaagctgtgcaccttcagccagagattccccctgcccagcatgtacagagccctggtgtggaaggtgctgctgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagatag

SEQ ID NO: 12091 - DNA, 2730 bp, Artificial Sequence
  Description of Artificial Sequence: Synthetic coding sequence
atgatcagacacgccggcgcccccgccagaggcgaccccaccggccccgtgcccgtggtgggcaagggcgaggaggaggaggaggaggacggcatgagactgtgcctgcccgccaaccccaagaactgcctgccccacagaagaggcatcagcatcctggagaagctgatcaagacctgccccgtgtggctgcagctgagcctgggccaggccgaggtggccagaatcctgcacagagtggtggccggcatgttcctggtgagaagagacagcagcagcaagcagctggtgctgtgcgtgcacttccccagcctgaacgagagcagcgccgaggtgctggagtacaccatcaaggaggagaagagcatcctgtacctggagggcagcgccctggtgttcgaggacatcttcagactgatcgccttctactgcgtgagcagagacctgctgcccttcaccctgagactgccccaggccatcctggaggccagcagcttcaccgacctggagaccatcgccaacctgggcctgggcttctgggacagcagcctgaaccccccccaggagagaggcaagcccgccgagccccccagagacagagcccccggcttccccctggtgagcagcctgagacccaccgcccacgacgccaactgcgcctgcgagatcgagctgagcgtgggcaacgacagactgtggttcgtgaaccccatcttcatcgaggactgcagcagcgccctgcccaccgaccagccccccctgggcaactgccccgccagacccctgccccccaccagcgacgccaccagccccaccagcagatgggcccccagaagaccccccccccccccccccgtgctgcccctgcagccctgcagccccgcccagcccccccccctgcccgccaagaagaacctgcccaccgccccccccagaagaagagtgagcgagagagtgagcctggaggaccagagccccggcatggccgccgagggcgaccagctgagcctgcccccccagggcaccagcgacggccccgaggacacccccagagagagcaccgagcagggccaggacaccgaggtgaaggccagcgacccccacagcatgcccgagctgcccagaaccgccaagcagccccccgtgcccccccccagaaagaagagaatcagcagacagctggccagcaccctgcccgcccccctggagaacgccgagctgtgcacccaggccatggccctggagacccccacccccggcccccccagagagggccagagccccgccagccaggccggcacccagcacccccccgcccaggccaccgcccacagccagagcagccccgagttcaagggcagcctggccagcctgagcgacagcctgggcgtgagcgtgatggccaccgaccaggacagctacagcaccagcagcaccgaggaggagctggagcagttcagcagccccagcgtgaagaagaagcccagcatgatcctgggcaaggccagacacagactgagcttcgccagcttcagcagcatgttccacgccttcctgagcaacaacagaaagctgtacaagaaggtggtggagctggcccaggacaagggcagctacttcggcagcctggtgcaggactacaaggtgtacagcctggagatgatggccagacagaccagcagcaccgagatgctgcaggagatcagaaccatgatgacccagctgaagagctacctgctgcagagcaccgagctgaaggccctggtggaccccgccctgcacagcgaggaggagctggaggccatcgtggagagcgccctgtacaagtgcgtgctgaagcccctgaaggaggccatcaacagctgcctgcaccagatccacagcaaggacggcagcctgcagcagctgaaggagaaccagctggtgatcctggccaccaccaccaccgacctgggcgtgaccaccagcgtgcccgaggtgcccatgatggagaagatcctgcagaagttcaccagcatgcacaaggcctacagccccgagaagaagatcagcatcctgctgaagacctgcaagctgatctacgacagcatggccctgggcaaccccggcaagccctacggcgccgacgacttcctgcccgtgctgatgtacgtgctggccagaagcaacctgaccgagatgctgctgaacgtggagtacatgatggagctgatggaccccgccctgcagctgggcgagggcagctactacctgaccaccacctacggcgccctggagcacatcaagagctacgacaagatcaccgtgaccagacagctgagcgtggaggtgcaggacagcatccacagatgggagagaagaagaaccctgaacaaggccagagccagcagaagcagcgtgcaggacttcatctgcgtgagctacctggagcccgagcagcaggccagaaccctggccagcagagccgacacccaggcccaggccctgtgcgcccagtgcgccgagaagttcgccgtggagagaccccaggcccacagactgttcgtgctggtggacggcagatgcttccagctggccgacgacgccctgccccactgcatcaagggctacctgctgagaagcgagcccaagagagacttccacttcgtgtacagacccctggacggcggcggcggcggcggcggcggcagccccccctgcctggtggtgagagagcccaacttcctgtag

SEQ ID NO: 12092 - DNA, 1728 bp, Artificial Sequence
  Description of Artificial Sequence: Synthetic coding sequence
atgagcagcgacgaggagaagtacagcctgcccgtggtgcagaacgacagcagcagaggcagcagcgtgagcagcaacctgcaggaggagtacgaggagctgctgcactacgccatcgtgacccccaacatcgagccctgcgccagccagagcagccaccccaagggcgagctggtgcccgacgtgagaatcagcaccatccacgacatcctgcacagccagggcaacaacagcgaggtgagagagaccgccatcgaggtgggcaagggctgcgacttccacatcagcagccacagcaagaccgacgagagcagccccgtgctgagccccagaaagcccagccaccccgtgatggacttcttcagcagccacctgctggccgacagcagcagccccgccaccaacagcagccacaccgacgcccacgagatcctggtgagcgacttcctggtgagcgacgagaacctgcagaagatggagaacgtgctggacctgtggagcagcggcctgaagaccaacatcatcagcgagctgagcaagtggagactgaacttcatcgactggcacagaatggagatgagaaaggagaaggagaagcacgccgcccacctgaagcagctgtgcaaccagatcaacgagctgaaggagctgcagaagaccttcgagatcagcatcggcagaaaggacgaggtgatcagcagcctgagccacgccatcggcaagcagaaggagaagatcgagctgatgagaaccttcttccactggagaatcggccacgtgagagccagacaggacgtgtacgagggcaagctggccgaccagtactaccagagaaccctgctgaagaaggtgtggaaggtgtggagaagcgtggtgcagaagcagtggaaggacgtggtggagagagcctgccaggccagagccgaggaggtgtgcatccagatcagcaacgactacgaggccaaggtggccatgctgagcggcgccctggagaacgccaaggccgagatccagagaatgcagcacgagaaggagcacttcgaggacagcatgaagaaggccttcatgagaggcgtgtgcgccctgaacctggaggccatgaccatcttccagaacagaaacgacgccggcatcgacagcaccaacaacaagaaggaggagtacggccccggcgtgcagggcaaggagcacagcgcccacctggaccccagcgccccccccatgcccctgcccgtgaccagccccctgctgcccagcccccccgccgccgtgggcggcgccagcgccaccgccgtgcccagcgccgccagcatgaccagcaccagagccgccagcgccagcagcgtgcacgtgcccgtgagcgccctgggcgccggcagcgccgccaccgccgccagcgaggagatgtacgtgcccagagtggtgaccagcgcccagcagaaggccggcagaaccatcaccgccagaatcaccggcagatgcgacttcgccagcaagaacagaatcagcagcagcctggccatcatgggcgtgagcccccccatgagcagcgtggtggtggagaagcaccaccccgtgaccgtgcagaccatcccccaggccaccgccgccaagtaccccagaaccatccaccccgagagcagcaccagcgccagcagaagcctgggcaccagaagcgcccacacccagagcctgaccagcgtgcacagcatcaaggtggtggactag

SEQ ID NO: 12093 - DNA, 2091 bp, Artificial Sequence
  Description of Artificial Sequence: Synthetic coding sequence
atggccaactacagaaacaccagcgagatccccctggtgctggtgggcacccaggacgccatcagcagcgccaaccccagagtgatcgacgacgccagagccagaaagctgagcaacgacctgaagagatgcacctactacgagacctgcgccacctacggcctgaacgtggagagagtgttccaggacgtggcccagaagatcgtggccaccagaaagaagcagcagctgagcatcggcccctgcaagagcctgcccaacagccccagccacagcagcgtgtgcagcgcccaggtgagcgccgtgcacatcagccagaccagcaacggcggcggcagcctgagcgactacagcagcagcgtgcccagcacccccagcaccagccagaaggagctgagaatcgacgtgccccccaccgccaacacccccacccccgtgagaaagcagagcaagagaagaagcaacctgttcaccagcagaaagggcagcgaccccgacaaggagaagaagggcctggagagcagagccgacagcatcggcagcggcagagccatccccatcaagcagggcatgctgctgaagagaagcggcaagagcctgaacaaggagtggaagaagaagtacgtgaccctgtgcgacaacggcgtgctgacctaccaccccagcctgcacgactacatgcagaacgtgcacggcaaggagatcgacctgctgagaaccaccgtgaaggtgcccggcaagagaccccccagagccaccagcgcctgcgcccccatcagcagccccaagaccaacggcctgagcaaggacatgagcagcctgcacatcagccccaacagcggcaacgtgaccagcgccagcggcagccagatggccagcggcatcagcctggtgagcttcaacagcagacccgacggcatgcaccagagaagctacagcgtgagcagcgccgaccagtggagcgaggccaccgtgatcgccaacagcgccatcagcagcgacaccggcctgggcgacagcgtgtgcagcagccccagcatcagcagcaccaccagccccaagctggaccccccccccagcccccacgccaacagaaagaagcacagaagaaagaagagcaccagcaacttcaaggccgacggcctgagcggcaccgccgaggagcaggaggagaacttcgagttcatcatcgtgagcctgaccggccagacctggcacttcgaggccaccacctacgaggagagagacgcctgggtgcaggccatcgagagccagatcctggccagcctgcagagctgcgagagcagcaagaacaagagcagactgaccagccagagcgaggccatggccctgcagagcatcagaaacatgagaggcaacagccactgcgtggactgcgagacccagaaccccaactgggccagcctgaacctgggcgccctgatgtgcatcgagtgcagcggcatccacagaaacctgggcacccacctgagcagagtgagaagcctggacctggacgactggcccgtggagctgatcaaggtgatgagcagcatcggcaacgagctggccaacagcgtgtgggaggagagcagccagggcagaaccaagcccagcgtggacagcaccagagaggagaaggagagatggatcagagccaagtacgagcagaagctgttcctggcccccctgccctgcaccgagctgagcctgggccagcacctgctgagagccaccgccgacgaggacctgagaaccgccatcctgctgctggcccacggcagcagagacgaggtgaacgagacctgcggcgagggcgacggcagaaccgccctgcacctggcctgcagaaagggcaacgtggtgctggcccagctgctgatctggtacggcgtggacgtgaccgccagagacgcccacggcaacaccgccctggcctacgccagacaggccagcagccaggagtgcatcgacgtgctgctgcagtacggctgccccgacgagagattcgtgctgatggccacccccaacctgagcagaagaaacaacaacagaaacaacagcagcggcagagtgcccaccatcatctag

SEQ ID NO: 12094 - DNA, 270 bp, Artificial Sequence; identical to SEQ ID NO: 11466
  Description of Artificial Sequence: Synthetic coding sequence

SEQ ID NO: 12095 - DNA, 1785 bp, Artificial Sequence
  Description of Artificial Sequence: Synthetic coding sequence
atgaccgacaccagaagaagagtgaaggtgtacaccctgaacgaggacagacagtgggacgacagaggcaccggccacgtgagcagcggctacgtggagagactgaagggcatgagcctgctggtgagagccgagagcgacggcagcctgctgctggagagcaagatcaaccccaacaccgcctaccagaagcagcaggaggacgagaagttcctgaccgacctgttcgcccagctgaccgacgaggccaccgacgaggagaagagacaggagctggtgaacttcctgaaggagttctgcgccttcagccagaccctgcagccccagaacagagacgccttcttcaagaccctgagcaacatgggcatcctgcccgccctggaggtgatcctgggcatggacgacacccaggtgagaagcgccgccaccgacatcttcagctacctggtggagtacaaccccagcatggtgagagagttcgtgatgcaggaggcccagcagaacgacgacgtgagcaagaagctgaccgagcagaagatcaccagcaaggacatcctgctgatcaacctgatcatcgagcacatgatctgcgacaccgaccccgagctgggcggcgccgtgcagctgatgggcctgctgagaaccctggtggaccccgagaacatgctggccaccgccaacaagaccgagaagaccgagttcctgggcttcttctacaagcactgcatgcacgtgctgaccgcccccctgctggccaacaccaccgaggacaagcccagcaaggacgacttccagaccgcccagctgctggccctggtgctggagctgctgaccttctgcgtggagcaccacacctaccacatcaagaactacatcatcaacaaggacatcctgagaagagtgctggtgctgatggccagcaagcacgccttcctggccctgtgcgccctgagattcaagagaaagatcatcggcctgaaggacgagttctacaacagatacatcatgaagagcttcctgttcgagcccgtggtgaaggccttcctgaacaacggcagcagatacaacctgatgaacagcgccatcatcgagatgttcgagttcatcagagtggaggacatcaagagcctgaccgcccacgtgatcgagaactactggaaggccctggaggacgtggactacgtgcagaccttcaagggcctgaagctgagattcgagcagcagagagagagacaggacaaccccaagctggacagcatgagaagcatcctgagaaaccacagatacagaagagacgccagaaccctggaggacgaggaggagatgtggttcaacaccgacgaggacgacatggaggacggcgaggccgtggtgagccccagcgacaagaccaagaacgacgacgacatcatggaccccatcagcaagttcatggagagaaagaagctgaaggagagcgaggagaaggaggtgctgctgaagaccaacctgagcggcagacagagccccagcttcaagctgagcctgagcagcggcaccaagaccaacctgaccagccagagcagcaccaccaacctgcccggcagccccggcagccccggcagccccggcagccccggcagccccggcagcgtgcccaagaacaccagccagaccgccgccatcaccaccaagggcggcctggtgggcctggtggactaccccgacgacgacgaggacgacgacgaggacgaggacaaggaggacaccctgcccctgagcaagaaggccaagttcgacagctag

SEQ ID NO: 12096 - DNA, 522 bp, Artificial Sequence
  Description of Artificial Sequence: Synthetic coding sequence
atgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgaccagggcatcaacatctacagaaagtag

SEQ ID NO: 12097 - DNA, 1620 bp, Artificial Sequence; identical to SEQ ID NO: 10018
  Description of Artificial Sequence: Synthetic coding sequence

SEQ ID NO: 12098 - DNA, 2112 bp, Artificial Sequence
  Description of Artificial Sequence: Synthetic coding sequence
atgttcagatacgagagcctggaggactgccccctggacgaggacgaggacgccttccagggcctgggcgaggaggacgaggagatcgaccagttcaacgacgacaccttcggcagcggcgccgtggacgacgactggcaggaggcccacgagagactggccgagctggaggagaagctgcccgtggccgtgaacgagcagaccggcaacggcgagagagacgagatggacctgctgggcgaccacgaggagaacctggccgagagactgagcaagatggtgatcgagaacgagctggaggaccccgccatcatgagagccgtgcagaccagacccgtgctgcagccccagcccggcagcctgaacagcagcatctgggacggcagcgaggtgctgagaagaatcagaggccccctgctggcccaggagatgcccaccgtgagcgtgctggagtacgccctgccccagagacccccccagggccccgaggacgacagagacctgagcgagagagccctgcccagaagaagcaccagccccatcatcggcagcccccccgtgagagccgtgcccatcggcaccccccccaagcagatggccgtgcccagcttcacccagcagatcctgtgccccaagcccgtgcacgtgagaccccccatgccccccagataccccgccccctacggcgagagaatgagccccaaccagctgtgcagcgtgcccctgcagcccggcagaatgagccccagccagttcgccagagtgcccggcttcgtgggcagccccctggccgccatgaaccccaagctgctgcagggcagagtgggccagatgctgccccccgcccccggcttcagagccttcttcagcgccccccccagcgccaccccccccccccagcagcacccccccggccccggcccccacctgcagaacctgagaagccaggcccccatgttcagacccgacaccacccacctgcacccccagcacagaagactgctgcaccagagacagcagcagaacagaagccagcacagaaacctgaacggcgccggcgacagaggcagccacagaagcagccaccaggaccacctgagaaaggacccctacgccaacctgatgctgcagagagagaaggactgggtgagcaagatccagatgatgcagctgcagagcaccgacccctacctggacgacttctactaccagaactacttcgagaagctggagaagctgagcgccgccgaggagatccagggcgacggccccaagaaggagagaaccaagctgatcaccccccaggtggccaagctggagcacgcctacaagcccgtgcagttcgagggcagcctgggcaagctgaccgtgagcagcgtgaacaaccccagaaagatgatcgacgccgtggtgaccagcagaagcgaggacgacgagaccaaggagaagcaggtgagagacaagagaagaaagaccctggtgatcatcgagaagacctacagcctgctgctggacgtggaggactacgagagaagatacctgctgagcctggaggaggagagacccgccctgatggacgacagaaagcacaagatctgcagcatgtacgacaacctgagaggcaagctgcccggccaggagagacccagcgacgaccacttcgtgcagatcatgtgcatcagaaagggcaagagaatggtggccagaatcctgcccttcctgagcaccgagcaggccgccgacatcctgatgaccaccgccagaaacctgcccttcctgatcaagaaggacgcccaggacgaggtgctgccctgcctgctgagccccttcagcctgctgctgtaccacctgcccagcgtgagcatcaccagcctgctgagacagctgatgaacctgcccagcagcgaccccgccaccgagagcacccagaacaaccagtggaccgaggtgatgttcatggccaccagagagctgctgagaatcccccaggccgccctggccaagcccatcagcatccccaccaacctggtgagcctgttcagcagatacgtggacagacagaagctgaacctgctggagaccaagctgcagctggtgcagggcatcagatag

SEQ ID NO: 12099 - DNA, 957 bp, Artificial Sequence
  Description of Artificial Sequence: Synthetic coding sequence
atgagcgcccacaacagaggcaccgagctggacctgagctggatcagcaagatccaggtgaaccaccccgccgtgctgagaagagccgagcagatccaggccagaagaaccgtgaagaaggagtggcaggccgcctggctgctgaaggccgtgaccttcatcgacctgaccaccctgagcggcgacgacaccagcagcaacatccagagactgtgctacaaggccaagtaccccatcagagaggacctgctgaaggccctgaacatgcacgacaagggcatcaccaccgccgccgtgtgcgtgtaccccgccagagtgtgcgacgccgtgaaggccctgaaggccgccggctgcaacatccccgtggccagcgtggccgccggcttccccgccggccagacccacctgaagaccagactggaggagatcagactggccgtggaggacggcgccaccgagatcgacgtggtgatcaacagaagcctggtgctgaccggccagtgggaggccctgtacgacgagatcagacagttcagaaaggcctgcggcgaggcccacctgaagaccatcctggccaccggcgagctgggcaccctgaccaacgtgtacaaggccagcatgatcgccatgatggccggcagcgacttcatcaagaccagcaccggcaaggagaccgtgaacgccaccttccccgtggccatcgtgatgctgagagccatcagagacttcttctggaagaccggcaacaagatcggcttcaagcccgccggcggcatcagaagcgccaaggacagcctggcctggctgagcctggtgaaggaggagctgggcgacgagtggctgaagcccgagctgttcagaatcggcgccagcaccctgctgagcgacatcgagagacagatctaccaccacgtgaccggcagatacgccgcctaccacgacctgcccatgagctag

SEQ ID NO: 12100 - DNA, 1188 bp, Artificial Sequence; identical to SEQ ID NO: 11022
  Description of Artificial Sequence: Synthetic coding sequence

SEQ ID NO: 12101 - DNA, 3288 bp, Artificial Sequence
  Description of Artificial Sequence: Synthetic coding sequence
atggccgagggcgccgccggcagagaggaccccgccccccccgacgccgccggcggcgaggacgaccccagagtgggccccgacgccgccggcgactgcgtgaccgccgccagcggcggcagaatgagagacagaagaagcggcgtggccctgcccggcgccgccggcacccccgccgacagcgaggccggcctgctggaggccgccagagccacccccagaagaagcagcatcatcaaggaccccagcaaccagaagtgcggcggcagaaagaagaccgtgagcttcagcagcatgcccagcgagaagaagatcagcagcgccaacgactgcatcagcttcatgcaggccggctgcgagctgaagaaggtgagacccaacagcagaatctacaacagattcttcaccctggacaccgacctgcaggccctgagatgggagcccagcaagaaggacctggagaaggccaagctggacatcagcgccatcaaggagatcagactgggcaagaacaccgagaccttcagaaacaacggcctggccgaccagatctgcgaggactgcgccttcagcatcctgcacggcgagaactacgagagcctggacctggtggccaacagcgccgacgtggccaacatctgggtgagcggcctgagatacctggtgagcagaagcaagcagcccctggacttcatggagggcaaccagaacacccccagattcatgtggctgaagaccgtgttcgaggccgccgacgtggacggcaacggcatcatgctggaggacaccagcgtggagctgatcaagcagctgaaccccaccctgaaggaggccaagatcagactgaagttcaaggagatccagaagagcaaggagaagctgaccaccagagtgaccgaggaggagttctgcgaggccttctgcgagctgtgcaccagacccgaggtgtacttcctgctggtgcagatcagcaagaacaaggagtacctggacgccaacgacctgatgctgttcctggaggccgagcagggcgtgacccacatcaccgaggacatctgcctggacatcatcagaagatacgagctgagcgaggagggcagacagaagggcttcctggccatcgacggcttcacccagtacctgctgagcagcgagtgcgacatcttcgaccccgagcagaagaaggtggcccaggacatgacccagcccctgagccactactacatcaacgccagccacaacacctacctgatcgaggaccagttcagaggccccgccgacatcaacggctacatcagagccctgaagatgggctgcagaagcgtggagctggacgtgagcgacggcagcgacaacgagcccatcctgtgcaacagaaacaacatgaccacccacgtgagcttcagaagcgtgatcgaggtgatcaacaagttcgccttcgtggccagcgagtaccccctgatcctgtgcctgggcaaccactgcagcctgccccagcagaaggtgatggcccagcagatgaagaaggtgttcggcaacaagctgtacaccgaggcccccctgcccagcgagagctacctgcccagccccgagaagctgaagagaatgatcatcgtgaagggcaagaagctgcccagcgaccccgacgtgctggagggcgaggtgaccgacgaggacgaggaggccgagatgagcagaagaatgagcgtggactacaacggcgagcagaagcagatcagactgtgcagagagctgagcgacctggtgagcatctgcaagagcgtgcagtacagagacttcgagctgagcatgaagagccagaactactgggagatgtgcagcttcagcgagaccgaggccagcagaatcgccaacgagtaccccgaggacttcgtgaactacaacaagaagttcctgagcagaatctaccccagcgccatgagaatcgacagcagcaacctgaacccccaggacttctggaactgcggctgccagatcgtggccatgaacttccagacccccggccccatgatggacctgcacaccggctggttcctgcagaacggcggctgcggctacgtgctgagacccagcatcatgagagacgaggtgagctacttcagcgccaacaccaagggcatcctgcccggcgtgagccccctggccctgcacatcaagatcatcagcggccagaacttccccaagcccaagggcgcctgcgccaagggcgacgtgatcgacccctacgtgtgcatcgagatccacggcatccccgccgactgcagcgagcagagaaccaagaccgtgcagcagaacagcgacaaccccatcttcgacgagaccttcgagttccaggtgaacctgcccgagctggccatgatcagattcgtggtgctggacgacgactacatcggcgacgagttcatcggccagtacaccatccccttcgagtgcctgcagcccggctacagacacgtgcccctgagaagcttcgtgggcgacatcatggagcacgtgaccctgttcgtgcacatcgccatcaccaacagaagcggcggcggcaaggcccagaagagaagcctgagcgtgagaatgggcaagaaggtgagagagtacaccatgctgagaaacatcggcctgaagaccatcgacgacatcttcaagatcgccgtgcaccccctgagagaggccatcgacatgagagagaacatgcagaacgccatcgtgagcatcaaggagctgtgcggcctgccccccatcgccagcctgaagcagtgcctgctgaccctgagcagcagactgatcaccagcgacaacacccccagcgtgagcctggtgatgaaggacagcttcccctacctggagcccctgggcgccatccccgacgtgcagaagaagatgctgaccgcctacgacctgatgatccaggagagcagattcctgatcgagatggccgacaccgtgcaggagaagatcgtgcagtgccagaaggccggcatggagttccacgaggagctgcacaacctgggcgccaaggagggcctgaagggcagaaagctgaacaaggccaccgagagcttcgcctggaacatcaccgtgctgaagggccagggcgacctgctgaagaacgccaagaacgaggccatcgagaacatgaagcagatccagctggcctgcctgagctgcggcctgagcaaggcccccagcagcagcgccgaggccaagagcaagagaagcctggaggccatcgaggagaaggagagcagcgaggagaacggcaagctgtag

SEQ ID NO: 12102 - DNA, 543 bp, Artificial Sequence
  Description of Artificial Sequence: Synthetic coding sequence
atggagcagcccaagggcgtggactggaccgtgatcatcctgacctgccagtacaaggacagcgtgcaggtgttccagagagagctggaggtgagacagaagagagagcagatccccgccggcaccctgctgctggccgtggaggaccccgagaagagagtgggcagcggcggcgccaccctgaacgccctgctggtggccgccgagcacctgagcgccagagccggcttcaccggcagagacttccccttcgacgactgcggcagagccttcacctgcctgcccgtggagaaccccgaggcccccgtggaggccctggtgtgcaacctggactgcctgctggacatcatgacctacagactgggccccggcagcccccccggcgtgtgggtgtgcagcaccgacatgctgctgagcgtgcccgccaaccccggcgagcccgagaccacctgggactgcctgcccagcagccagccccagcaggaggccagcagcgccctgctggcccaccccgccagcggccccgcccccctgccctactag

SEQ ID NO: 12103 - DNA, 429 bp, Artificial Sequence
  Description of Artificial Sequence: Synthetic coding sequence
atgaacgaggtggtgcacaccagccccaccatcggcagcaacgtggaggagatcgtgatcaacaacaccagattcctgatgtgggacatcggcggccaggagagcctgagaagcagctggaacacctactacaccaacaccgagttcgtgatcgtggtggtggacagcaccgacagagagagaatcagcgtgaccagagaggagctgtacaagatgctggcccacgaggacctgagaaaggccggcctgctgatcttcgccaacaagcaggacgtgaaggagtgcatgaccgtggccgagatcagccagttcctgaagctgaccagcatcaaggaccaccagtggcacatccaggcctgctgcgccctgaccggcgagggcctgtgccagggcctggagtggatgatgagcagactgaagatcagatag

SEQ ID NO: 12104 - DNA, 342 bp, Artificial Sequence
  Description of Artificial Sequence: Synthetic coding sequence
atggagggcgtgctgtacaagtggaccaactacctgagcggctggcagcccagatggttcctgctgtgcggcggcatcctgagctactacgacagccccgaggacgcctggaagggctgcaagggcagcatccagatggccgtgtgcgagatccaggtgcacagcgtggacaacaccagaatggacctgatcatccccggcgagcagtacttctacctgaaggccagaagcgtggccgagagacagagatggctggtggccctgggcagcgccaaggcctgcctgaccgacagcagaacccagaaggagaagggcaacctgctgaagaccctgaagacctag

SEQ ID NO: 12105 - DNA, 1119 bp, Artificial Sequence
  Description of Artificial Sequence: Synthetic coding sequence
atggccagcaaccacaagagcagcgccgccagacccgtgagcagaggcggcgtgggcctgaccggcagaccccccagcggcatcagacccctgagcggcaacatcagagtggccaccgccatgccccccggcaccgccagacccggcagcagaggctgccccatcggcaccggcggcgtgctgagcagccagatcaaggtggcccacagacccgtgacccagcagggcctgaccggcatgaagaccggcaccaagggcccccagagacagatcctggacaagagctactacctgggcctgctgagaagcaagatcagcgagctgaccaccgaggtgaacaagctgcagaagggcatcgagatgtacaaccaggagaacagcgtgtacctgagctacgagaagagagccgagaccctggccgtggagatcaaggagctgcagggccagctggccgactacaacatgctggtggacaagctgaacaccaacaccgagatggaggaggtgatgaacgactacaacatgctgaaggcccagaacgacagagagacccagagcctggacgtgatcttcaccgagagacaggccaaggagaagcagatcagaagcgtggaggaggagatcgagcaggagaagcaggccaccgacgacatcatcaagaacatgagcttcgagaaccaggtgaagtacctggagatgaagaccaccaacgagaagctgctgcaggagctggacaccctgcagcagcagctggacagccagaacatgaagaaggagagcctggaggccgagatcgcccacagccaggtgaagcaggaggccgtgctgctgcacgagaagctgtacgagctggagagccacagagaccagatgatcgccgaggacaagagcatcggcagccccatggaggagagagagaagctgctgaagcagatcaaggacgacaaccaggagatcgccagcatggagagacagctgaccgacaccaaggagaagatcaaccagttcatcgaggagatcagacagctggacatggacctggaggagcaccaggaccccaccaactacggctggaagatcctggagaagaacaccggcagcttcaagaagcaggtgtag

SEQ ID NO: 12106 - DNA, 345 bp, Artificial Sequence; identical to SEQ ID NO: 11846
  Description of Artificial Sequence: Synthetic coding sequence

SEQ ID NO: 12107 - DNA, 327 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagcatccccctgggccaggccgaccccagcctggccccctacatcatcgacctgcccagctggacccagttcagacaggacaccggcaccatgagagccgtgagaagacacctgttcccccagcacagcgcccccggcagatag

SEQ ID NO: 12108 - DNA, 549 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtgatcgactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacatggccgccctggagaaggactacgaggaggtgggcgtggacagcgtggagggcgagggcgaggaggagggcgaggagtactag

SEQ ID NO: 12109 - DNA, 483 bp, Artificial Sequence; identical to SEQ ID NO: 10977
  Description of Artificial Sequence: Synthetic coding sequence

SEQ ID NO: 12110 - DNA, 3483 bp, Artificial Sequence
  Description of Artificial Sequence: Synthetic coding sequence
atggcctgcagaagaagatacttcgtggagggcgaggcccccagcagcgagaccggcaccagcctggacagccccagcgcctacccccagggccccctggtgcccggcagcagcctgagccccgaccactacgagcacaccagcgtgggcgcctacggcctgtacagcggcccccccggccagcagcagagaaccagaagacccaagctgcagcacagcaccagcatcctgagaaagcaggccgaggaggaggccatcaagagaagcagaagcctgagcgagagctacgagctgagcagcgacctgcaggacaagcaggtggagatgctggagagaaagtacggcggcagactggtgaccagacacgccgccagaaccatccagaccgccttcagacagtaccagatgaacaagaacttcgagagactgagaagcagcatgagcgagaacagaatgagcagaagaatcgtgctgagcaacatgagaatgcagttcagcttcgagggccccgagaaggtgcacagcagctacttcgagggcaagcaggtgagcgtgaccaacgacggcagccagctgggcgccctggtgagccccgagtgcggcgacctgagcgagcccaccaccctgaagagccccgcccccagcagcgacttcgccgacgccatcaccgagctggaggacgccttcagcagacaggtgaagagcctggccgagagcatcgacgacgccctgaactgcagaagcctgcacaccgaggaggcccccgccctggacgccgccagagccagagacaccgagccccagaccgccctgcacggcatggaccacagaaagctggacgagatgaccgccagctacagcgacgtgaccctgtacatcgacgaggaggagctgagcccccccctgcccctgagccaggccggcgacagacccagcagcaccgagagcgacctgagactgagagccggcggcgccgcccccgactactgggccctggcccacaaggaggacaaggccgacaccgacaccagctgcagaagcacccccagcctggagagacaggagcagagactgagagtggagcacctgcccctgctgaccatcgagccccccagcgacagcagcgtggacctgagcgacagaagcgagagaggcagcctgaagagacagagcgcctacgagagaagcctgggcggccagcagggcagccccaagcacggcccccacagcggcgcccccaagagcctgcccagagaggagcccgagctgagacccagaccccccagacccctggacagccacctggccatcaacggcagcgccaacagacagagcaagagcgagagcgactacagcgacggcgacaacgacagcatcaacagcaccagcaacagcaacgacaccatcaactgcagcagcgagagcagcagcagagacagcctgagagagcagaccctgagcaagcagacctaccacaaggaggccagaaacagctgggacagccccgccttcagcaacgacgtgatcagaaagagacactacagaatcggcctgaacctgttcaacaagaagcccgagaagggcgtgcagtacctgatcgagagaggcttcgtgcccgacacccccgtgggcgtggcccacttcctgctgcagagaaagggcctgagcagacagatgatcggcgagttcctgggcaacagacagaagcagttcaacagagacgtgctggactgcgtggtggacgagatggacttcagcaccatggagctggacgaggccctgagaaagttccaggcccacatcagagtgcagggcgaggcccagaaggtggagagactgatcgaggccttcagccagagatactgcatctgcaaccccggcgtggtgagacagttcagaaaccccgacaccatcttcatcctggccttcgccatcatcctgctgaacaccgacatgtacagccccaacgtgaagcccgagagaaagatgaagctggaggacttcatcaagaacctgagaggcgtggacgacggcgaggacatccccagagagatgctgatgggcatctacgagagaatcagaaagagagagctgaagaccaacgaggaccacgtgagccaggtgcagaaggtggagaagctgatcgtgggcaagaagcccatcggcagcctgcaccccggcctgggctgcgtgctgagcctgccccacagaagactggtgtgctactgcagactgttcgaggtgcccgaccccaacaagccccagaagctgggcctgcaccagagagagatcttcctgttcaacgacctgctggtggtgaccaagatcttccagaagaagaagaacagcgtgacctacagcttcagacagagcttcagcctgtacggcatgcaggtgctgctgttcgagaaccagtactaccccaacggcatcagactgaccagcagcgtgcccggcgccgacatcaaggtgctgatcaacttcaacgcccccaacccccaggacagaaagaagttcaccgacgacctgagagagagcatcgccgaggtgcaggagatggagaagcacagaatcgagagcgagctggagaagcagaagggcgtggtgagacccagcatgagccagtgcagcagcctgaagaaggagagcggcaacggcaccctgagcagagcctgcctggacgacagctacgccagcggcgagggcctgaagagaagcgccctgagcagcagcctgagagacctgagcgaggccggcaagagaggcagaagaagcagcgccggcagcctggagagcaacgtggagggcagcatcatcagcagcccccacatgagaagaagagccaccagcaccagagagtgccccagcagaccccaccagaccatgcccaacagcagcagcctgctgggcagcctgttcggcagcaagagaggcaagccccccccccaggcccacctgcccagcgcccccgccctggccacccccccccccaccggcggccccgccagcctggccgccctgtgcggctggcccccccccggcgcccccagaggcgccgccgccggcagacacgccagagccagccaccccgtgctgccccacgccgagcccagccccgtgccccccagccccccccccccccccacccccgcccaccccgccagaacccccgtgccccccagacccccctggggcccccccagcctgagaggcccctgccccagaccccccgccgccgccctgggccccagaggcgcccacagcgcccccccctgggccgccccctgccccgccgccccccaccagcagcagggccagacccagagacaccagcacaactgcgtggacagcctgggcagaggccccagactgcccgagacccccgcccaccacaccggccacgccagaggcagccccgccgcccaccagaccagaggcaccagcgtggccatcagccccctgtgccccagcagacccaactag

SEQ ID NO: 12111 - DNA, 378 bp, Artificial Sequence
  Description of Artificial Sequence: Synthetic coding sequence
atgaagaaggagcacgtgctgcactgccagttcagcgcctggtaccccttcttcagaggcgtgaccatcaagagcgtgatcctgcccctgccccagaacgtgaaggactacctgctggacgacggcaccctggtggtgagcggcagagacgacccccccacccacagccagcccgacagcgacgacgaggccgaggagatccagtggagcgacgacgagaacaccgccaccctgaccgacgcctactggatcgccatgaacagcagcctgaagtgcaagaccctgagcgacatcttcctgctgttcaagagcagcgacttcatcaccagagacttcacccagcccttcatccactgcaccgacgacagccccgactag

SEQ ID NO: 12112 - DNA, 414 bp, Artificial Sequence; identical to SEQ ID NO: 11742
  Description of Artificial Sequence: Synthetic coding sequence

SEQ ID NO: 12113 - DNA, 3222 bp, Artificial Sequence
  Description of Artificial Sequence: Synthetic coding sequence
atggaggagagaaagcacgagaccatgaaccccgcccacgtgctgttcgacagattcgtgcaggccaccacctgcaagggcaccctgaaggccttccaggagctgtgcgaccacctggagctgaagcccaaggactacagaagcttctaccacaagctgaagagcaagctgaactactggaaggccaaggccctgtgggccaagctggacaagagaggcagccacaaggactacaagaagggcaaggcctgcaccaacaccaagtgcctgatcatcggcgccggcccctgcggcctgagaaccgccatcgacctgagcctgctgggcgccaaggtggtggtgatcgagaagagagacgccttcagcagaaacaacgtgctgcacctgtggcccttcaccatccacgacctgagaggcctgggcgccaagaagttctacggcaagttctgcgccggcgccatcgaccacatcagcatcagacagctgcagctgatcctgctgaaggtggccctgatcctgggcatcgagatccacgtgaacgtggagttccagggcctgatccagccccccgaggaccaggagaacgagagaatcggctggagagccctggtgcaccccaagacccaccccgtgagcgagtacgagttcgaggtgatcatcggcggcgacggcagaagaaacaccctggagggcttcagaagaaaggagttcagaggcaagctggccatcgccatcaccgccaacttcatcaacagaaacaccaccgccgaggccaaggtggaggagatcagcggcgtggccttcatcttcaaccagaagttcttccaggagctgagagaggccaccggcatcgacctggagaacatcgtgtactacaaggacgacacccactacttcgtgatgaccgccaagaagcagagcctgctggacaagggcgtgatcctgcacgactacgccgacaccgagctgctgctgagcagagagaacgtggaccaggaggccctgctgagctacgccagagaggccgccgacttcagcacccagcagcagctgcccagcctggacttcgccatcaaccactacggccagcccgacgtggccatgttcgacttcacctgcatgtacgccagcgagaacgccgccctggtgagagagcagaacggccaccagctgctggtggccctggtgggcgacagcctgctggagcccttctggcccatgggcaccggcatcgccagaggcttcctggccgccatggacagcgcctggatggtgagaagctggagcctgggcaccagccccctggaggtgctggccgagagagagagcatctacagactgctgccccagaccacccccgagaacgtgagcaagaacttcagccagtacagcatcgaccccgtgaccagataccccaacatcaacgtgaacttcctgagacccagccaggtgagacacctgtacgacaccggcgagaccaaggacatccacctggagatggagagcctggtgaacagcagaaccacccccaagctgaccagaaacgagagcgtggccagaagcagcaagctgctgggctggtgccagagacagaccgacggctacgccggcgtgaacgtgaccgacctgaccatgagctggaagagcggcctggccctgtgcgccatcatccacagatacagacccgacctgatcgacttcgacagcctggacgagcagaacgtggagaagaacaaccagctggccttcgacatcgccgagaaggagctgggcatcagccccatcatgaccggcaaggagatggccagcgtgggcgagcccgacaagctgagcatggtgatgtacctgacccagttctacgagatgttcaaggacagcctgcccagcagcgacaccctggacctgaacgccgaggagaaggccgtgctgatcgccagcaccagaagccccatcagcttcctgagcaagctgggccagaccatcagcagaaagagaagccccaaggacaagaaggagaaggacctggacggcgccggcaagagaagaaagaccagccagagcgaggaggaggaggcccccagaggccacagaggcgagagacccaccctggtgagcaccctgaccgacagaagaatggacgtggccgtgggcaaccagaacaaggtgaagtacatggccacccagctgctggccaagttcgaggagaacgcccccgcccagagcatcggcatcagaagacagcagagagagaaggagtgcagcagaacctgccccaagaaggtgatcaccctgagccccccccccaccccccccccctgcagagcccacggcggccagcagacctacagagacctggacgccgacaacagaggcaagcagagcccccaccacgagagacccgagcccgagccccccagaagattcttcgtggaccagtgggagctgagcctgagcctgagaagcagcgccagacccgccagccccagcagcgacagcctgagacagaagtacatcaagatgtacaccggcggcgtgagcagcctggccgagcagatcgccaaccagctgcagagaaaggagcagcccaaggccctgctggacaagaaggagctgggcagcatgaagaaggagttcccccagaacctgggcggcagcgacacctgctacttctgccagaagagagtgtacgtgatggagagactgagcgccgagggcaagttcttccacagaagctgcttcaagtgcgagtactgcgccaccaccctgagactgagcgcctacgcctacgacatcgaggacggcaagttctactgcaagccccactactgctacagactgagcggctacgcccagagaaagagacccgccgtggcccccctgagcggcaaggaggccaagggccccctgcaggacggcgccaccaccgacgccaacggcagagccaacgccgtggccagcagcaccgagagaacccccggcagcctgaccagcctgttcggctgggtggccagacacagcctgggcctgtgcgacaaggccaagggcatgagccagcacctgcagagcaacatcagcagcttcggccagcaggtggcccagaaccccctggacagcttcttcatgtgccagctgctggccttcggcgtgcccttcctgtacggcctgagcgaggtgctggtgcagatcagaggcgagttccactggcaggccgtggcccagtag

SEQ ID NO: 12114 - DNA, 543 bp, Artificial Sequence
  Description of Artificial Sequence: Synthetic coding sequence
atgttcctgagctgcggcagcctgcaccagagaggccccgagaccgacggcaccgtgttcagaatccacaccaaggccgagggcttcatggacgtggacatccccctggagctggtgttccacctgcccgtgaactaccccagctgcctgcccggcatcagcatcaacagcgagcagctgaccagagcccagtgcgtgaccgtgaaggagaacctgctggagcaggccgagagcctgctgagcgagcccatggtgcacgagctggtgctgtggatccagcagaacctgagacacatcctgagccagcccgagaccggcagcggcagcgagaagtgcaccttcagcaccagcaccaccatggacgacggcctgtggatcaccctgctgcacctggaccacatgagagccaagaccaagtacgtgaagatcgtggagaagtgggccagcgacctgagactgaccggcagactgatgttcatgggcaagatcatcctgatcctgctgcagggcgacagaaacaacctgaaggtgcccaagagctag

SEQ ID NO: 12115 - DNA, 1521 bp, Artificial Sequence
  Description of Artificial Sequence: Synthetic coding sequence
atgaagagaagaagcgtgaccatgaccgacggcctgaccgccgacaaggtgaccagaagcgacggctgccccaccagcaccagcctgcccagacccagagacagcatcagaagctgcgccctgagcatggaccagatccccgacctgcacagccccatgagccccatcagcgagagccccagcagccccgcctacagcaccgtgaccagagtgcacgccgcccccgccgcccccagcgccaccgccctgcccgccagccccgtggccagaagaagcagcgagccccagctgtgccccggcagcgcccccaagacccacggcgagagcgacaagggcccccacaccagccccagccacaccctgggcaaggccagccccagccccagcctgagcagctacagcgaccccgacagcggccactactgccagctgcagccccccgtgagaggcagcagagagtgggccgccaccgagaccagcagccagcaggccagaagctacggcgagagactgaaggagctgagcgagaacggcgcccccgagggcgactggggcaagaccttcaccgtgcccatcgtggaggtgaccagcagcttcaaccccgccaccttccagagcctgctgatccccagagacaacagacccctggaggtgggcctgctgagaaaggtgaaggagctgctggccgaggtggacgccagaaccctggccagacacgtgaccaaggtggactgcctggtggccagaatcctgggcgtgaccaaggagatgcagaccctgatgggcgtgagatggggcatggagctgctgaccctgccccacggcagacagctgagactggacctgctggagagattccacaccatgagcatcatgctggccgtggacatcctgggctgcaccggcagcgccgaggagagagccgccctgctgcacaagaccatccagctggccgccgagctgagaggcaccatgggcaacatgttcagcttcgccgccgtgatgggcgccctggacatggcccagatcagcagactggagcagacctgggtgaccctgagacagagacacaccgagggcgccatcctgtacgagaagaagctgaagcccttcctgaagagcctgaacgagggcaaggagggcccccccctgagcaacaccaccttcccccacgtgctgcccctgatcaccctgctggagtgcgacagcgccccccccgagggccccgagccctggggcagcaccgagcacggcgtggaggtggtgctggcccacctggaggccgccagaaccgtggcccaccacggcggcctgtaccacaccaacgccgaggtgaagctgcagggcttccaggccagacccgagctgctggaggtgttcagcaccgagttccagatgagactgctgtggggcagccagggcgccagcagcagccaggccagaagatacgagaagttcgacaaggtgctgaccgccctgagccacaagctggagcccgccgtgagaagcagcgagctgtag

SEQ ID NO: 12116 - DNA, 369 bp, Artificial Sequence; identical to SEQ ID NO: 12080
  Description of Artificial Sequence: Synthetic coding sequence

SEQ ID NO: 12117 - DNA, 369 bp, Artificial Sequence
  Description of Artificial Sequence: Synthetic coding sequence
atgcccgagatcaacaccaaccacctggacaagcagcaggtgcagctgctggccgagatgtgcatcctgatcgacgagaacgacaacaagatcggcgccgagaccaagaagaactgccacctgaacgagaacatcgagaagggcctgctgcacagagccttcagcgtgttcctgttcaacaccgagaacaagctgctgctgcagcagagaagcgacgccaagatcaccttccccggctgcttcaccaacacctgctgcagccaccccctgagcaaccccgccgagctggaggagagcgacgccctgggcgtgagaagagccgcccagagaagactgaaggccgagctgggcatccccctggaggagtag

SEQ ID NO: 12118 - DNA, 408 bp, Artificial Sequence; identical to SEQ ID NO: 11485
  Description of Artificial Sequence: Synthetic coding sequence

SEQ ID NO: 12119 - DNA, 3282 bp, Artificial Sequence
  Description of Artificial Sequence: Synthetic coding sequence
atgggcaccggcgacttcatctgcatcagcatgaccggcggcgccccctggggcttcagactgcagggcggcaaggagcagaagcagcccctgcaggtggccaagatcagaaaccagagcaaggccagcggcagcggcctgtgcgagggcgacgaggtggtgagcatcaacggcaacccctgcgccgacctgacctaccccgaggtgatcaagctgatggagagcatcaccgacagcctgcagatgctgatcaagagacccagcagcggcatcagcgaggccctgatcagcgagaacgagaacaagaacctggagcacctgacccacggcggctacgtggagagcaccaccctgcagatcagacccgccaccaagacccagtgcaccgagttcttcctggcccccgtgaagaccgaggtgcccctggccgagaaccagagaagcggccccgactgcgccggcagcctgaaggaggagaccggccccagctaccagagagccccccagatgcccgacagccagagaggcagagtggccgaggagctgatcctgagagagaaggtggaggccgtgcagcccggccccgtggtggagctgcagctgagcctgagccaggagagacacaagggcgccagcggccccctggtggccctgcccggcgccgagaagagcaagagccccgaccccgaccccaacctgagccacgacagaatcgtgcacatcaacagcatccccaccaacgagaaggccgaccccttcctgagaagcagcaagatcatccagatcagcagcggcagagagctgagagtgatccaggagagcgaggccggcgacgccggcctgcccagagtggaggtgatcctggactgcagcgacagacagaagaccgagggctgcagactgcaggccggcaaggagtgcgtggacagccccgtggagggcggccagagcgaggccccccccagcctggtgagcttcgccgtgagcagcgagggcaccgagcagggcgaggaccccagaagcgagaaggaccacagcagaccccacaagcacagagccagacacgccagactgagaagaagcgagagcctgagcgagaagcaggtgaaggaggccaagagcaagtgcaagagcatcgccctgctgctgaccgacgcccccaaccccaacagcaagggcgtgctgatgttcaagaagagaagaagaagagccagaaagtacaccctggtgagctacggcaccggcgagctggagagagaggccgacgaggaggaggagggcgacaaggaggacacctgcgaggtggccttcctgggcgccagcgagagcgaggtggacgaggagctgctgagcgacgtggacgacaacacccaggtggtgaacttcgactgggacagcggcctggtggacatcgagaagaagctgaacagaggcgacaagatggagatgctgcccgacaccaccggcaagggcgccctgatgttcgccaagagaagagagagaatggaccagatcaccgcccagaaggaggaggacaaggtgggcggcacccccagcagagagcaggacgccgcccagaccgacggcctgagaaccaccaccagctaccagagaaaggaggaggagagcgtgagaacccagagcagcgtgagcaagagctacatcgaggtgagccacggcctgggccacgtgccccagcagaacggcttcagcggcaccagcgagaccgccaacatccagagaatggtgcccatgaacagaaccgccaagcccttccccggcagcgtgaaccagcccgccacccccttcagccccaccagaaacatgaccagccccatcgccgacttccccgccccccccccctacagcgccgtgacccccccccccgacgccttcagcagaggcgtgagcagccccatcgccggccccgcccagccccccccctggccccagcccgccccctggagccagcccgccttctacgacagcagcgagagaatcgccagcagagacgagagaatcagcgtgcccgccaagagaaccggcatcctgcaggaggccaagagaagaagcaccaccaagcccatgttcaccttcaaggagcccaaggtgagccccaaccccgagctgctgagcctgctgcagaacagcgagggcaagagaggcaccggcgccggcggcgacagcggccccgaggaggactacctgagcctgggcgccgaggcctgcaacttcatgcagagcagcagcgccaagcagaagacccccccccccgtggcccccaagcccgccgtgaagagcagcagcagccagcccgtgacccccgtgagccccgtgtggagccccggcgtggcccccacccagccccccgccttccccaccagcaaccccagcaagggcaccgtggtgagcagcatcaagatcgcccagcccagctacccccccgccagacccgccagcaccctgaacgtggccggccccttcaagggcccccaggccgccgtggccagccagaactacacccccaagcccaccgtgagcacccccaccgtgaacgccgtgcagcccggcgccgtgggccccagcaacgagctgcccggcatgagcggcagaggcgcccagctgttcgccaagagacagagcagaatggagaagtacgtggtggacagcgacaccgtgcaggcccacgccgccagagcccagagccccacccccagcctgcccgccagctggaagtacagcagcaacgtgagagcccccccccccgtggcctacaaccccatccacagccccagctaccccctggccgccctgaagagccagcccagcgccgcccagcccagcaagatgggcaagaagaagggcaagaagcccctgaacgccctggacgtgatgaagcaccagccctaccagctgaacgccagcctgttcaccttccagccccccgacgccaaggacggcctgccccagaagagcagcgtgaaggtgaacagcgccctggccatgaagcaggccctgccccccagacccgtgaacgccgccagccccaccaacgtgcaggccagcagcgtgtacagcgtgcccgcctacaccagcccccccagcttcttcgccgaggccagcagccccgtgagcgccagccccgtgcccgtgggcatccccaccagccccaagcaggagagcgccagcagcagctacttcgtggcccccagacccaagttcagcgccaagaagagcggcgtgaccatccaggtgtggaagcccagcgtggtggaggagtag

SEQ ID NO: 12120 - DNA, 600 bp, Artificial Sequence
  Description of Artificial Sequence: Synthetic coding sequence
atggccatcgtgcagaccctgcccgtgcccctggagcccgcccccgaggccgccaccgccccccaggcccccgtgatgggcagcgtgagcagcctgatcagcggcagaccctgccccggcggccccgccccccccagacaccacggcccccccggccccaccttcttcagacagcaggacggcctgctgagaggcggctacgaggcccaggagcccctgtgccccgccgtgccccccagaaaggccgtgcccgtgaccagcttcacctacatcaacgaggacttcagaaccgagagcccccccagccccagcagcgacgtggaggacgccagagagcagagagcccacaacgcccacctgagaggccccccccccaagctgatccccgtgagcggcaagctggagaagaacatggagaagatcctgatcagacccaccgccttcaagcccgtgctgcccaagcccagaggcgcccccagcctgcccagcttcatgggccccagagccaccggcctgagcggcagccagggcagcctgacccagctgttcggcggccccgccagcagcagcagcagcagcagcagcagcagcgccgcctag

SEQ ID NO: 12121 - DNA, 612 bp, Artificial Sequence
  Description of Artificial Sequence: Synthetic coding sequence
atgcccagcacccccgccagcaccatcagcgccagagaggagctggtgcagagaatccccgaggccagcctgaacttccagaaggtgccccccggcagcctgaacagcagagacttcgaccagaacatgaacgacagctgcgaggacgccctggccaacaagaccagacccagaaacagagaggaggtgatcttcgacaacctgatgctgaaccccgtgagccagctgagccaggccatcagagagaacaccgagcacctggccgagaagatgaagatcctgttccagaacaccggcagagcctgggaggacctggaggccagaatcaacgccgagaacgaggtgcccatcctgaagaccagcaacaaggagatcagcagcatcctgaaggagctgagaagagtgcagaagcagctggaggtgatcaacgccatcgtggaccccagcggcagcctggacctgctgctgcccaccctgagcagcttcgtgccccccccccccgccttcgcctgggagctggtgctggtgtgcagagccagcagaagagtgcactgcaccttcgtgctgagatggagctgcggctgcctgagcgagaacggctacttcatctag

SEQ ID NO: 12122 - DNA, 321 bp, Artificial Sequence
  Description of Artificial Sequence: Synthetic coding sequence
tgacccaccaccagcagacccgccctggacgtgaagggcggcaccagccccgccaaggaggacgccaaccaggagatgagcagcgtggcctacagcaacctggccgtgaaggacagaaaggccgtggccatcctgcactaccccggcgtggccagcaacggcaccaagagccccgccatcatcgacagcgaccccgtggacgaggaggtgctgatgagcctggtggtggagctgggcctggacagagccaacgagctgcccgagctgtggctgggccagaacgagttcgacttcaccgccgacttccccagcagctgctag

SEQ ID NO: 12123 - DNA, 456 bp, Artificial Sequence
  Description of Artificial Sequence: Synthetic coding sequence
atggccgccttcagagacatcgaggaggtgagccagggcctgctgagcctgctgggcgccaacagagccgaggcccagcagagaagactgctgggcagacacgagcaggtggtggagagactgctggagacccaggacggcgccgagaagcagctgagagagatcctgaccatggagaaggaggtggcccagagcctgctgaacgccaaggagcaggagagacaggagaaggaggtggacgaggacaccaccgtgaccatccccagcgccgtgtacgtggcccagctgtaccaccaggtgagcaagatcgagtgggactacgagtgcgagcccggcatggtgaagggcatccaccacggccccagcgtggcccagcccatccacctggacagcacccagctgagcagaaagttcatcagcgactacctgtggagcctggtggacaccgagtggtag

SEQ ID NO: 12124 - DNA, 444 bp, Artificial Sequence
  Description of Artificial Sequence: Synthetic coding sequence
atgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagaccctag

SEQ ID NO: 12125 - DNA, 1482 bp, Artificial Sequence
  Description of Artificial Sequence: Synthetic coding sequence
atggagaagtacgagaacctgggcctggtgggcgagggcagctacggcatggtgatgaagtgcagaaacaaggacaccggcagaatcgtggccatcaagaagttcctggagagcgacgacgacaagatggtgaagaagatcgccatgagagagatcaagctgctgaagcagctgagacacgagaacctggtgaacctgctggaggtgtgcaagaagaagaagagatggtacctggtgttcgagttcgtggaccacaccatcctggacgacctggagctgttccccaacggcctggactaccaggtggtgcagaagtacctgttccagatcatcaacggcatcggcttctgccacagccacaacatcatccacagagacatcaagcccgagaacatcctggtgagccagagcggcgtggtgaagctgtgcgacttcggcttcgccagaaccctggccgcccccggcgaggtgtacaccgactacgtggccaccagatggtacagagcccccgagctgctggtgggcgacgtgaagtacggcaaggccgtggacgtgtgggccatcggctgcctggtgaccgagatgttcatgggcgagcccctgttccccggcgacagcgacatcgaccagctgtaccacatcatgatgtgcctgggcaacctgatccccagacaccaggagctgttcaacaagaaccccgtgttcgccggcgtgagactgcccgagatcaaggagagagagcccctggagagaagataccccaagctgagcgaggtggtgatcgacctggccaagaagtgcctgcacatcgaccccgacaagagacccttctgcgccgagctgctgcaccacgacttcttccagatggacggcttcgccgagagattcagccaggagctgcagctgaaggtgcagaaggacgccagaaacgtgagcctgagcaagaagagccagaacagaaagaaggagaaggagaaggacgacagcctggtggaggagagaaagaccctggtggtgcaggacaccaacgccgaccccaagatcaaggactacaagctgttcaagatcaagggcagcaagatcgacggcgagaaggccgagaagggcaacagagccagcaacgccagctgcctgcacgacagcagaaccagccacaacaagatcgtgcccagcaccagcctgaaggactgcagcaacgtgagcgtggaccacaccagaaaccccagcgtggccatcccccccctgacccacaacctgagcgccgtggcccccagcatcaacagcggcatgggcaccgagaccatccccatccagggctacagagtggacgagaagaccaagaagtgcagcatccccttcgtgaagcccaacagacacagccccagcggcatctacaacatcaacgtgaccaccctggtgagcggcccccccctgagcgacgacagcggcgccgacctgccccagatggagcaccagcactag

SEQ ID NO: 12126 - DNA, 6189 bp, Artificial Sequence
  Description of Artificial Sequence: Synthetic coding sequence
atggacggctgcctggacaccgagacccccaccgtgagcatccaggagaacgtggacgtggccagcctgaagcccatcagcgacagcggcatcaacttcaccgacgccatctggagccccacctgcgagagaagaacctgcgagtgccacgagagcatcgagaagaacaaggacaagaccgacctgccccagagcgtggtgtaccagaacgaggagggcagatgggtgaccgacctggcctactacaccagcttcaacagcaagcagaacctgaacgtgagcctgagcgacgagatgaacgaggacttcagaagcggcagcgaggccttcgacctgatcgcccaggacgaggaggagttcaacaaggagcaccagttcatccagcccagcttcggctacttcatcagaagccccgagaagagagagcccatcgccctgatcagaaagagcgacgtgagcagaggcaacctggagaaggagatggcccacctgaaccacgacctgtacagcggcgacctgaacgagcagagccaggcccagctgagcgagggcagcatcaccctgcaggtggaggccgtggagagcaccagccaggtggacgagaacgacgtgaccctgaccgccgacaagggcaagaccgaggacaccttcttcatgagcaacaagccccagagatacaaggacaagctgcccgacagcggcgacagcatgctgagaatcagcaccatcgccagcgccatcgccgaggccagcgtgaacaccgaccccagccagctggccgccatgatcaaggccctgagcaacaagaccagagacaagaccttccaggaggacgagaagcagaaggactacagccacgtgagacacttcctgcccaacgacctggagaagagcaacggcagcaacgccctggacatggagaagtacctgaagaagaccgaggtgagcagatacgagagcgccctggagaacttcagcagagccagcatgagcgacacctgggacctgagcctgcccaaggagcagaccacccaggacatccaccccgtggacctgagcgccaccagcgtgagcgtgagagcccccgaggagaacaccgccgccatcgtgtacgtggagaacggcgagagcgagaaccaggagagcttcagaaccatcaacagcagcaacagcgtgaccaacagagagaacaacagcgccgtggtggacgtgaagacctgcagcatcgacaacaagctgcaggacgtgggcaacgacgagaaggccaccagcatcagcacccccagcgacagctacagcagcgtgagaaaccccagaatcaccagcctgtgcctgctgaaggactgcgaggagatcagagacaacagagagaaccagagacagaacgagtgcgtgagcgagatcagcaacagcgagaagcacgtgaccttcgagaaccacagaatcgtgagccccaagaacagcgacctgaagaacaccagccccgagcacggcggcagaggcagcgaggacgagcaggagagcttcagacccagcaccagccccctgagccacagcagccccagcgagatcagcggcaccagcagcagcggctgcgccctggagagcttcggcagcgccgcccagcagcagcagcccccctgcgagcaggagctgagccccctggtgtgcagccccgccggcgtgagcagactgacctacgtgagcgagcccgagagcagctaccccaccaccgccaccgacgacgccctggaggacagaaagagcgacatcaccagcgagctgagcaccaccatcatccagggcagccccgccgccctggaggagagagccatggagaagctgagagagaaggtgcccttccagaacagaggcaagggcaccctgagcagcatcatccagaacaacagcgacaccagaaaggccaccgagaccaccagcctgagcagcaagcccgagtacgtgaagcccgacttcagatggagcaaggaccccagcagcaagagcggcaacctgctggagaccagcgaggtgggctggaccagcaaccccgaggagctggaccccatcagactggccctgctgggcaagagcggcctgagctgccaggtgggcagcgccaccagccaccccgtgagctgccaggagcccatcgacgaggaccagagaatcagccccaaggacaagagcaccgccggcagagagttcagcggccaggtgagccaccagaccaccagcgagaaccagtgcacccccatccccagcagcaccgtgcacagcagcgtggccgacatgcagaacatgcccgccgccgtgcacgccctgctgacccagcccagcctgagcgccgcccccttcgcccagagatacctgggcaccctgcccagcaccggcagcaccaccctgccccagtgccacgccggcaacgccaccgtgtgcggcttcagcggcggcctgccctaccccgccgtggccggcgagcccgtgcagaacagcgtggccgtgggcatctgcctgggcagcaacatcggcagcggctggatgggcaccagcagcctgtgcaacccctacagcaacaccctgaaccagaacctgctgagcaccaccaagcccttccccgtgcccagcgtgggcaccaactgcggcatcgagccctgggacagcggcgtgaccagcggcctgggcagcgtgagagtgcccgaggagctgaagctgccccacgcctgctgcgtgggcatcgccagccagaccctgctgagcgtgctgaaccccaccgacagatggctgcaggtgagcatcggcgtgctgagcatcagcgtgaacggcgagaaggtggacctgagcacctacagatgcctggtgttcaagaacaaggccatcatcagaccccacgccaccgaggagatcaaggtgctgttcatccccagcagccccggcgtgttcagatgcaccttcagcgtggccagctggccctgcagcaccgacgccgagaccatcgtgcaggccgaggccctggccagcaccgtgaccctgaccgccatcgccgagagccccgtgatcgaggtggagaccgagaagaaggacgtgctggacttcggcgacctgacctacggcggctggaaggccctgcccctgaagctgatcaacagaacccacgccaccgtgcccatcagactgatcatcaacgccaacgccgtggcctggagatgcttcaccttcagcaaggagagcgtgagagcccccgtggaggtggccccctgcgccgacgtggtgaccagactggccggccccagcgtggtgaaccacatgatgcccgccagctacgacggccaggaccccgagttcctgatgatctgggtgctgttccacagccccaagaagcagatcagcagcagcgacatcctggacagcgccgaggagttcagcgccaaggtggacatcgaggtggacagccccaaccccacccccgtgctgagaagcgtgagcctgagagccagagccggcatcgccagaatccacgcccccagagacctgcagaccatgcacttcctggccaaggtggccagcagcagaaagcagcacctgcccctgaagaacgccggcaacatcgaggtgtacctggacatcaaggtgcccgagcagggcagccacttcagcgtggaccccaagaacctgctgctgaagcccggcgaggagcacgaggtgatcgtgagcttcacccccaaggaccccgaggcctgcgaggagagaatcctgaagatcttcgtgcagcccttcggcccccagtacgaggtggtgctgaagggcgaggtgatcagcagcggcagcaagcccctgagccccggcccctgcctggacatccccagcatcctgagcaacaagcagttcctggcctggggcggcgtgcccctgggcagaacccagctgcagaagctggccctgagaaacaacagcgccagcaccacccagcacctgagactgctgatcagaggccaggaccaggactgcttccagctgcagaacaccttcggcagcgagcagagactgaccagcaactgcgagatcagaatccaccccaaggaggacatcttcatcagcgtgctgttcgcccccaccagactgagctgcatgctggccagactggagatcaagcagctgggcaacagaagccagcccggcatcaagttcaccatccccctgagcggctacggcggcaccagcaacctgatcctggagggcgtgaagaagctgagcgacagctacatggtgaccgtgaacggcctggtgcccggcaaggagagcaagatcgtgttcagcgtgagaaacaccggcagcagagccgccttcgtgaaggccgtgggcttcaaggacagccagaagaaggtgctgctggaccccaaggtgctgagaatcttccccgacaagttcgtgctgaaggagagaacccaggagaacgtgaccctgatctacaaccccagcgacagaggcatcaacaacaagaccgccaccgagctgagcaccgtgtacctgttcggcggcgacgagatcagcagacagcagtacagaagagccctgctgcacaagcccgagatgatcaagcagatcctgcccgagcacagcgtgctgcagaacatcaacttcgtggaggccttccaggacgagctgctggtgaccgaggtgtacgacctgccccagagacccaacgacgtgcagctgttctacggcagcatgtgcaagatcatcctgagcgtgatcggcgagttcagagactgcatcagcagcagagagttcctgcagcccagcagcaaggccagcctggagagcaccagcgacctgggcgccagcggcaagcacggcggcaacgtgagcctggacgtgctgcccgtgaagggcccccagggcagccccctgctgagcagagccgccagaccccccctggaccagctggccagcgaggagccctggaccgtgctgcccgagcacctgatcctggtggcccccagcccctgcgacatggccaagaccggcagattccagatcgtgaacaacagcgtgagactgctgagattcgagctgtgctggcccgcccactgcctgaccgtgaccccccagcacggctgcgtggcccccgagagcaagctgcagatcctggtgagccccaacagcagcctgagcaccaagcagagcatgttcccctggagcggcctgatctacatccactgcgacgacggccagaagaagatcgtgaaggtgcagatcagagaggacctgacccaggtggagctgctgaccagactgaccagcaagcccttcggcatcctgagccccgtgagcgagcccagcgtgagccacctggtgaagcccatgaccaagccccccagcaccaaggtggagatcagaaacaagagcatcaccttccccaccaccgagcccggcgagaccagcgagagctgcctggagctggagaaccacggcaccaccgacgtgaagtggcacctgagcagcctggcccccccctacgtgaagggcgtggacgagagcggcgacgtgttcagagccacctacgccgccttcagatgcagccccatcagcggcctgctggagagccacggcatccagaaggtgagcatcaccttcctgcccagaggcagaggcgactacgcccagttctgggacgtggagtgccaccccctgaaggagccccacatgaagcacaccctgagattccagctgagcggccagagcatcgaggccgagaacgagcccgagaacgcctgcctgagcaccgacagcctgatcaagatcgaccacctggtgaagcccagaagacaggccgtgagcgaggccagcgccagaatccccgagcagctggacgtgaccgccagaggcgtgtacgcccccgaggacgtgtacagattcagacccaccagcgtgggcgagagcagaaccctgaaggtgaacctgagaaacaacagcttcatcacccacagcctgaagttcctgagccccagagagcccttctacgtgaagcacagcaagtacagcctgagagcccagcactacatcaacatgcccgtgcagttcaagcccaagagcgccggcaagttcgaggccctgctggtgatccagaccgacgagggcaagagcatcgccatcagactgatcggcgaggccctgggcaagaactag

SEQ ID NO: 12127 - DNA, 1545 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggccgaggtgagcatcaacgaggacggcaccctgttcgacggcagacccatcgagagcctgagcctgatcgacgccgtgatgcccgacgtggtgcagaccagacagcaggcctacagagacaagctggcccagcagcaggccgccgccgccgccgccgccgccgccgccgccagccagcagggcagcgccaagaacggcgagaacaccgccaacggcgaggagaacggcgcccacaccatcgccaacaaccacaccgacatgatggaggtggacggcgacgtggagatcccccccaacaaggccgtggtgctgagaggccacgagagcgaggtgttcatctgcgcctggaaccccgtgagcgacctgctggccagcggcagcggcgacagcaccgccagaatctggaacctgagcgagaacagcaccagcggcagcacccagctggtgctgagacactgcatcagagagggcggccaggacgtgcccagcaacaaggacgtgaccagcctggactggaacagcgagggcaccctgctggccaccggcagctacgacggcttcgccagaatctggaccaaggacggcaacctggccagcaccctgggccagcacaagggccccatcttcgccctgaagtggaacaagaagggcaacttcatcctgagcgccggcgtggacaagaccaccatcatctgggacgcccacaccggcgaggccaagcagcagttccccttccacagcgcccccgccctggacgtggactggcagagcaacaacaccttcgccagctgcagcaccgacatgtgcatccacgtgtgcaagctgggccaggacagacccatcaagaccttccagggccacaccaacgaggtgaacgccatcaagtgggaccccaccggcaacctgctggccagctgcagcgacgacatgaccctgaagatctggagcatgaagcaggacaactgcgtgcacgacctgcaggcccacaacaaggagatctacaccatcaagtggagccccaccggccccggcaccaacaaccccaacgccaacctgatgctggccagcgccagcttcgacagcaccgtgagactgtgggacgtggacagaggcatctgcatccacaccctgaccaagcaccaggagcccgtgtacagcgtggccttcagccccgacggcagatacctggccagcggcagcttcgacaagtgcgtgcacatctggaacacccagaccggcgccctggtgcacagctacagaggcaccggcggcatcttcgaggtgtgctggaacgccgccggcgacaaggtgggcgccagcgccagcgacggcagcgtgtgcgtgctggacctgagaaagtag

SEQ ID NO: 12128 - DNA, 2034 bp, Artificial Sequence
  Description of Artificial Sequence: Synthetic coding sequence
atggaggagaccatgaagctggccaccatggaggacaccgtggagtactgcctgttcctgatccccgacgagagcagagacagcgacaagcacaaggagatcctgcagaagtacatcgagagaatcatcaccagattcgcccccatgctggtgccctacatctggcagaaccagcccttcaacctgaagtacaagcccggcaagggcggcgtgcccgcccacatgttcggcgtgaccaagttcggcgacaacatcgaggacgagtggttcatcgtgtacgtgatcaagcagatcaccaaggagttccccgagctggtggccagaatcgaggacaacgacggcgagttcctgctgatcgaggccgccgacttcctgcccaagtggctggaccccgagaacagcaccaacagagtgttcttctgccacggcgagctgtgcatcatccccgcccccagaaagagcggcgccgagagctggctgcccaccaccccccccaccatcccccaggccctgaacatcatcaccgcccacagcgagaagatcctggccagcgagagcatcagagccgccgtgaacagaagaatcagaggctaccccgagaagatccaggccagcctgcacagagcccactgcttcctgcccgccggcatcgtggccgtgctgaagcagagacccagactggtggccgccgccgtgcaggccttctacctgagagaccccatcgacctgagagcctgcagagtgttcaagaccttcctgcccgagaccagaatcatgaccagcgtgaccttcaccaagtgcctgtacgcccagctggtgcagcagagattcgtgcccgacagaagaagcggctacagactgcccccccccagcgacccccagtacagagcccacgagctgggcatgaagctggcccacggcttcgagatcctgtgcagcaagtgcagcccccacttcagcgactgcaagaagagcctggtgaccgccagccccctgtgggccagcttcctggagagcctgaagaagaacgactacttcaagggcctgatcgagggcagcgcccagtacagagagagactggagatggccgagaactacttccagctgagcgtggactggcccgagagactggaggtgcagtggagagaccccggcctgctgcaggcccccccccccggcttcacccccttcatctgcctgagcctgctgagcacctgggacaacagcagcctggccatgagccccggcgaggagatcctgaccctgctgcagaccatccccttcgacatcgaggacctgaagaaggaggccgccaacctgccccccgaggacgacgaccagtggctggacctgagccccgaccagctggaccagctgctgcaggaggccgtgggcaagaaggagagcgagagcgtgagcaaggaggagaaggagcagaactacgacctgaccgaggtgagcgagagcatgaaggccttcatcagcaaggtgagcacccacaagggcgccgagctgcccagagagcccagcgaggcccccatcaccttcgacgccgacagcttcctgaactacttcgacaagatcctgggccccagacccaacgagagcgacagcgacgacctggacgacgaggacttcgagtgcctggacagcgacgacgacctggacttcgagacccacgagcccggcgaggaggccagcctgaagggcaccctggacaacctgaagagctacatggcccagatggaccaggagctggcccacacctgcatcagcaagagcttcaccaccagaaaccaggtggagcccgtgagccagaccaccgacaacaacagcgacgaggaggacagcggcaccggcgagagcgtgatggcccccgtggacgtggacctgaacctggtgagcaacatcctggagagctacagcagccaggccggcctggccggccccgccagcaacctgctgcagagcatgggcgtgcagctgcccgacaacaccgaccacagacccaccagcaagcccaccaagaactag

SEQ ID NO: 12129 - DNA, 1821 bp, Artificial Sequence
  Description of Artificial Sequence: Synthetic coding sequence
atggaggagagccccctgagcagagcccccagcagaggcggcgtgaacttcctgaacgtggccagaacctacatccccaacaccaaggtggagtgccactacaccctgccccccggcaccatgcccagcgccagcgactggatcggcatcttcaaggtggaggccgcctgcgtgagagactaccacaccttcgtgtggagcagcgtgcccgagagcaccaccgacggcagccccatccacaccagcgtgcagttccaggagcccagacccatggacgagctggtgaccctggaggaggccgacggcggcagcgacatcctgctggtggtgcccaaggccaccgtgctgcagaaccagctggacgagagccagcaggagagaaacgacctgatgcagctgaagctgcagctggagggccaggtgaccgagctgagaagcagagtgcaggagctggagagagccctggccaccgccagacaggagcacaccgagctgatggagcagtacaagggcatcagcagaagccacggcgagatcaccgaggagagagacatcctgagcagacagcagggcgaccacgtggccagaatcctggagctggaggacgacatccagaccatcagcgagaaggtgctgaccaaggaggtggagctggacagactgagagacaccgtgaaggccctgaccagagagcaggagaagctgctgggccagctgaaggaggtgcaggccgacaaggagcagagcgaggccgagctggagcccctgaaggagcagctgagaggcgcccaggagctggccgccagcagccagcagaaggccaccctgctgggcgaggagctggccagcgccgccgccgccagagacagaaccatcgccgagctgcacagaagcagactggaggtggccgaggtgaacggcagactggccgagctgggcctgcacctgaaggaggagaagtgccagtggagcaaggagagagccggcctgctgcagagcgtggaggccgagaaggacaagatcctgaagctgagcgccgagatcctgagactggagaaggccgtgcaggaggagagaacccagaaccaggtgttcaagaccgagctggccagagagaaggacagcagcctggtgcagctgagcgagagcaagagagagctgaccgagctgagaagcgccctgagagtgctgcagaaggagaaggagcagctgcaggaggagaagcaggagctgctggagtacatgagaaagctggaggccagactggagaaggtggccgacgagaagtggaacgaggacgccaccaccgaggacgaggaggccgccgtgggcctgagctgccccgccgccctgaccgacagcgaggacgagagccccgaggacatgagactgcccccctacggcctgtgcgagagaggcgaccccggcagcagccccgccggccccagagaggccagccccctggtggtgatcagccagcccgcccccatcagcccccacctgagcggccccgccgaggacagcagcagcgacagcgaggccgaggacgagaagagcgtgctgatggccgccgtgcagagcggcggcgaggaggccaacctgctgctgcccgagctgggcagcgccttctacgacatggccagcggcttcaccgtgggcaccctgagcgagaccagcaccggcggccccgccacccccacctggaaggagtgccccatctgcaaggagagattccccgccgagagcgacaaggacgccctggaggaccacatggacggccacttcttcttcagcacccaggaccccttcaccttcgagtag

SEQ ID NO: 12130 - DNA, 2997 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttcggcagctgcctggacaccttcttcggcctgaccgccaccggcctgcacagatacatccaggaccccaacaagatccccgagaccctggacaacgacaccacccagaacctgctgaccaaggccgtggagacctgcttcgtgggccagagcttcatcttcggcgtgaccaacttcgagaaccagcccggccagggcagcgacgccagcaacttcctgcagcagtgcagcgaccacaagagaaaggccaaggccctggtggcctgccagatcgtgctgcccgaccccggcatcgccggcttcaccgtgatcgactacttccaccagctgctgcagaccttcaacttcagaaagctgcagtgcgacagccaggcccccaacaaccacctgctggccctggaccacagcaacagcgacctgagcagcatctacaccagcgacagcaccagcgacttcttcaagagctgcagcaaggacaccttcagcaagttctggcagcccagcctggagttcacctgcatcgtgagccagctgaccgacaacgacgacttcagcgccagcgagcagagcaaggccttcggcaccctgcagcagaacagaaagagcatcagcatcgccgaggccaccggcagcagcagctgccacgaccccatccaggacagctggagcctggtgagctacatggacaagaagagcaccgccgagaagctgggcaaggagctgggcctgcaggccaaggagctgagcgccgtgcacagcagccaccacgagatcggcgtgaacgacagcaacctgttcagcctggagatgagagagcccctggagagcagcaacaccaagagcttccacagcgccgtggagatcaagaacagaagccagcacgagctgccctgcttccagcaccacggcatcgacacccccaccagcctgcagaagagaagcgcctgctgcccccccagcctgctgagactggaggagaccgccagcagcagccaggacggcgacccccagatctgggacgacctgcccttcagcgagagcctgaacaagttcctggccgtgctggagagcgagatcgccgtgacccaggccgacgtgagcagcagaaagcaccacgtggacaacgacatcgacaagttccacgccgaccacagcagactgagcgtgaccccccagagaaccaccggcgccctgcacaccccccccatcgccctgagaagcagccaggtgatcgtgaaggccaactgcagcaaggacgacttcctgttcaactgcaagggcaacctgagccccagcgtggagaaggagagccagcccgacaacaaggtggaggccgtgagcgtgaaccacaacggcagagacatgagcgagtacttcctgcccaacccctacctgagcgccctgagcagcagcagcaaggacctggagaccatcgtgaccctgaagaagaccatcagaatcagcccccacagagagagcgaccacagcagcctgaacaacaagtacctgaacggctgcggcgagatcagcgtgagcgagatgaacgagaagctgaccaccctgtgctacagaaagtacaacgacgtgagcgacctgtgcaagctggagaacaagcagtactgcagatggagcaagaaccaggacgacagcttcaccatctgcagaaagctgacctaccccctggagaccctgtgcaacagccccaacagaagcaccaacaccctgaaggagatgccctggggccacatcaacaacaacgtgacccagagctacagcatcggctacgagggcagctacgacgccagcgccgacctgttcgacgacatcgccaaggagatggacatcgccaccgagatcaccaagaagagccaggacatcctgctgaagtggggcaccagcctggccgagagccaccccagcgagagcgacttcagcctgagaagcctgagcgaggacttcatccagcccagccagaagctgagcctgcagagcctgagcgacagcagacacagcagaacctgcagccccaccccccacttccagagcgacagcgagtacaacttcgagaacagccaggacttcgtgccctgcagccagagcacccccatcagcggcttccaccagaccagaatccacggcatcaacagagccttcaagaagcccgtgttctacagcgacctggacggcaactacgagaagatcagaatcttccccgagaacgacaagcagcaggccagccccagctgccccaagaacatcaagacccccagccagaagatcagaagccccatcgtgagcggcgtgagccagcccgacgtgttcaaccactaccccttcgccgagtgccacgagaccgacagcgacgagtgggtgccccccaccacccagaagatcttccccagcgacatgctgggcttccagggcatcggcctgggcaagtgcctggccgcctaccacttccccgaccagcaggagctgcccagaaagaagctgaagcacatcagacagggcaccaacaagggcctgatcaagaagaagctgaagaacatgctggccgccgtggtgaccaagaagaagacccacaagtacaactgcaagagcagcggctggatcagcaagtgccccgacatccaggtgctggccgccccccagctgcaccccatcctgggccccgacagctgcagcgaggtgaagtgctgcctgcccttcagcgagaagggcccccccagcgtgtgcgagaccagaagcgcctggagccccgagctgttcagctag

SEQ ID NO: 12131 - DNA, 471 bp, Artificial Sequence
  Description of Artificial Sequence: Synthetic coding sequence
atggccgacagccccggcggctacaaggagtgcggcaccaacgagggcccccaggaggacgagaacggcagcagcgccagcggcagcagcaaggtgagacagctgtggagcgaggacagctgcgagagcggcaagctgcccgccaccagaaccgtgtactgcatgaacgaggccgagatcgtggacgtggccctgggcatcctgatcgagagcagaaagcaggagaaggcctgcgagcagcccgccctggccggcgccgacaaccccgagcacagccccccctgcagcgtgagcccccacaccagcagcggcagcagcagcgaggaggaggacagcggcaagcaggccctggcccccggcctgagccccagccagagacccggcggcagcagcagcgcctgcagcagaagccccgaggaggaggaggaggaggacgtgctgaagtacgtgagagagatcttcttcagctag

SEQ ID NO: 12132 - DNA, 1377 bp, Artificial Sequence
  Description of Artificial Sequence: Synthetic coding sequence
atggccgagctgcagatgctgctggaggaggagatccccggcggcagaagagccctgttcgacagctacaccaacctggagagagtggccgactactgcgagaacaactacatccagagcgccgacaagcagagagccctggaggagaccaaggcctacaccacccagagcctggccagcgtggcctacctgatcaacaccctggccaacaacgtgctgcagatgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacctggagagacccgtgagatacatcagaaagcccatcgactacaccatcctggacgacatcggccacggcgtgaaggtgagcacccagaacatgaagatgggcggcctgcccagaaccaccccccccacccagaagccccccagcccccccatgagcggcaagggcaccctgggcagcagcggcagcagcggcggcagccaccccagcagcagaagcagcagcagagagaacagcggcagcggcagcgtgggcgtgcccatcgccgtgcccacccccagcccccccagcgtgttccccgcccccgccggcagcgccggcaccccccccctgcccgccaccagcgccagcgcccccgcccccctggtgcccgccaccgtgcccagcagcaccgcccccgacgccgccgccggcggcgcccagaccctggccgacggcttcaccagccccaccccccccgtggtgagcagcaccccccccaccggccaccccgtgcagttctacagcatgaacagacccgccagcagacacaccccccccaccatcggcggcagcctgccctacagaagaccccccagcatcaccagccagaccagcctgcagaaccagatgaacggcggccccttctacagccagaaccccgtgagcgacaccccccccccccccccccccgtggaggagcccgtgttcgacgagagccccccccccccccccccccccgaggactacgaggaggaggaggccgccgtggtggagtacagcgacccctacgccgaggaggaccccccctgggcccccagaagctacctggagaaggtggtggccatctacgactacaccaaggacaaggaggacgagctgagcttccaggagggcgccatcatctacgtgatcaagaagaacgacgacggctggtacgagggcgtgatgaacggcgtgaccggcctgttccccggcaactacgtggagagcatcatgcactacagcgagtag

SEQ ID NO: 12133 - DNA, 5223 bp, Artificial Sequence
  Description of Artificial Sequence: Synthetic coding sequence
tgaaagatctaccccgaggagatcacccccctgctgcccgccatcagcggcgagaagatcgccgaggaccagacctgcttcttcctgcagatcctgctgaagtacatggtgatccaggccgccagcctggagtggaagaacaaggagaaccaggacaccggcttcaagttcctgttcaccctgttcagaaagtactacctgccccacctgttccccagcttcaccaagctgaccaacatctacaagcccgtgctggacatcccccacctgagacccaagcccgtgtacatcaccaccaccagagacaacgagaacatctacagcaccaagatcccctacatggccgccagagtggtgttcatcaagtggatcgtgaccttcttcctggagaagaagtacctgaccgccacccagaacaccaagaacggcgtggacgtgctgcccaagatcatccagaccgtgggcggcggcgccgtgcaggagagagcccccgagctggacggcggcggccccaccgagcaggacaagagccacagcaacagcagcaccctgagcgacagaagactgagcaacagcagcctgtgcagcatcgaggaggagcacagaatggtgtacgagatggtgcagagaatcctgctgagcaccagaggctacgtgaacttcgtgaacgaggtgttccaccaggccttcctgctgcccagctgcgagatcgccgtgaccagaaaggtggtgcaggtgtacagaaagtggatcctgcaggacaagcccgtgttcatggaggagcccgacagaaaggacgtggcccaggaggacgccgagaagctgggcttcagcgagaccgacagcaaggaggccagcagcgagagcagcggccacaagagaagcagcagctggggcagaacctacagcttcaccagcgccatgagcagaggctgcgtgaccgaggaggagaacaccaacgtgaaggccggcgtgcaggccctgctgcaggtgttcctgaccaacagcgccaacatcttcctgctggagccctgcgccgaggtgcccgtgctgctgaaggagcaggtggacgcctgcaaggccgtgctgatcatcttcagaagaatgatcatggagctgaccatgaacaagaagacctgggagcagatgctgcagatcctgctgagaatcaccgaggccgtgatgcagaagcccaaggacaagcagatcaaggacctgttcgcccagagcctggccggcctgctgttcagaaccctgatggtggcctggatcagagccaacctgtgcgtgtacatcagcagagagctgtgggacgacttcctgggcgtgctgagcagcctgaccgagtgggaggagctgatcaacgagtgggccaacatcatggacagcctgaccgccgtgctggccagaaccgtgtacggcgtggagatgaccaacctgcccctggacaagctgagcgagcagaaggagaagaagcagagaggcaagggctgcgtgctggacccccagaagggcaccaccgtgggcagaagcttcagcctgagctggagaagccaccccgacgtgaccgagcccatgagattcagaagcgccaccaccagcggcgcccccggcgtggagaaggccagaaacatcgtgagacagaaggccaccgaggtggaggagtgccagcagagcgagaacgcccccgccgccggcagcggccacctgaccgtgggccagcagcagcaggtgctgagaagcagcagcaccagcgacatccccgagcccctgtgcagcgacagcagccagggccagaaggccgagaacacccagaacagcagcagcagcgagccccagcccatccaggagaacaagggccacgtgaagagagagcacgagggcatcaccatcctggtgagaagaagcagcagccccgccgagctggacctgaaggacgacctgcagcagacccagggcaagtgcagagagagacagaagagcgagagcaccaacagcgacaccaccctgggctgcaccaacgaggccgagctgagcatgggcccctggcagacctgcgaggaggaccccgagctgaacacccccaccgacgtggtggccgacgccgacgccagacactggctgcagctgagccccaccgacgccagcaacctgaccgacagcagcgagtgcctgaccgacgactgcagcatcatcgccggcggcagcctgaccggctggcaccccgacagcgccgccgtgctgtggagaagagtgctgggcatcctgggcgacgtgaacaacatccagagccccaagatccacgccagagtgttctgctacctgtacgagctgtggtacaagctggccaagatcagagacaacctggccatcagcctggacaaccagagcagccccagcccccccgtgctgatcccccccctgagaatgttcgccagctggctgttcaaggccgccaccctgcccaacgagtacaaggagggcaagctgcaggcctacagactgatctgcgccatgatgaccagaagacaggacgtgctgcccaacagcgacttcctggtgcacttctacctggtgatgcacctgggcctgaccagcgaggaccaggacatcctgaacaccatcatcagacactgcccccccagattcttcagcctgggcttccccggcttcagcatgctggtgggcgacttcatcaccgccgccgccagagtgctgagcaccgacatcctgaccgcccccagaagcgaggccgtgaccgtgctgggcagcctggtgtgcttccccaacacctaccaggagatccccctgctgcagagcgtgcccgaggtgaacgaggccatcaccggcaccgaggacgtgaagcactacctgatcaacatcctgctgaagaacgccaccgaggagcccaacgagtacgccagatgcatcgccgtgtgcagcctgggcgtgtggatctgcgaggagctggcccagtgcaccagccacccccaggtgaaggaggccatcaacgtgatcggcgtgaccctgaagttccccaacaagatcgtggcccaggtggcctgcgacgtgctgcagctgctggtgagctactgggagaagctgcagatgttcgagaccagcctgcccagaaagatggccgagatcctggtggccaccgtggccttcctgctgcccagcgccgagtacagcagcgtggagaccgacaagaagttcatcgtgagcctgctgctgtgcctgctggactggtgcatggccctgcccgtgagcgtgctgctgcaccccgtgagcaccgccgtgctggaggagcagcacagcgccagagcccccctgctggactacatctacagagtgctgcactgctgcgtgtgcggcagcagcacctacacccagcagagccactacatcctgaccctggccgacctgagcagcaccgactacgaccccttcctgcccctggccaacgtgaagagcagcgagcccgtgcagtaccacagcagcgccgagctgggcaacctgctgaccgtggaggaggagaagaagagaagaagcctggagctgatccccctgaccgccagaatggtgatggcccacctggtgaaccacctgggccactaccccctgagcggcggccccgccatcctgcacagcctggtgagcgagaaccacgacaacgcccacgtggagggcagcgagctgagcttcgaggtgttcagaagccccaacctgcagctgttcgtgttcaacgacagcaccctgatcagctacctgcagacccccaccgagggccccgtgggcggcagccccgtgggcagcctgagcgacgtgagagtgatcgtgagagacatcagcggcaagtacagctgggacggcaaggtgctgtacggccccctggagggctgcctggcccccaacggcagaaaccccagcttcctgatcagcagctggcacagagacaccttcggcccccagaaggacagcagccaggtggaggagggcgacgacgtgctggacaagctgctggagaacatcggccacaccagccccgagtgcctgctgcccagccagctgaacctgaacgagcccagcctgaccccctgcggcatgaactacgaccaggagaaggagatcatcgaggtgatcctgagacagaacgcccaggaggacgagtacatccagagccacaacttcgacagcgccatgaaggtgaccagccagggccagcccagccccgtggagcccagaggccccttctacttctgcagactgctgctggacgacctgggcatgaacagctgggacagaagaaagaacttccacctgctgaagaagaacagcaagctgctgagagagctgaagaacctggacagcagacagtgcagagagacccacaagatcgccgtgttctacatcgccgagggccaggaggacaagtgcagcatcctgagcaacgagagaggcagccaggcctacgaggacttcgtggccggcctgggctgggaggtggacctgagcacccactgcggcttcatgggcggcctgcagagaaacggcagcaccggccagaccgccccctactacgccaccagcaccgtggaggtgatcttccacgtgagcaccagaatgcccagcgacagcgacgacagcctgaccaagaagctgagacacctgggcaacgacgaggtgcacatcgtgtggagcgagcacagcagagactacagaagaggcatcatccccaccgccttcggcgacgtgagcatcatcatctaccccatgaagaaccacatgttcttcatcgccatcaccaagaagcccgaggtgcccttcttcggccccctgttcgacggcgccatcgtgagcggcaagctgctgcccagcctggtgtgcgccacctgcatcaacgccagcagagccgtgaagtgcctgatccccctgtaccagagcttctacgaggagagagccctgtacctggaggccatcatccagaaccacagagaggtgatgaccttcgaggacttcgccgcccaggtgttcagccccagccccagctacagcctgagcggcaccggcgccctggccagcagcctgagcgccgacctggaggagcccctgagcgaggaggagaccgagcaccccctgctgcccctgcccagagccaccaagcccagaatcagcagaaagttcagatgctgcaccagcgccctgagcagaagcagccactag

SEQ ID NO: 12134 - DNA, 1836 bp, Artificial Sequence
  Description of Artificial Sequence: Synthetic coding sequence
atgccccacctggacatgaagacccacgtgtgccccagcgtggagggccccaagaagaagggcggcatcacctgcttctgctgcggcggccccttcagagccgccgacagaagcaagaccagaagccccaagctgagccacagcccccagccccccagcctgggcgaccccgtggagcacctgagcgagaccagcgccgacagcctggaggccatgagcgagggcgacgcccccacccccttcagcagaggcagcagaaccagagccagcctgcccgtggtgagaagcaccaaccagaccaaggagagaagcctgggcgtgctgtacctgcagtacggcgacgagaccaagcagctgagaatgcccaacgagatcaccagcgccgacaccatcagagccctgttcgtgagcgccttcccccagcagctgaccatgaagatgctggagagccccagcgtggccatctacatcaaggacgagagcagaaacgtgtactacgagctgaacgacgtgagaaacatccaggacagaagcctgctgaaggtgtacaacaaggaccccgcccacgccttcaaccacacccccaagaccatgaacggcgacatgagaatgcagagagagctggtgtacgccagaggcgacggccccggcgcccccagacccggcagcaccgcccaccccccccacgccatccccaacagcccccccagcacccccgtgccccacagcatgccccccagccccagcagaatcccctacggcggcaccagaagcatggtggtgcccggcaacgccaccatccccagagacagaatcagcagcctgcccgtgagcagacccatcagccccagccccagcgccatcctggagagaagagacgtgaagcccgacgaggacatgagcggcaagaacatcgccatgtacagaaacgagggcttctacgccgacccctacctgtaccacgagggcagaatgagcatcgccagcagccacggcggccaccccctggacgtgcccgaccacatcatcgcctaccacagaaccgccatcagaagcgccagcgcctactgcaaccccagcatgcaggccgagatgcacatggagcagagcctgtacagacagaagagcagaaagtaccccgacagccacctgcccaccctgggcagcaagaccccccccgccagcccccacagagtgagcgacctgagaatgatcgacatgcacgcccactacaacgcccacggccccccccacaccatgcagcccgacagagccagccccagcagacaggccttcaagaaggagcccggcaccctggtgtacatcgagaagcccagaagcgccgccggcctgagcagcctggtggacctgggcccccccctgatggagaagcaggtgttcgcctacagcaccgccaccatccccaaggacagagagaccagcgagaagatgatgaagaccaccgccaacagaaaccacaccgacagcgccggcaccccccacgtgagcggcggcaagatgctgagcgccctggagagcaccgtgccccccagccagcccccccccgtgggcaccagcgccatccacatgagcctgctggagatgagaagaagcgtggccgagctgagactgcagctgcagcagatgagacagctgcagctgcagaaccaggagctgctgagagccatgatgaagaaggccgagctggagatcagcggcaaggtgatggagaccatgaagagactggaggaccccgtgcagagacagagagtgctggtggagcaggagagacagaagtacctgcacgaggaggagaagatcgtgaagaagctgtag

SEQ ID NO: 12135 - DNA, 189 bp, Artificial Sequence
  Description of Artificial Sequence: Synthetic coding sequence
tgagagaaccccctggtgtactgcgacggccacggctgcagcgtggccgtgcaccaggcctgctacggcatcgtgcaggtgcccaccggcccctggttctgcagaaagtgcgagagccaggagagagccgccagagtggtgggccccatgtggttcgtgccctgcatcttccagagatacaacctgtag

SEQ ID NO: 12136 - DNA, 1869 bp, Artificial Sequence; identical to SEQ ID NO: 9991
  Description of Artificial Sequence: Synthetic coding sequence

SEQ ID NO: 12137 - DNA, 546 bp, Artificial Sequence
  Description of Artificial Sequence: Synthetic coding sequence
atgggcggcagaagcgcccaggccggcctgggcaccagaatcacccccatgatggagctgaagcccaacgccggcagcgacagagcctgggtgtggaacacccacgccgacttcgccgacgagtgccccaagcccgagctgctggccatcagattcctgaacgccgagaacgcccagaagttcaagaccaagttcgaggagtgcagaaaggagatcgaggagagagagaagaagggcgacgtggtgccctgggtgggcggcctgctgtgcagactgaccctgcacctgaccatcctgcccggcggctgcttcttctgcctgcccgacaagcacagcagagtgctgtggcccccccacgtgagcagagtgatgcagctgcccggcgacaccggcgccagctggggcgccctgagcacctgccagtgctgctggccccagagcaactgggccggcatcggcgtgagagccctgcccggcgcccaccagaaggtgctgtacgacggccccagattcgtgagccagagagcctggagccccctgccctag

SEQ ID NO: 12138 - DNA, 378 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggagttcgccgtgcccgactacagaagcagccacctggaggtgagccaggccagccagctgctgcagcagcagcagcagcagcagctgagaagaagacccagcctgctgagcgagttccaccccggcagcgacagaccccaggagagaagaaccagctacgagcccttccaccccggccccagccccgtggaccacgacagcctggagagcaagagacccagactggagcaggtgagcgacagccacttccagagagtgagcgccgcctag

SEQ ID NO: 12139 - DNA, 318 bp, Artificial Sequence
  Description of Artificial Sequence: Synthetic coding sequence
atgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatctag

SEQ ID NO: 12140 - DNA, 1305 bp, Artificial Sequence
  Description of Artificial Sequence: Synthetic coding sequence
atggacatcgacaaggacctggaggcccccctgtacctgacccccgagggctggagcctgttcctgcagagatactaccaggtggtgcacgagggcgccgagctgagacacctggacacccaggtgcagagatgcgaggacatcctgcagcagctgcaggccgtggtgccccagatcgacatggagggcgacagaaacatctggatcgtgaagcccggcgccaagagcagaggcagaggcatcatgtgcatggaccacctggaggagatgctgaagctggtgaacggcaaccccgtggtgatgaaggacggcaagtgggtggtgcagaagtacatcgagagacccctgctgatcttcggcaccaagttcgacctgagacagtggttcctggtgaccgactggaaccccctgaccgtgtggttctacagagacagctacatcagattcagcacccagcccttcagcctgaagaacctggacaacagcgtgcacctgtgcaacaacagcatccagaagcacctggagaacagctgccacagacaccccctgctgccccccgacaacatgtggagcagccagagattccaggcccacctgcaggagatgggcgcccccaacgcctggagcaccatcatcgtgcccggcatgaaggacgccgtgatccacgccctgcagaccagccaggacaccgtgcagtgcagaaaggccagcttcgagctgtacggcgccgacttcgtgttcggcgaggacttccagccctggctgatcgagatcaacgccagccccaccatggcccccagcaccgccgtgaccgccagactgtgcgccggcgtgcaggccgacaccctgagagtggtgatcgacagaatgctggacagaaactgcgacaccggcgccttcgagctgatctacaagcagcccgccgtggaggtgccccagtacgtgggcatcagactgctggtggagggcttcaccatcaagaagcccatggccatgtgccacagaagaatgggcgtgagacccgccgtgcccctgctgacccagagaggcagcggcgaggccagacaccacttccccagcctgcacaccaaggcccagctgcccagcccccacgtgctgagacaccagggccaggtgctgagaagacagcacagcaagctggtgggcaccaaggccctgagcaccaccggcaaggccctgagaaccctgcccaccgccaaggtgttcatcagcctgccccccaacctggacttcaaggtggcccccagcatcctgaagcccagaaaggtgggcctggacctgtag

SEQ ID NO: 12141 - DNA, 576 bp, Artificial Sequence
  Description of Artificial Sequence: Synthetic coding sequence
atggccatcggcaagagactggccaccctgcccaccaaggagcagaagacccagagactgatcagcgagctgagcctgctgaaccacaagctgcccgccagagtgtggctgcccaccgccggcttcgaccaccacgtggtgagagtgccccacacccaggccgtggtgctgaacagcaaggacaaggccccctacctgatctacgtggaggtgctggagtgcgagaacttcgacaccaccagcgtgcccgccagaatccccgagaacagaatcagaagcaccagaagcgtggagaacctgcccgagtgcggcatcacccacgagcagagagccggcagcttcagcaccgtgcccaactacgacaacgacgacgaggcctggagcgtggacgacatcggcgagctgcaggtggagctgcccgaggtgcacaccaacagctgcgacaacatcagccagttcagcgtggacagcatcaccagccaggagagcaaggagcccgtgttcatcgccgccggcgacatcagaagaagactgagcgagcagctggcccacacccccaccgccttcaagagatag

SEQ ID NO: 12142 - DNA, 903 bp, Artificial Sequence
  Description of Artificial Sequence: Synthetic coding sequence
atggccaagtggggccagggcaacccccactggatcgtggaggagagagaggacggcaccaacgtgaacaactggagatggagaaccgagagagacgccaccagcctgagcaagggcaagttccaggagctgctggtgggcatcgtggtggagaacgacgccggcagaggcgagatcaacgagctgaagcaggtggagggcgaggccagctgcagcagcagaaagggcaagctgatcttcttctacgagtggaacatcaagctgggctggaagggcatcgtgaaggagagcggcgtgaagcacaagggcctgatcgagatccccaacctgagcgaggagaacgaggtggacgacaccgaggtgagcctgagcaagaagaagggcgacggcgtgatcctgaaggacctgatgaagaccgccggcaccgccaaggtgagagaggccctgggcgactacctgaaggccctgaagaccgagttcaccaccggcatgatcctgcccaccaaggccatggccacccaggagctgaccgtgaagagaaagctgagcggcaacaccctgcaggtgcaggccagcagccccgtggccctgggcgtgagaatccccaccgtggccctgcacatgatggagctgttcgacaccaccgtggagcagctgtacagcatcttcaccgtgaaggagctgaccaacaagaagatcatcatgaagtggagatgcggcaactggcccgaggagcactacgccatggtggccctgaacttcgtgcccaccctgggccagaccgagctgcagctgaaggagttcctgagcatctgcaaggaggagaacatgaagttctgctggcagaagcagcacttcgaggagatcaagggcagcctgcagctgacccccctgaacggctag

SEQ ID NO: 12143 - DNA, 1137 bp, Artificial Sequence
  Description of Artificial Sequence: Synthetic coding sequence
atgaaggacgtgcccggcttcctgcagcagagccagaacagcggccccggccagcccgccgtgtggcacagactggaggagctgtacaccaagaacttcatgaagaccctgagcgtgaacctgaacaccggcaagagcctgagcagcgtgttccacttcgagaacgagtgcatcgacgccagaagatgcagcaaggccggcggcttctacttcagagtgaaccccctgagcctggtggagatcatcctgcacgtggtgagacagatgaccgaccccaacgtggccctgaccttcctggagaagaccagagagaaggtgaagagcagcgacgaggccgtgatcctgtgcaagaccgccatcggcgccctgaagctgaacatcggcgacctgcaggtgaccaaggagaccatcgaggacgtggaggagatgctgaacaacctgcccggcgtgaccagcgtgcacagcagattctacgacctgagcagcaagtactaccagaccatcggcaaccacgccagctactacaaggacgccctgagattcctgggctgcgtggacatcaaggacctgcccgtgagcgagcagcaggagagagccttcaccctgggcctggccggcctgctgggcgagggcgtgttcaacttcggcgagctgctgatgcaccccgtgctggagagcctgagaaacaccgacagacagtggctgatcgacaccctgtacgccttcaacagcggcaacgtggagagattccagaccctgaagaccgcctggggccagcagcccgacctggccgccaacgaggcccagctgctgagaaagatccagctgctgtgcctgatggagatgaccttcaccagacccgccaaccacagacagctgaccttcgaggagatcgccaagagcgccaagatcaccgtgaacgaggtggagctgctggtgatgaaggccctgagcgtgggcctggtgaagggcagcatcgacgaggtggacaagagagtgcacatgacctgggtgcagcccagagtgctggacctgcagcagatcaagggcatgaaggacagactggagttctggtgcaccgacgtgaagagcatggagatgctggtggagcaccaggcccacgacatcctgacctag

SEQ ID NO: 12144 - DNA, 603 bp, Artificial Sequence
  Description of Artificial Sequence: Synthetic coding sequence
atgctgctggagcagaacctgatcaccgtggacatgcagaagcacagcctgaccttctggtggctggtggagtgctggccccaggtgttcaacaagctgatcagaagatacaagtacctggagaagggcttcgaggacgaggtgaagaagctgctgctgttcctgaagggcttcagcgagagcgagagaaacaagctggccatgctgaccggcgtgctgctggccaacggcaccctgaacgccagcatcctgaacagcctgtacaacgagaacctggtgaaggagggcgtgagcgccgccttcgccgtgaagctgttcaagagctggatcaacgagaaggacatcaacgccgtggccgccagcctgagaaaggtgagcatggacaacagactgatggagctgttccccgccaacaagcagagcgtggagcacttcaccaagtacttcaccgaggccggcctgaaggagctgagcgagtacgtgagaaaccagcagaccatcggcgccagaaaggagctgcagaaggagctgcaggagcagatgagcagaggcgaccccttcaaggacatcatcctgtacgtgaaggaggagatgaagaagtag

SEQ ID NO: 12145 - DNA, 1446 bp, Artificial Sequence; identical to SEQ ID NO: 12062
  Description of Artificial Sequence: Synthetic coding sequence

SEQ ID NO: 12146 - DNA, 261 bp, Artificial Sequence
  Description of Artificial Sequence: Synthetic coding sequence
atgggcaagatggtgagcgtgatcaacaccgtggacaccagccacgaggacatgatccacgacgcccagatggactactacggcaccagactggccacctgcagcagcgacagaagcgtgaagatcttcgacgtgagaaacggcggccagatcctgatcgccgacctgagaggccacgagggccccgtgtggcaggtggcctgggcccaccccatgtacggcaacatcctggccagctgcagctacgacagaaaggtgtag

SEQ ID NO: 12147 - DNA, 660 bp, Artificial Sequence
  Description of Artificial Sequence: Synthetic coding sequence
atggagcccagcgcccagcagctgcagctggccgccagcctgcccgccaacctgagcaacttctgccagggcagcgagatgcccaccaccagcagacccgccctggacgtgaagggcggcaccagccccgccaaggaggacgccaaccaggagatgagcagcgtggcctacagcaacctggccgtgaaggacagaaaggccgtggccatcctgcactaccccggcgtggccagcaacggcaccaaggccagcggcgcccccaccagcagcagcggcagccccatcggcagccccaccaccaccccccccaccaagccccccagcttcaacctgcaccccgccccccacctgctggccagcatgcacctgcagaagctgaacagccagtaccagggcatggccgccgccacccccggccagcccggcgaggccggccccctgcagaactgggacttcggcgcccaggccggcggcgccgagagcctgagccccagcgccggcgcccagagccccgccatcatcgacagcgaccccgtggacgaggaggtgctgatgagcctggtggtggagctgggcctggacagagccaacgagctgcccgagctgtggctgggccagaacgagttcgacttcaccgccgacttccccagcagctgctag

SEQ ID NO: 12148 - DNA, 396 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgcggcttcatcagcgacagaagcgtgaaggaggtggcctgcggcggcaaccacagcgtgttcctgctggaggacggcgaggtgtacacctgcggcctgaacaccaagggccagctgggccacgagagagagggcaacaagcccgagcagatcggcgccctggccgaccagcacatcatccacgtggcctgcggcgagagccacagcctggccctgagcgacagaggccagctgttcagctggggcgccggcagcgacggccagctgggcctgatgaccaccgaggacagcgtggccgtgcccagactgatctag

SEQ ID NO: 12149 - DNA, 3099 bp, Artificial Sequence
  Description of Artificial Sequence: Synthetic coding sequence
atggagggcgccctgaccgccagagacaaggtgggcgtgcaggacttcgtgctgctggacgcctacaccagcgagagcgccttcgtggacaacctgagaaagagattcagcgagaacctgatctacacctacatcggcaccctgctggtgagcgtgaacccctaccaggagctgggcatctacaccgtgagccagatggagctgtaccagggcgtgaacttcttcgagctgcccccccacgtgtacgccatcgccgacaacgcctacagaatgatgtgcgccgagctgaacaaccacttcatcctgatcagcggcgagagcggcgccggcaagaccgaggccagcaagaagatcctggagtacttcgccgtgacctgccccatgacccagagcctgcagatcgccagagacagactgctgttcagcaaccccgtgctggaggccttcggcaacgccagaaccctgagaaacgacaacagcagcagattcggcaagtacatggacatccagttcgacttccagggcatccccgtgggcggccacatcatcagctacctgatcgagaagagcagagtggtgtaccagaacgagggcgagagaaacttccacatcttctaccagctgctggccggcggcgaggaggagagactgagctacctgggcctggagagagacccccagctgtacaagtacctgagccagggccactgcgccaaggagagcagcatcagcgacaagaacgactggaagaccgtgagcaacgccttcagcgtgatcgacttcaccgaggccgacctggagaacctgttcggcatcatcgccagcgtgctgcacctgggcaacatcggcttcgaggaggacgaccagggctgcgccaccatccccgacacccacgagatcaagtggatcgccaagctgctgggcgtgcaccccagcgtgctgctggaggccctgacccacagaaagatcgaggccaagaccgaggaggtgatctgccccctgaccctggagctgagcgtgtacgccagagacgccatggccaaggccgtgtacggcagaaccttcacctggctggtgaacaagatcaacagcagcctggtgaacaaggtgggccagagaatcctggaccccctgctgctgctgacctggaagaccgtgatcggcctgctggacatctacggcttcgaggtgttcgacaagaacggcttcgagcagttctgcatcaactactgcaacgagaagctgcagcagctgctgatcgagagaaccctgaaggccgagcaggccgagtacgagatggagggcatcgagtgggagcccatcaagtacttcaacaacaagatcatctgcgacctggtggaggagagacacaagggcatcatcagcatcctggacgaggagtgcatcagacccggccccgccaccgacctgagcttcctggagaagctggaggagaaggtgggcaagcacgcccacttcgagaccagaaagctggccggccccaagggcagaaagagaatcggctggatggagttcagactgctgcactacgccggcgaggtgacctactgcaccaagggcttcctggagaagaacaacgacctgctgtacagacacctgaaggaggtgctgtgcaagagcaagaacatcatcctgagagagtgcttcctgctggccgagctggagaacagaagaagaccccccaccgtgggcacccagttcaagaacagcctgagcagcctgctggagaccctgatcagcaaggagcccagctacatcagatgcatcaagcccaacgacagaaaggagcccagcaagttcgacgacttcctgatcagacaccagatcaagtacctgggcctgatggagcacctgagagtgagaagagccggcttcgcctacagaagaaagtacgagcacttcctgcagagatacaagagcctgtgccccgacacctggccccactggcacggcccccccgccgagggcgtggagagactgatcaagtacatcggctacaagcccgaggagtacaagctgggcaagaccaagatcttcatcagattccccagaaccctgttcgccaccgaggacgccttcgagttcagcaagcaccagctggtggccagaatccaggccacctacaagagatgcctgggcagaagagagtacgtgaagaagagacaggccgccatcaagctggaggcccactggagaggcgccctggccagaaaggccatccagagaagaaagtgggccgtgagaatcatcagaaagttcatcaagggcttcatcagcagaaacaagcccctgtgccccgacaacgaggagttcatcgtgttcgtgagaaagaactacatcctgaacctgagataccacctgcccaagaccgtgctggacaagagctggctgagaccccccggcatcctggagaacgccagcgacctgctgagaaagatgtgcgtgagaaacctggtgcagaagtactgcagaggcatcaccgccgagagaaaggccatgatgcagcagaaggtggtgaccagcgagatcttcagaggcagaaaggacggctacaccgagagcctgaaccagcccttcgtgaacagcagaatcgacgagggcgacatcaaccccaaggtgctgcagctgatcagccacgagaagatccagtacggcgtgcccgtgatcaagtacgacagaaagggcttcaaggccagacagagacagctgatcctgacccagaaggccgcctacgtggtggagctggccaagatcaagcagaagatcgagtacagcgccctgaagggcgtgagcaccagcaacctgagcgacggcatcctggtgatccacgtgagccccgaggacagcaagcagaagggcgacgccgtgctgcagtgcggccacgtgttcgaggccgtgaccaagctggtgatgctggtgaagaaggagaacatcgtgaacgtggtgcagggcagcctgcagttcttcatcagccccggcaaggagggcaccatcgtgttcgacaccggcctggaggagcaggtgtacaagaacaagaacggccagctgaccgtggtgagcgtgagaagaaagagctag

SEQ ID NO: 12150 - DNA, 1176 bp, Artificial Sequence
  Description of Artificial Sequence: Synthetic coding sequence
atgtgcagccagctgtggttcctgaccgacagaagaatcagagaggactacccccaggtgcagatcctgagagccctgagacagagatgcagcgagcaggacgtgagattcagagccgtgctgatggaccagatcgccgtgaccatcgtgggcggccacctgggcctgcagctgaaccagaaggccctgaccaccttccccgacgtggtgctggtgagagtgcccacccccagcgtgcagagcgacagcgacatcaccgtgctgagacacctggagaagctgggctgcagactggtgaacagaccccagagcatcctgaactgcatcaacaagttctggaccttccaggagctggccggccacggcgtgcccatgcccgacaccttcagctacggcggccacgaggacttcagcaagatgatcgacgaggccgagcccctgggctaccccgtggtggtgaagagcaccagaggccacagaggcaaggccgtgttcctggccagagacaagcaccacctgagcgacatctgccacctgatcagacacgacgtgccctacctgttccagaagtacgtgaaggagagccacggcaaggacatcagagtggtggtggtgggcggccaggtgatcggcagcatgctgagatgcagcaccgacggcagaatgcagagcaactgcagcctgggcggcgtgggcgtgaagtgccccctgaccgagcagggcaagcagctggccatccaggtgagcaacatcctgggcatggacttctgcggcatcgacctgctgatcatggacgacggcagcttcgtggtgtgcgaggccaacgccaacgtgggcttcctggccttcgaccaggcctgcaacctggacgtgggcggcatcatcgccgactacaccatgagcctgctgcccaacagacagaccggcaagatggccgtgctgcccggcctgagcagccccagagagaagaacgagcccgacggctgcgccagcgcccagggcgtggccgagagcgtgtacaccatcaacagcggcagcaccagcagcgagagcgagcccgagctgggcgagatcagagacagcagcgccagcaccatgggcgccccccccagcatgctgcccgagcccggctacaacatcaacaacagaatcgccagcgagctgaagctgaagtag

SEQ ID NO: 12151 - DNA, 1065 bp, Artificial Sequence
  Description of Artificial Sequence: Synthetic coding sequence
atggacatggaccacatcatgacctgggccaccgacgtggccaagggcatgcactacctgcacatggaggcccccgtgaaggtgatccacagagacctgaagagcagaaacgtggtgatcgccgccgacggcgtgctgaagatctgcgacttcggcgccagcagattccacaaccacaccacccacatgagcctggtgggcaccttcccctggatggcccccgaggtgatccagagcctgcccgtgagcgagacctgcgacacctacagctacggcgtggtgctgtgggagatgctgaccagagaggtgcccttcaagggcctggagggcctgcaggtggcctggctggtggtggagaagaacgagagactgaccatccccagcagctgccccagaagcttcgccgagctgctgcaccagtgctgggaggccgacgccaagaagagacccagcttcaagcagatcatcagcatcctggagagcatgagcaacgacaccagcctgcccgacaagtgcaacagcttcctgcacaacaaggccgagtggagatgcgagatcgaggccaccctggagagactgaagaagctggagagagacctgagcttcaaggagcaggagctgaaggagagagagagaagactgaagatgtgggagcagaagctgaccgagcagagcaacacccccctgctgctgcccctggccgccagaatgagcgaggagagctacttcgagagcaagaccgaggagagcaacagcgccgagatgagctgccagatcaccgccaccagcaacggcgagggccacggcatgaaccccagcctgcaggccatgatgctgatgggcttcggcgacatcttcagcatgaacaaggccggcgccgtgatgcacagcggcatgcagatcaacatgcaggccaagcagaacagcagcaagaccaccagcaagagaagaggcaagaaggtgaacatggccctgggcttcagcgacttcgacctgagcgagggcgacgacgacgacgacgacgacggcgaggaggaggacaacgacatggacaacagcgagtag

SEQ ID NO: 12152 - DNA, 1707 bp, Artificial Sequence
  Description of Artificial Sequence: Synthetic coding sequence
atgctggagagaccccccgccctggccatgcccatgcccaccgagggcacccccccccccctgagcggcacccccatccccgtgcccgcctacttcagacacgccgagcccggcttcagcctgaagagacccagaggcctgagcagaagcctgcccccccccccccccgccaagggcagcatccccatcagcagactgttcccccccagaacccccggctggcaccagctgcagcccagaagagtgagcttcagaggcgaggccagcgagaccctgcagagccccggctacgaccccagcagacccgagagcttcttccagcagagcttccagagactgagcagactgggccacggcagctacggcgaggtgttcaaggtgagaagcaaggaggacggcagactgtacgccgtgaagagaagcatgagccccttcagaggccccaaggacagagccagaaagctggccgaggtgggcagccacgagaaggtgggccagcacccctgctgcgtgagactggagcaggcctgggaggagggcggcatcctgtacctgcagaccgagctgtgcggccccagcctgcagcagcactgcgaggcctggggcgccagcctgcccgaggcccaggtgtggggctacctgagagacaccctgctggccctggcccacctgcacagccagggcctggtgcacctggacgtgaagcccgccaacatcttcctgggccccagaggcagatgcaagctgggcgacttcggcctgctggtggagctgggcaccgccggcgccggcgaggtgcaggagggcgaccccagatacatggcccccgagctgctgcagggcagctacggcaccgccgccgacgtgttcagcctgggcctgaccatcctggaggtggcctgcaacatggagctgccccacggcggcgagggctggcagcagctgagacagggctacctgccccccgagttcaccgccggcctgagcagcgagctgagaagcgtgctggtgatgatgctggagcccgaccccaagctgagagccaccgccgaggccctgctggccctgcccgtgctgagacagcccagagcctggggcgtgctgtggtgcatggccgccgaggccctgagcagaggctgggccctgtggcaggccctgctggccctgctgtgctggctgtggcacggcctggcccaccccgccagctggctgcagcccctgggcccccccgccaccccccccggcagccccccctgcagcctgctgctggacagcagcctgagcagcaactgggacgacgacagcctgggccccagcctgagccccgaggccgtgctggccagaaccgtgggcagcaccagcacccccagaagcagatgcacccccagagtgctgacccccctgagactgagccccgccgccgagcccagcgcccccggcctgggccccgccgccgaggccccctgctgcgtggagcagagaggcttcctgagcagacacatccccagaagcttcagcgccttccaggccgccccccccaagagcgcctgcaacgccctgcacctgcacggccacacccagcccagcgccttcgtgtggagcctgacctgcagcagccaccacggcagaaccttcgaggccagaaccaaggtggaccccctgttcaagatctgcggcggcttcctgaccgtgttcgccgacctgtag

SEQ ID NO: 12153 - DNA, 642 bp, Artificial Sequence
  Description of Artificial Sequence: Synthetic coding sequence
atggccgagaccgaggagagaagcctggacaacttcttcgccaagagagacaagaagaagaagaaggagagaagcaacagagccgccagcgccgccggcgccgccggcagcgccggcggcagcagcggcgccgccggcgccgccggcggcggcgccggcgccggcaccagacccggcgacggcggcaccgccagcgccggcgccgccggccccggcgccgccaccaaggccgtgaccaaggacgaggacgagtggaaggagctggagcagaaggaggtggactacagcggcctgagagtgcaggccatgcagatcagcagcgagaaggaggaggacgacaacgagaagagacaggaccccggcgacaactgggaggagggcggcggcggcggcggcggcatggagaagagcagcggcccctggaacaagaccgcccccgtgcaggccccccccgcccccgtgatcgtgaccgagacccccgagcccgccatgaccagcggcgtgtacagaccccccggcgccagactgaccaccaccagaaagaccccccagggcccccccgagatctacagcgacacccagttccccagcctgcagagcaccgccaagcacgtggagagcagaaacagatacctgaagtag

SEQ ID NO: 12154 - DNA, 4140 bp, Artificial Sequence
  Description of Artificial Sequence: Synthetic coding sequence
atggccagcagccccaccaagggcctgaccatgagcgtgcccgtggcccccaagaagagctgctacacccagctgagagacaacagaaacgccgccagaaacaacaacgagagcatcctgagcctgggcgacaccaacgccaaccagatcatgctggaggtgagcagcagccacgacgagagcaagacctgcgacctgggcgacgagatcggcaacaccaacagcagcgagcccgagaacagaacccacttccacaaggagttccaccagctgcagggcttcggcaagggcagccaggccggcagcgccagcctgaaggacttcagactgagcagcaccatccagagagagctgaacgaggagcacaccgtggagagaggcaccgacagcctgcagaccaccagaagcatccagggccccagcctgagcagctggagaaacgtgatgagcgaggccagcctggacgtgctggccaagagagacgccgagatccccagacacgtgcccaaggacaagctggccaagaccctggacaacgaggagctgagaagacacagcctggagagagccagcagcagcgtggccgccgtgggcagcctgaccccccagcacccccagcccctgagcctggacagcagagaggccagaggccagatccccggcggcggcgagggcccccagaagaccctgcccgaccacgccgtgcccgccgccttccccgccaccgacagcaccagcgagggcaagagcgtgagacaccccaagcccagcaccagcgagagcaagcagagcacccccagcgagacccagaccgtgggcgcccacgtgctgcaggtgtgcagcgagcacaccagccacagcgcccaccccgagcccgccctgaacctgaccctggccagcaaggagatccccagcaagctggaggcccagctgggccagggcaagggcgaggccaagctggacctgaagtacgtgccccccagaagagtggagcaggagggcaaggccgcccaggagggctacctgggctgccacaaggaggagaacctgagcgccctggagggcagagacccctgcggcgaggcccaccccgaggccaccgacgccctgggccacctgctgaacagcgacctgcaccacctgggcgtgggcagaggcaactgcgaggagaagagaggcgtgaaccccggcgagcaggacagcctgcacaccacccccaagcagggcagcgccagcctgggcggcgccgacaaccagcccaccggcaagatcagcccctgcgccggcgagaagctgggcgagagaaccagcagcagcttcagccccggcgacagccacgtggccttcatccccaacaacctgaccgacagcaagcccctggacgtgatcgaggaggagagaagactgggcagcggcaacaaggacagcgtgatggtgctggtgttcaaccccagcgtgggcgagaacaagaccgaggtgcccgagcccctggacccccagagcggcagaagcgaggccagagagagcaaggaggtgaccaccagcgtggccgagaacagaaacctgctggagaacgccgacaagatcgagagcaccagcgccagagccgacagcgtgctgaacatccccgcccccctgcaccccgagaccaccgtgaacatgacctaccagcccaccacccccagcagcagcttccaggacgtgagcgtgttcggcatggacgccggcagccccctggtggtgcccccccccaccgacagcgccagactgctgaacaccagccccaaggtgcccgacaagaacacctgccccagcggcatccccaagcccgtgttcacccacagcaaggacacccccagcagccaggagggcatggagaactaccaggtggagaagaccgaggagagaaccgagaccaagcccatcatcatgcccaagcccaagcacgtgagacccaagatcatcacctacatcagaagaaacccccaggccctgggccaggtggacgccagcctggtgcccgtgggcctgccctacgccccccccacctgcaccatgcccctgccccacgaggagaaggccgccggcggcgacctgaagcccagcgccaacctgtacgagaagttcaagcccgacctgcagaagcccagagtgttcagcagcggcctgatggtgagcggcatcaagccccccggccaccccttcagccagatgagcgagaagttcctgcaggaggtgaccgaccaccccggcaaggaggagttctgcagccccccctacgcccactacgaggtgccccccaccttctacagaagcgccatgctgctgaagccccagctgggcctgggcgccatgagcagactgcccagcgccaagagcagaatcctgatcgccagccagagaagcagcgccagcgccatccacccccccggccccatcaccaccgccaccagcctgtacagcagcgaccccagcgccgacctgaagaaggccagcagcagcaacgccgccaagagcaacctgcccaagagcggcctgagaccccccggctacagcagactgcccgccgccaagctggccgccttcggcttcgtgagaagcagcagcgtgagcagcgtgagcagcacccagagcggcgacagcgcccagcccgagcagggcagacccgccaccagaagcaccttcggcaacgaggagcagcccgtgctgaaggccagcctgcccagcaaggacacccccaagggcgccggcagagtggccccccccgccagcagcagcgtgaccgcccccagaagaagcctgctgcccgcccccaagagcaccagcacccccgccggcaccaagaaggacgcccagaaggaccaggacaccaacaagcccgccgtgagcagccccaagagagtggccgccagcaccaccaagctgcacagccccggctaccccaagcagagaaccgccgccgccagaaacggcttcccccccaagcccgacccccaggccagagaggccgagagacagctggtgctgagactgaaggagagatgcgagcagcagaccagacagctgggcgtggcccagggcgagctgaagagagccatctgcggcttcgacgccctggccgtggccacccagcacttcttcagaaagaacgagagcgccctggtgaaggagaaggagctgagcatcgagctggccaacatcagagacgaggtggccttccacaccgccaagtgcgagaagctgcagaaggagaaggaggagctggagagaagattcgaggacgaggtgaagagactgggctggcagcagcaggccgagctgcaggagctggaggagagactgcagctgcagttcgaggccgagatggccagactgcaggaggagcacggcgaccagctgctgagcatcagatgccagcaccaggagcaggtggaggacctgaccgccagccacgacgccgccctgctggagatggagaacaaccacaccgtggccatcaccatcctgcaggacgaccacgaccacaaggtgcaggagctgatgagcacccacgagctggagaagaaggagctggaggagaacttcgagaagctgagactgagcctgcaggaccaggtggacaccctgaccttccagagccagagcctgagagacagagccagaagattcgaggaggccctgagaaagaacaccgaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaacgaggacctgaaggccagaatcgaccagaacaccgtggtgaccagacagctgagcgaggagaacgccaacctgcaggagtacgtggagaaggagacccaggagaagaagagactgagcagaaccaacgaggagctgctgtggaagctgcagaccggcgaccccaccagccccatcaagctgagccccaccagccccgtgtacagaggcagcagcagcggccccagcagccccgccagagtgagcaccacccccagatag

SEQ ID NO: 12155 - DNA, 1041 bp, Artificial Sequence
  Description of Artificial Sequence: Synthetic coding sequence
atgcagcacctgaagagcaagaagagagaggagagatggatgagagccagcaagagacagagcgagaaggagatggaggagctgcaccacaacatcgacgacctgctgcaggagaagaagagcctggagtgcgaggtggaggagctgcacagaaccgtgcagaagagacagcagcagaaggacttcatcgacggcaacgtggagagcctgatgaccgagctggagatcgagaagagcctgaagcaccacgaggacatcgtggacgagatcgagtgcatcgagaagaccctgctgaagagaagaagcgagctgagagaggccgacagactgctggccgaggccgagagcgagctgagctgcaccaaggagaagaccaagaacgccgtggagaagttcaccgacgccaagagaagcctgctgcagaccgagagcgacgccgaggagctggagagaagagcccaggagaccgccgtgaacctggtgaaggccgaccagcagctgagaagcctgcaggccgacgccaaggacctggagcagcacaagatcaagcaggaggagatcctgaaggagatcaacaagatcgtggccgccaaggacagcgacttccagtgcctgagcaagaagaaggagaagctgaccgaggagctgcagaagctgcagaaggacatcgagatggccgagagaaacgaggaccaccacctgcaggtgctgaaggagagcgaggtgctgctgcaggccaagagagccgagctggagaagctgaagagccaggtgaccagccagcagcaggagatggccgtgctggacagacagctgggccacaagaaggaggagctgcacctgctgcagggcagcatggtgcaggccaaggccgacctgcaggaggccctgagactgggcgagaccgaggtgaccgagaagtgcaaccacatcagagaggtgaagagcctgctggaggagctgagcttccagaagggcgagctgaacgtgcagatcagcgagagaaagacccagctgaccctgatcaagcaggagatctag

SEQ ID NO: 12156 - DNA, 369 bp, Artificial Sequence; identical to SEQ ID NO: 12080
  Description of Artificial Sequence: Synthetic coding sequence

SEQ ID NO: 12157 - DNA, 291 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggccgaggtgagcatcaacgaggacggcaccctgttcgacggcagacccatcgagagcctgagcctgatcgacgccgtgatgcccgacgtggtgcagaccagacagtag

SEQ ID NO: 12158 - DNA, 2913 bp, Artificial Sequence
  Description of Artificial Sequence: Synthetic coding sequence
atgctgcagcaggtgaacggccacaaccccggcagcgacggccaggccagagagtacctgagagaggacctgcaggagttcctgggcggcgaggtgctgctgtacaagctggacgacctgaccagagtgaaccccgtgaccctggagaccgtgctgagatgcctgcaggccagatacatggccgacaccttctacaccaacgccggctgcaccctggtggccctgaaccccttcaagcccgtgccccagctgtacagccccgagctgatgagagagtaccacgccgccccccagccccagaagctgaagccccacgtgttcaccgtgggcgagcagacctacagaaacgtgaagagcctgatcgagcccgtgaaccagagcatcgtggtgagcggcgagagcggcgccggcaagacctggaccagcagatgcctgatgaagttctacgccgtggtggccaccagccccgccagctgggagagccacaagatcgccgagagaatcgagcagagaatcctgaacagcaaccccgtgatggaggccttcggcaacgcctgcaccctgagaaacaacaacagcagcagattcggcaagttcatccagctgcagctgaacagagcccagcagatgaccggcgccgccgtgcagacctacctgctggagaagaccagagtggcctgccaggccagcagcgagagaaacttccacatcttctaccagatctgcaagggcgccagcgaggacgagagactgcagtggcacctgcccgagggcgccgccttcagctggctgcccaaccccgagagaagcctggaggaggactgcttcgaggtgaccagagaggccatgctgcacctgggcatcgacacccccacccagaacaacatcttcaaggtgctggccggcctgctgcacctgggcaacatccagttcgccgccagcgaggacgaggcccagccctgccagcccatggacgacgccaagtacagcgtgagaaccgccgccagcctgctgggcctgcccgaggacgtgctgctggagatggtgcagatcagaaccatcagagccggcagacagcagcaggtgttcagaaagccctgcgccagagccgagtgcgacaccagaagagactgcctggccaagctgatctacgccagactgttcgactggctggtgagcgtgatcaacagcagcatctgcgccgacaccgacagctggaccaccttcatcggcctgctggacgtgtacggcttcgagagcttccccgacaacagcctggagcagctgtgcatcaactacgccaacgagaagctgcagcagcacttcgtggcccactacctgagagcccagcaggaggagtacgccgtggagggcctggagtggagcttcatcaactaccaggacaaccagccctgcctggacctgatcgagggcagccccatcagcatctgcagcctgatcaacgaggagtgcagactgaacagacccagcagcgccgcccagctgcagaccagaatcgagaccgccctggccggcagcccctgcctgggccacaacaagctgagcagagagcccagcttcatcgtggtgcactacgccggccccgtgagataccacaccgccggcctggtggagaagaacaaggaccccatcccccccgagctgaccagactgctgcagcagagccaggaccccctgctgatgggcctgttccccaccaaccccaaggagaagacccaggaggagccccccggccagagcagagcccccgtgctgaccgtggtgagcaagttcaaggccagcctggagcagctgctgcaggtgctgcacagcaccaccccccactacatcagatgcatcaagcccaacagccagggccaggcccagaccttcctgcaggaggaggtgctgagccagctggaggcctgcggcctggtggagaccatccacatcagcgccgccggcttccccatcagagtgagccacagaaacttcgtggagagatacaagctgctgagaagactgcacccctgcaccagcagcggccccgacagcccctaccccgccaagggcctgcccgagtggtgcccccacagcgaggaggccaccctggagcccctgatccaggacatcctgcacaccctgcccgtgctgacccaggccgccgccatcaccggcgacagcgccgaggccatgcccgcccccatgcactgcggcagaaccaaggtgttcatgaccgacagcatgctggagctgctggagtgcggcagagccagagtgctggagcagtgcgccagatgcatccagggcggctggagaagacacagacacagagagcaggagagacagtggagagccgtgatgctgatccaggccgccatcagaagctggctgaccagaaagcacatccagagactgcacgccgccgccaccgtgatcaagagagcctggcagaagtggagaatcagaatggcctgcctggccgccaaggagctggacggcgtggaggagaagcacttcagccaggccccctgcagcctgagcaccagccccctgcagaccagactgctggaggccatcatcagactgtggcccctgggcctggtgctggccaacaccgccatgggcgtgggcagcttccagagaaagctggtggtgtgggcctgcctgcagctgcccagaggcagccccagcagctacaccgtgcagaccgcccaggaccaggccggcgtgaccagcatcagagccctgccccagggcagcatcaagttccactgcagaaagagccccctgagatacgccgacatctgccccgagcccagcccctacagcatcaccggcttcaaccagatcctgctggagagacacagactgatccacgtgaccagcagcgccttcaccggcctgggctag

SEQ ID NO: 12159 - DNA, 3303 bp, Artificial Sequence; identical to SEQ ID NO: 9603
  Description of Artificial Sequence: Synthetic coding sequence

SEQ ID NO: 12160 - DNA, 390 bp, Artificial Sequence; identical to SEQ ID NO: 10956
  Description of Artificial Sequence: Synthetic coding sequence

SEQ ID NO: 12161 - DNA, 498 bp, Artificial Sequence
  Description of Artificial Sequence: Synthetic coding sequence
atgagcctgcacggcaagagaaaggagatctacaagtacgaggccccctggaccgtgtacgccatgaactggagcgtgagacccgacaagagattcagactggccctgggcagcttcgtggaggagtacaacaacaaggtgcagctggtgggcctggacgaggagagcagcgagttcatctgcagaaacaccttcgaccacccctaccccaccaccaagctgatgtggatccccgacaccaagggcgtgtaccccgacctgctggccaccagcggcgactacctgagagtgtggagagtgggcgagaccgagaccagactggagtgcctgctgaacaacaacaagaacagcgacttctgcgcccccctgaccagcttcgactggaacgaggtggacccctacctgctgggcaccagcagcatcgacaccacctgctgcttccagtggcccgtgtgcctgagcctgctgtgcacccactgctaccagaagctgctgtag

SEQ ID NO: 12162 - DNA, 1044 bp, Artificial Sequence
  Description of Artificial Sequence: Synthetic coding sequence
atgagcctggcccagagccccggcatctggggcgaggaccccgtgaagctgaccctggccctgaagatgaccagacaggacctgaccagaacccagatggagctgaacaacatgaaggccaacttcggcgacgtggtgcccagaagagacttcgagatgcaggagaagaccaacaaggacctgcaggagcagctggacaccctgagagccagctacgaggaggtgagaaaggagcacgagatcctgatgcagctgcacatgagcaccctgaaggagagagaccagttcttcagcgagctgcaggagatccagagaaccagcacccccagacccgactggaccaagtgcaaggacgtggtggccggcggccccgagagatggcagatgctggccgagggcaagaacagcgaccagctggtggacgtgctgctggaggagatcggcagcggcctgctgagagagaaggacttcttccccggcctgggctacggcgaggccatccccgccttcctgagattcgacggcctggtggagaacaagaagcccagcaagaaggacgtggtgaacctgctgaaggacgcctggaaggagagactggccgaggagcagaaggagaccttccccgacttcttcttcaacttcctggagcacagattcggccccagcgacgccatggcctgggcctacaccatcttcgagaacatcaagatcttccacagcaacgaggtgatgagccagttctacgccgtgctgatgggcaagagaagcgagaacgtgtacgtgacccagaaggagaccgtggcccagctgctgaaggagatgaccaacgccgacagccagaacgagggcctgctgaccatggagcagttcaacaccgtgctgaagagcaccttccccctgaagaccgaggagcagatccaggagctgatggaggccggcggctggcaccccagcagcagcaacgccgacctgctgaactacagaagcctgttcatggaggacgaggagggccagagcgagcccttcgtgcagaagctgtggtag

SEQ ID NO: 12163 - DNA, 219 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacctag

SEQ ID NO: 12164 - DNA, 1149 bp, Artificial Sequence; identical to SEQ ID NO: 10012
  Description of Artificial Sequence: Synthetic coding sequence

SEQ ID NO: 12165 - DNA, 1620 bp, Artificial Sequence; identical to SEQ ID NO: 10018
  Description of Artificial Sequence: Synthetic coding sequence

SEQ ID NO: 12166 - DNA, 390 bp, Artificial Sequence; identical to SEQ ID NO: 10956
  Description of Artificial Sequence: Synthetic coding sequence

SEQ ID NO: 12167 - DNA, 1089 bp, Artificial Sequence; identical to SEQ ID NO: 9912
  Description of Artificial Sequence: Synthetic coding sequence

SEQ ID NO: 12168 - DNA, 1266 bp, Artificial Sequence
  Description of Artificial Sequence: Synthetic coding sequence
atgagcgccctgagaagaagcggctacggccccagcgacggccccagctacggcagatactacggccccggcggcggcgacgtgcccgtgcacccccccccccccctgtaccccctgagacccgagcccccccagccccccatcagctggagagtgagaggcggcggccccgccgagaccacctggctgggcgagggcggcggcggcgacggctactaccccagcggcggcgcctggcccgagcccggcagagccggcggcagccaccagagcctgaacagctacaccaacggcgcctacggccccacctacccccccggccccggcgccaacaccgccagctacagcggcgcctactacgcccccggctacacccagaccagctacagcaccgaggtgcccagcacctacagaagcagcggcaacagccccacccccgtgagcagatggatctacccccagcaggactgccagaccgaggccccccccctgagaggccaggtgcccggctacccccccagccagaaccccggcatgaccctgccccactacccctacggcgacggcaacagaagcgtgccccagagcggccccaccgtgagaccccaggaggacgcctgggccagccccggcgcctacggcatgggcggcagatacccctggcccagcagcgcccccagcgccccccccggcaacctgtacatgaccgagagcaccagcccctggcccagcagcggcagcccccagagcccccccagcccccccgtgcagcagcccaaggacagcagctacccctacagccagagcgaccagagcatgaacagacacaacttcccctgcagcgtgcaccagtacgagagcagcggcaccgtgaacaacgacgacagcgacctgctggacagccaggtgcagtacagcgccgagccccagctgtacggcaacgccaccagcgaccaccccaacaaccaggaccagagcagcagcctgcccgaggagtgcgtgcccagcgacgagagcaccccccccagcatcaagaagatcatccacgtgctggagaaggtgcagtacctggagcaggaggtggaggagttcgtgggcaagaagaccgacaaggcctactggctgctggaggagatgctgaccaaggagctgctggagctggacagcgtggagaccggcggccaggacagcgtgagacaggccagaaaggaggccgtgtgcaagatccaggccatcctggagaagctggagaagaagggcctgtag

SEQ ID NO: 12169 - DNA, 321 bp, Artificial Sequence
  Description of Artificial Sequence: Synthetic coding sequence
tgaaacctgagagagggcgccgagcagaaggtggtgttcatcaccggcagagtgcaccccggcgagacccccagcagcttcgtgtgccagggcatcatcgacttcctggtgagccagcaccccatcgcctgcgtgctgagagagtacctggtgttcaagatcgcccccatgctgaaccccgacggcgtgtacctgggcaactacagatgcctgagcctgatgagaaacggcagcagaggcagacccttcttccccagcagcagcgccagaatgctgagaaccagccccatccccgcccaccccctgaccggcaccctgtag

SEQ ID NO: 12170 - DNA, 684 bp, Artificial Sequence
  Description of Artificial Sequence: Synthetic coding sequence
tgactgatcttcgcctgcctggtgcccggcttccccgccgtgatgagcagcagaggcccctgcaccctggagaccctgatcaaccccagccccagcgtggccgacgtgaagatctaccccgaggagatcacccccctgctgcccgccatcagcggcgagaagatcgccgaggaccagacctgcttcttcctgcagatcctgctgaagtacatggtgatccaggccgccagcctggagtggaagaacaaggagaaccaggacaccggcttcaagttcctgttcaccctgttcagaaagtactacctgccccacctgttccccagcttcaccaagctgaccaacatctacaagcccgtgctggacatcccccacctgagacccaagcccgtgtacatcaccaccaccagagacaacgagaacatctacagcaccaagatcccctacatggccgccagagtggtgttcatcaagtggatcgtgaccttcttcctggagaagaagtacctgaccgccacccagaacaccaagaacggcgtggacgtgctgcccaagatcatccagaccgtgggcggcggcgccgtgcaggagagagcccccgagctggacggcggcggccccaccgagcaggacaagagccacagcaacagcagcaccctgagcgacagaagactgagcaacagctag

SEQ ID NO: 12171 - DNA, 573 bp, Artificial Sequence
  Description of Artificial Sequence: Synthetic coding sequence
atggagccccccatggagcccagcggcggcgagcaggagcccggcgccgtgagattcctggacctgccctgggaggacgtgctgctgccccacgtgctgaacagagtgcccctgagacagctgctgagactgcagagagtgagcagagccttcagaagcctggtgcagctgcacctggccggcctgagaagattcgacgccgcccaggtgggcccccagatccccagagccgccctggccagactgctgagagacgccgagggcctgcaggagctggccctggccccctgccacgagtggctgagcgacgaggacctggtgcccgtgctggccagaaacccccagctgagaagcgtggccctgggcggctgcggccagctgagcagaagagccctgggcgccctggccgagggctgccccagactgcagagactgagcctggcccactgcgactgggtggacggcctggccctgagaggcctggccgacagatgccccgccctggaggagctggacctgaccgcctgcagacagctgaaggacgaggccatcgtgtacctggcccagagatag

SEQ ID NO: 12172 - DNA, 270 bp, Artificial Sequence; identical to SEQ ID NO: 11466
  Description of Artificial Sequence: Synthetic coding sequence

SEQ ID NO: 12173 - DNA, 381 bp, Artificial Sequence
  Description of Artificial Sequence: Synthetic coding sequence
atgaccaccagaagcgtgctggacgtggagaccttcgtggccgacatcctgaagggcgagaacctgagcaagaaggccaaggagaagagagagagcctgatcaagaagatcaaggacgtgaagagcatctacctgcaggagttccaggacaagggcgacgccgaggacggcgaggagtacgacgaccccttcgccggcccccccgacaccatcagcctggccagcgagagatacgacaaggacgacgaggcccccagcgacggcgcccagttcccccccatcgccgcccaggacctgcccttcgtgctgaaggccggctacctggagaagagaagaaaggaccacagcttcctgggcttcgagtggcagaagagatggtag

SEQ ID NO: 12174 - DNA, 678 bp, Artificial Sequence
  Description of Artificial Sequence: Synthetic coding sequence
atgctgagcgccgtggccagaggctaccagggctggttccacccctgcgccagactgagcgtgagaatgagcagcaccggcatcgacagaaagggcgtgctggccaacagagtggccgtggtgaccggcagcaccagcggcatcggcttcgccatcgccagaagactggccagagacggcgcccacgtggtgatcagcagcagaaagcagcagaacgtggacagagccatggccaagctgcagggcgagggcctgagcgtggccggcatcgtgtgccacgtgggcaaggccgaggacagagagcagctggtggccaaggccctggagcactgcggcggcgtggacttcctggtgtgcagcgccggcgtgaaccccctggtgggcagcaccctgggcaccagcgagcagatctgggacaagatcctgagcgtgaacgtgaagagccccgccctgctgctgagccagctgctgccctacatggagaacagaagaggcgccgtgatcctggtgagcagcatcgccgcctacaaccccgtggtggccctgggcgtgtacaacgtgagcaagaccgccctgctgggcctgaccagaaccctggccctggagctggcccccaaggacatcagagtgaactgcgtggtgcccggcatcatcaagaccgacttcagcaaggtgtag

SEQ ID NO: 12175 - DNA, 1080 bp, Artificial Sequence
  Description of Artificial Sequence: Synthetic coding sequence
tgagccaccgccatgaccagcgcctggctggcccagggcaccggcgagggcgtgaacgacgtgagaaagggcgcctgcgccagccacgtgagcaccatggccagcttcctgaagggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12176 - DNA, 483 bp, Artificial Sequence; identical to SEQ ID NO: 10977
  Description of Artificial Sequence: Synthetic coding sequence

SEQ ID NO: 12177 - DNA, 2616 bp, Artificial Sequence
  Description of Artificial Sequence: Synthetic coding sequence
atgggcgacagcgacgacgagtacgacagaagaagaagagacaagttcagaagagagagaagcgactacgacagaagcagagagagagacgagagaagaagaggcgacgactggaacgacagagagtgggacagaggcagagagagaagaagcagaggcgagtacagagactacgacagaaacagaagagagagattcagcccccccagacacgagctgagccccccccagaagagaatgagaagagactgggacgagcacagcagcgacccctaccacagcggctacgagatgccctacgccggcggcggcggcggccccacctacggccccccccagccctggggccaccccgacgtgcacatcatgcagcaccacgtgctgcccatccaggccagactgggcagcatcgccgagatcgacctgggcgtgcccccccccgtgatgaagaccttcaaggagttcctgctgagcctggacgacagcgtggacgagaccgaggccgtgaagagatacaacgactacaagctggacttcagaagacagcagatgcaggacttcttcctggcccacaaggacgaggagtggttcagaagcaagtaccaccccgacgaggtgggcaagagaagacaggaggccagaggcgccctgcagaacagactgagagtgttcctgagcctgatggagaccggctggttcgacaacctgctgctggacatcgacaaggccgacgccatcgtgaagatgctggacgccgccgtgatcaagatggagggcggcaccgagaacgacctgagaatcctggagcaggaggaggaggaggagcaggccggcaagcccggcgagcccagcaagaaggaggagggcagagccggcgccggcctgggcgacggcgagagaaagaccaacgacaaggacgagaagaaggaggacggcaagcaggccgagaacgacagcagcaacgacgacaagaccaagaagagcgagggcgacggcgacaaggaggagaagaaggaggacagcgagaaggaggccaagaagagcagcaagaagagaaacagaaagcacagcggcgacgacagcttcgacgagggcagcgtgagcgagagcgagagcgagagcgagagcggccaggccgaggaggagaaggaggaggccgaggccctgaaggagaaggagaagcccaaggaggaggagtgggagaagcccaaggacgccgccggcctggagtgcaagcccagacccctgcacaagacctgcagcctgttcatgagaaacatcgcccccaacatcagcagagccgagatcatcagcctgtgcaagagataccccggcttcatgagagtggccctgagcgagccccagcccgagagaagattcttcagaagaggctgggtgaccttcgacagaagcgtgaacatcaaggagatctgctggaacctgcagaacatcagactgagagagtgcgagctgagccccggcgtgaacagagacctgaccagaagagtgagaaacatcaacggcatcacccagcacaagcagatcgtgagaaacgacatcaagctggccgccaagctgatccacaccctggacgacagaacccagctgtgggccagcgagcccggcaccccccccctgcccaccagcctgcccagccagaaccccatcctgaagaacatcaccgactacctgatcgaggaggtgagcgccgaggaggaggagctgctgggcagcagcggcggcgccccccccgaggagccccccaaggagggcaaccccgccgagatcaacgtggagagagacgagaagctgatcaaggtgctggacaagctgctgctgtacctgagaatcgtgcacagcctggactactacaacacctgcgagtaccccaacgaggacgagatgcccaacagatgcggcatcatccacgtgagaggccccatgccccccaacagaatcagccacggcgaggtgctggagtggcagaagaccttcgaggagaagctgacccccctgctgagcgtgagagagagcctgagcgaggaggaggcccagaagatgggcagaaaggaccccgagcaggaggtggagaagttcgtgaccagcaacacccaggagctgggcaaggacaagtggctgtgccccctgagcggcaagaagttcaagggccccgagttcgtgagaaagcacatcttcaacaagcacgccgagaagatcgaggaggtgaagaaggaggtggccttcttcaacaacttcctgaccgacgccaagagacccgccctgcccgagatcaagcccgcccagccccccggccccgcccagagcctgacccccggcctgccctacccccaccagaccccccagggcctgatgccctacggccagcccagaccccccatcctgggctacggcgccggcgccgtgagacccgccgtgcccaccggcggccccccctacccccacgccccctacggcgccggcagaggcaactacgacgccttcagaggccagggcggctaccccggcaagcccagaaacagaatggtgagaggcgaccccagagccatcgtggagtacagagacctggacgcccccgacgacgtggacttcttctag

SEQ ID NO: 12178 - DNA, 2025 bp, Artificial Sequence; identical to SEQ ID NO: 10426
  Description of Artificial Sequence: Synthetic coding sequence

SEQ ID NO: 12179 - DNA, 1467 bp, Artificial Sequence
  Description of Artificial Sequence: Synthetic coding sequence
atgagcgacgaggtgttcagcaccaccctggcctacaccaagagccccaaggtgaccaagagaaccaccttccaggacgagctgatcagagccatcaccgccagaagcgccagacagagaagcagcgagtacagcgacgacttcgacagcgacgagatcgtgagcctgggcgacttcagcgacaccagcgccgacgagaacagcgtgaacaagaagatgaacgacttccacatcagcgacgacgaggagaagaaccccagcaagctgctgttcctgaagaccaacaagagcaacggcaacatcaccaaggacgagcccgtgtgcgccatcaagaacgaggaggagatggcccccgacggctgcgaggacatcgtggtgaagagcttcagcgagagccagaacaaggacgaggagttcgagaaggacaagatcaagatgaagcccaagcccagaatcctgagcatcaagagcaccagcagcgagaacaacagcctggacaccgacgaccacttcaagcccagccccagacccagaagcatgctgaagaagaagagccacatggaggagaaggacggcctggaggacaaggagaccgccctgagcgaggagctggagctgcacagcgcccccagcagcctgcccacccccaacggcatccagctggaggccgagaagaaggccttcagcgagaacctggaccccgaggacagctgcctgaccagcctggccagcagcagcctgaagcagatcctgggcgacagcttcagccccggcagcgagggcaacgccagcggcaaggaccccaacgaggagatcaccgagaaccacaacagcctgaagagcgacgagaacaaggagaacagcttcagcgccgaccacgtgaccaccgccgtggagaagagcaaggagagccaggtgaccgccgacgacctggaggaggagaaggccaaggccgagctgatcatggacgacgacagaaccgtggaccccctgctgagcaagagccagagcatcctgatcagcaccagcgccaccgccagcagcaagaagaccatcgaggacagaaacatcaagaacaagaagagcaccaacaacagagccagcagcgccagcgccagactgatgaccagcgagttcctgaagaagagcagcagcaagagaagaacccccagcaccaccaccagcagccactacctgggcaccctgaaggtgctggaccagaagcccagccagaagcagagcatcgagcccgacagagccgacaacatcagagccgccgtgtaccaggagtggctggagaagaagaacgtgtacctgcacgagatgcacagaatcaagagaatcgagagcgagaacctgagaatccagaacgagcagaagaaggccgccaagagagaggaggccctggccagcttcgaggcctggaaggccatgaaggagaaggaggccaagaagatcgccgcctag

SEQ ID NO: 12180 - DNA, 564 bp, Artificial Sequence
  Description of Artificial Sequence: Synthetic coding sequence
atggtgagagagcccggccccagacccggcacccccggctgcagcgccagcggccagtggaccgccaccctgagaccctacctgagcgccgtgagagccaccctgcaggccgccctgtgcctggagaacttcagcagccaggtggtggagagacacaacaagcccgaggtggaggtgagaagcagcaaggagctgctgctgcagcccgtgaccatcagcagaaacgagaaggagaaggtgctgatcgagggcagcatcaacagcgtgagagtgagcatcgccgtgaagcaggccgacgagatcgagaagatcctgtgccacaagttcatgagattcatgatgatgagagccgagaacttcttcatcctgagaagaaagcccgtggagggctacgacatcagcttcctgatcaccaacttccacaccgagcagatgtacaagcacaagctggtggacttcgtgatccacttcatggaggagatcgacaaggagatcagcgagatgaagctgagcgtgaacgccagagccagaatcgtggccgaggagttcctgaagaacttctag

SEQ ID NO: 12181 - DNA, 1068 bp, Artificial Sequence
  Description of Artificial Sequence: Synthetic coding sequence
tgaagcctggccagcagcctgagaaacaaggagggcaccctgggcagcaaggtgggctacctggacgtggaggccagaggccccggcgagggcagaggcggcggcggcgagagcccccccctgcagccccccccccccgcccccgtgctgctgtacgaccagggcggcggcagaagaagaagaggcgaggccgaggccgaggccgaggagtgggaggccgagagcgtgctgggcaccctgctgcagaagctgagagaggagggctacctggcctactacctgcagggcggcttcagcagattccaggccgagtgcccccacctgtgcgagaccagcctggccggcagagccggcagcagcatggcccccgtgcccggccccgtgcccgtggtgggcctgggcagcctgtgcctgggcagcgactgcagcgacgccgagagcgaggccgacagagacagcatgagctgcggcctggacagcgagggcgccacccccccccccgtgggcctgagagccagcttccccgtgcagatcctgcccaacctgtacctgggcagcgccagagacagcgccaacctggagagcctggccaagctgggcatcagatacatcctgaacgtgacccccaacctgcccaacttcttcgagaagaacggcgacttccactacaagcagatccccatcagcgaccactggagccagaacctgagcagattcttccccgaggccatcgagttcatcgacgaggccctgagccagaactgcggcgtgctggtgcactgcctggccggcgtgagcagaagcgtgaccgtgaccgtggcctacctgatgcagaagctgcacctgagcctgaacgacgcctacgacctggtgaagagaaagaagagcaacatcagccccaacttcaacttcatgggccagctgctggacttcgagagaagcctgagactggaggagagacacagccaggagcagggcagcggcggccaggccagcgccgccagcaacccccccagcttcttcaccacccccaccagcgacggcgccttcgagctggcccccacctag

SEQ ID NO: 12182 - DNA, 51 bp, Artificial Sequence; identical to SEQ ID NO: 11825
  Description of Artificial Sequence: Synthetic coding sequence

SEQ ID NO: 12183 - DNA, 1620 bp, Artificial Sequence; identical to SEQ ID NO: 10018
  Description of Artificial Sequence: Synthetic coding sequence

SEQ ID NO: 12184 - DNA, 474 bp, Artificial Sequence; identical to SEQ ID NO: 11812
  Description of Artificial Sequence: Synthetic coding sequence

SEQ ID NO: 12185 - DNA, 2553 bp, Artificial Sequence
  Description of Artificial Sequence: Synthetic coding sequence
atggagcccgagagaaagggcctgagcctggccagcagcagcgacggcgacggcagagaggagaacaagctgaagcagggcatcagccaggacctggccagcagcagcagactggacagatacaagatcgccagacagctgaccgagaaggccatcaaggagaagaagatcttcagcatctacggccactaccccgtggtgagagccgccctgagaagaaagggctgggtggagaagaagttccacttcctgcccaaggtgatccccgacgtggaggacgagggcgccagagtgaacgacgacacctgcgccaaggtgaaggagaaccaggagatggccctggagaagaccgacaacatccacgacgtgatgagcagactggtgaagaacgagatgccctacctgctgtggaccatcaagagagacatcatcgactaccacagcctgacctacgaccagatgctgaaccactacgccaagaccgccagcttcaccaccaagatcggcctgtgcgtgaacatgagaagcctgccctggtacgtgcccgccaaccccgacagcttcttccccagatgctacagcctgtgcaccgagagcgagcagcaggagttcctggaggacttcagaagaaccatggccagcagcatcctgaagtgggtggtgagccaccagagctgcagcagaagcagcagaagcaagcccagagaccagagagaggaggccggcagcagcgacctgagcagcagacaggacgccgagaacgccgaggccaagctgagaggcctgcccggccagctggtggacatcgcctgcaaggtgtgccaggcctacctgggccagctggagcacgaggacatcgacaccagcgccgacgccgtggaggacctgaccgaggccgagtgggaggacctgacccagcagtactacagcctggtgcacggcgacgccttcatcagcaacagcagaaactacttcagccagtgccaggccctgctgaacagaatcaccagcgtgaacccccagaccgacatcgacggcctgagaaacatctggatcatcaagcccgccgccaagagcagaggcagagacatcgtgtgcatggacagagtggaggagatcctggagctggccgccgccgaccaccccctgagcagagacaacaagtgggtggtgcagaagtacatcgagacccccctgctgatctgcgacaccaagttcgacatcagacagtggttcctggtgaccgactggaaccccctgaccatctggttctacaaggagagctacctgagattcagcacccagagattcagcctggacaagctggacagcgccatccacctgtgcaacaacgccgtgcagaagtacctgaagaacgacgtgggcagaagccccctgctgcccgcccacaacatgtggaccagcaccagattccaggagtacctgcagagacagggcagaggcgccgtgtggggcagcgtgatctaccccagcatgaagaaggccatcgcccacgccatgaaggtggcccaggaccacgtggagcccagaaagaacagcttcgagctgtacggcgccgacttcgtgctgggcagagacttcagaccctggctgatcgagatcaacagcagccccaccatgcaccccagcacccccgtgaccgcccagctgtgcgcccaggtgcaggaggacaccatcaaggtggccgtggacagaagctgcgacatcggcaacttcgagctgctgtggagacagcccgtggtggagcccccccccttcagcggcagcgacctgtgcgtggccggcgtgagcgtgagaagagccagaagacaggtgctgcccgtgtgcaacctgaaggccagcgccagcctgctggacgcccagcccctgaaggccagaggccccagcgccatgcccgaccccgcccagggcccccccagccccgccctgcagagagacctgggcctgaaggaggagaagggcctgcccctggccctgctggcccccctgagaggcgccgccgagagcggcggcgccgcccagcccaccagaaccaaggccgccggcaaggtggagctgcccgcctgcccctgcagacacgtggacagccaggcccccaacaccggcgtgcccgtggcccagcccgccaagagctgggaccccaaccagctgaacgcccaccccctggagcccgtgctgagaggcctgaagaccgccgagggcgccctgagacccccccccggcggcaagggcgagggcaccgtgtgcagcagactgccccaccacggccaccacgtggccgcctgccagaccaccggcaccacctgggacggcggccccggcgtgtgcttcctgagacagctgctggccagcgagctgcccatgggccccggcctgcccagagaccccagagcccccccctgcctggtgtgcagaggcctgctgccccccgccggcccctgcaagagatgcagaagcttctgcgccgccgtgctgcagggcgccagcttcgtgagactgggcggcagaagctgcagccccagaaccccctag

SEQ ID NO: 12186 - DNA, 2739 bp, Artificial Sequence
  Description of Artificial Sequence: Synthetic coding sequence
atgaagagaggcatcagaagagaccccttcagaaagagaaagctgggcggcagagccaagaaggtgagagagcccaccgccgtgaacagcttctacagagaggccagcctgcccagcgtgtgggccagcctgagaagaagagagatggtgagaagcggcgccagacccggccaggtgctgagcagcggcagacacaccggccccgccaagctgaccaacggcaagaaggccacctacctgagaaagatccccagattcaacgccgacagcggctacagcatccacagcgacagcgagagccaggccgagaccgtgcacggcctggacggctgcgccagcctgctgagagacatcctgagaaacgaggacagcgccagcagcgacaacaagaagcagatccccaacgaggccagcgccagaagcgagagagacaccagcgacctggagcagaactggagcctgcaggaccactacagaatgtacagccccatcatctaccaggccctgtgcgagcacgtgcagacccagatgagcctgatgaacgacctgaccagcaagaacatccccaacggcatccccgccgtgccctgccacgcccccagccacagcgagagccaggccaccccccacagcagctacggcctgtgcaccagcacccccgtgtggagcctgcagagacccccctgcccccccaaggtgcacagcgaggtgcagaccgacggcaacagccagttcgccagccagggcaagaccgtgagcgccacctgcaccgacgtgctgagaaacagcttcaacaccagccccggcgtgccctgcagcctgcccaagaccgacatcagcgccatccccaccctgcagcagctgggcctggtgaacggcatcctgccccagcagggcatccacaaggagaccgacctgctgaagtgcatccagacctacctgagcctgttcagaagccacggcaaggagacccacctggacagccagacccacagaagccccacccagagccagcccgccttcctggccaccaacgaggagaagtgcgccagagagcagatcagagaggccaccagcgagagaaaggacctgaacatccacgtgagagacaccaagaccgtgaaggacgtgcagaaggccaagaacgtgaacaagaccgccgagaaggtgagaatcatcaagtacctgctgggcgagctgaaggccctggtggccgagcaggaggacagcgagatccagagactgatcaccgagatggaggcctgcatcagcgtgctgcccaccgtgagcggcaacaccgacatccaggtggagatcgccctggccatgcagcccctgagaagcgagaacgcccagctgagaagacagctgagaatcctgaaccagcagctgagagagcagcagaagacccagaagcccagcggcgccgtggactgcaacctggagctgttcagcctgcagagcctgaacatgagcctgcagaaccagctggaggagagcctgaagagccaggagctgctgcagagcaagaacgaggagctgctgaaggtgatcgagaaccagaaggacgagaacaagaagttcagcagcatcttcaaggacaaggaccagaccatcctggagaacaagcagcagtacgacatcgagatcaccagaatcaagatcgagctggaggaggccctggtgaacgtgaagagcagccagttcaagctggagaccgccgagaaggagaaccagatcctgggcatcaccctgagacagagagacgccgaggtgaccagactgagagagctgaccagaaccctgcagaccagcatggccaagctgctgagcgacctgagcgtggacagcgccagatgcaagcccggcaacaacctgaccaagagcctgctgaacatccacgacaagcagctgcagcacgaccccgcccccgcccacaccagcatcatgagctacctgaacaagctggagaccaactacagcttcacccacagcgagcccctgagcaccatcaagaacgaggagaccatcgagcccgacaagacctacgagaacgtgctgagcagcagaggcccccagaacagcaacaccagaggcatggaggaggccagcgcccccggcatcatcagcgccctgagcaagcaggacagcgacgagggcagcgagaccatggccctgatcgaggacgagcacaacctggacaacaccatctacatccccttcgccagaagcacccccgagaagaagagccccctgagcaagagactgagcccccagccccagatcagagccgccaccacccagctggtgagcaacagcggcctggccgtgagcggcaaggagaacaagctgtgcacccccgtgatctgcagcagcagcaccaaggaggccgaggacgcccccgagaagctgagcagagccagcgacatgaaggacacccagctgctgaagaagatcaaggaggccatcggcaagatccccgccgccaccaaggagcccgaggagcagaccgcctgccacggccccagcggctgcctgagcaacagcctgcaggtgaagggcaacaccgtgtgcgacggcagcgtgttcaccagcgacctgatgagcgactggagcatcagcagcttcagcaccttcaccagcagagacgagcaggacttcagaaacggcctggccgccctggacgccaacatcgccagactgcagaagagcctgagaaccggcctgctggagaagtag

SEQ ID NO: 12187 - DNA, 528 bp, Artificial Sequence
  Description of Artificial Sequence: Synthetic coding sequence
atggagctgaccatcttcatcctgagactggccatctacatcctgaccttccccctgtacctgctgaacttcctgggcctgtggagctggatctgcaagaagtggttcccctacttcctggtgagattcaccgtgatctacaacgagcagatggccagcaagaagagagagctgttcagcaacctgcaggagttcgccggccccagcggcaagctgagcctgctggaggtgggctgcggcaccggcgccaacttcaagttctacccccccggctgcagagtgctgagacccggcggcgccttctacttcatggagcacgtggccgccgagtgcagcacctggaactacttctggcagcaggtgctggaccccgcctggcacctgctgttcgacggctgcaacctgaccagagagagctggaaggccctggagagagccagcttcagcaagctgaagctgcagcacatccaggcccccctgagctgggagctggtgagaccccacatctacggctacgccgtgaagtag

SEQ ID NO: 12188 - DNA, 1392 bp, Artificial Sequence
  Description of Artificial Sequence: Synthetic coding sequence
atgagcggcggcaccccctacatcggcagcaagatcagcctgatcagcaaggccgagatcagatacgagggcatcctgtacaccatcgacaccgagaacagcaccgtggccctggccaaggtgagaagcttcggcaccgaggacagacccaccgacagacccatcccccccagagacgaggtgttcgagtacatcatcttcagaggcagcgacatcaaggacctgaccgtgtgcgagccccccaagccccagtgcagcctgccccaggaccccgccatcgtgcagagcagcctgggcagcagcaccagcagcttccagagcatgggcagctacggccccttcggcagaatgcccacctacagccagttcagccccagcagcctggtgggccagcagttcggcgccgtgggcgtggccggcagcagcctgaccagcttcggcaccgagaccagcaacagcggcaccctgccccagagcagcgccgtgggcagcgccttcacccaggacaccagaagcctgaagacccagctgagccagggcagaagcagcccccagctggaccccctgagaaagagccccaccatggagcaggccgtgcagaccgccagcgcccacctgcccgcccccgccgccgtgggcagaagaagccccgtgagcaccagacccctgcccagcgccagccagaaggccggcgagaaccaggagcacagaagagccgaggtgcacaaggtgagcagacccgagaacgagcagctgagaaacgacaacaagagacaggtggcccccggcgcccccagcgcccccagaagaggcagaggcggccacagaggcggcagaggcagattcggcatcagaagagacggccccatgaagttcgagaaggacttcgacttcgagagcgccaacgcccagttcaacaaggaggagatcgacagagagttccacaacaagctgaagctgaaggaggacaagctggagaagcaggagaagcccgtgaacggcgaggacaagggcgacagcggcgtggacacccagaacagcgagggcaacgccgacgaggaggaccccctgggccccaactgctactacgacaagaccaagagcttcttcgacaacatcagctgcgacgacaacagagagagaagacccacctgggccgaggagagaagactgaacgccgagaccttcggcatccccctgagacccaacagaggcagaggcggctacagaggcagaggcggcctgggcttcagaggcggcagaggcagaggcggcggcagaggcggcaccttcaccgcccccagaggcttcagaggcggcttcagaggcggcagaggcggcagagagttcgccgacttcgagtacagaaagaccaccgccttcggcccctag

SEQ ID NO: 12189 - DNA, 2790 bp, Artificial Sequence
  Description of Artificial Sequence: Synthetic coding sequence
atggccgaggtggaggccgtgcagctgaaggaggagggcaacagacacttccagctgcaggactacaaggccgccaccaacagctacagccaggccctgaagctgaccaaggacaaggccctgctggccaccctgtacagaaacagagccgcctgcggcctgaagaccgagagctacgtgcaggccgccagcgacgccagcagagccatcgacatcaacagcagcgacatcaaggccctgtacagaagatgccaggccctggagcacctgggcaagctggaccaggccttcaaggacgtgcagagatgcgccaccctggagcccagaaaccagaacttccaggagatgctgagaagactgaacaccagcatccaggagaagctgagagtgcagttcagcaccgacagcagagtgcagaagatgttcgagatcctgctggacgagaacagcgaggccgacaagagagagaaggccgccaacaacctgatcgtgctgggcagagaggaggccggcgccgagaagatcttccagaacaacggcgtggccctgctgctgcagctgctggacaccaagaagcccgagctggtgctggccgccgtgagaaccctgagcggcatgtgcagcggccaccaggccagagccaccgtgatcctgcacgccgtgagaatcgacagaatctgcagcctgatggccgtggagaacgaggagatgagcctggccgtgtgcaacctgctgcaggccatcatcgacagcctgagcggcgaggacaagagagagcacagaggcaaggaggaggccctggtgctggacaccaagaaggacctgaagcagatcaccagccacctgctggacatgctggtgagcaagaaggtgagcggccagggcagagaccaggccctgaacctgctgaacaagaacgtgcccagaaaggacctggccatccacgacaacagcagaaccatctacgtggtggacaacggcctgagaaagatcctgaaggtggtgggccaggtgcccgacctgcccagctgcctgcccctgaccgacaacaccagaatgctggccagcatcctgatcaacaagctgtacgacgacctgagatgcgaccccgagagagaccacttcagaaagatctgcgaggagtacatcaccggcaagttcgacccccaggacatggacaagaacctgaacgccatccagaccgtgagcggcatcctgcagggccccttcgacctgggcaaccagctgctgggcctgaagggcgtgatggagatgatggtggccctgtgcggcagcgagagagagaccgaccagctggtggccgtggaggccctgatccacgccagcaccaagctgagcagagccaccttcatcatcaccaacggcgtgagcctgctgaagcagatctacaagaccaccaagaacgagaagatcaagatcagaaccctggtgggcctgtgcaagctgggcagcgccggcggcaccgactacggcctgagacagttcgccgagggcagcaccgagaagctggccaagcagtgcagaaagtggctgtgcaacatgagcatcgacaccagaaccagaagatgggccgtggagggcctggcctacctgaccctggacgccgacgtgaaggacgacttcgtgcaggacgtgcccgccctgcaggccatgttcgagctggccaagaccagcgacaagaccatcctgtacagcgtggccaccaccctggtgaactgcaccaacagctacgacgtgaaggaggtgatccccgagctggtgcagctggccaagttcagcaagcagcacgtgcccgaggagcaccccaaggacaagaaggacttcatcgacatgagagtgaagagactgctgaaggccggcgtgatcagcgccctggcctgcatggtgaaggccgacagcgccatcctgaccgaccagaccaaggagctgctggccagagtgttcctggccctgtgcgacaaccccaaggacagaggcaccatcgtggcccagggcggcggcaaggccctgatccccctggccctggagggcaccgacgtgggcaaggtgaaggccgcccacgccctggccaagatcgccgccgtgagcaaccccgacatcgccttccccggcgagagagtgtacgaggtggtgagacccctggtgagactgctggacacccagagagacggcctgcagaactacgaggccctgctgggcctgaccaacctgagcggcagaagcgacaagctgagacagaagatcttcaaggagagagccctgcccgacatcgagaactacatgttcgagaaccacgaccagctgagacaggccgccaccgagtgcatgtgcaacatggtgctgcacaaggaggtgcaggagagattcctggccgacggcaacgacagactgaagctggtggtgctgctgtgcggcgaggacgacgacaaggtgcagaacgccgccgccggcgccctggccatgctgaccgccgcccacaagaagctgtgcctgaagatgacccaggtgaccacccagtggctggagatcctgcagagactgtgcctgcacgaccagctgagcgtgcagcacagaggcctggtgatcgcctacaacctgctggccgccgacgccgagctggccaagaagctggtggagagcgagctgctggagatcctgaccgtggtgggcaagcaggagcccgacgagaagaaggccgaggtggtgcagaccgccagagagtgcctgatcaagtgcatggactacggcttcatcaagcccgtgagctag

SEQ ID NO: 12190 - DNA, 246 bp, Artificial Sequence
  Description of Artificial Sequence: Synthetic coding sequence
atgagccactacggcagctactacggcggcctgggctacagctgcggcggcttcggcggcctgggctacggctacggctgcggctgcggcagcttctgcagaagaggcagcggctgcggctacggcggctacggctacggcagcggcttcggcggctacggctacggcagcggcttcggcggctacggctacggctgctgcagacccagctacaacggcggctacggcttcagcggcttctactag

SEQ ID NO: 12191 - DNA, 150 bp, Artificial Sequence
  Description of Artificial Sequence: Synthetic coding sequence
atggaggtgcccagactggaccacgccctgaacagccccaccagcccctgcgaggaggtgatcaagaacctgagcctggaggccatccagctgtgcgacagagacgtggtgttcgaggagctgaccagcaagcagaccagaaagggctag

SEQ ID NO: 12192 - DNA, 498 bp, Artificial Sequence
  Description of Artificial Sequence: Synthetic coding sequence
atgagcagatacctgagaccccccaacaccagcctgttcgtgagaaacgtggccgacgacaccagaagcgaggacctgagaagagagttcggcagatacggccccatcgtggacgtgtacgtgcccctggacttctacaccagaagacccagaggcttcgcctacgtgcagttcgaggacgtgagagacgccgaggacgccctgcacaacctggacagaaagtggatctgcggcagacagatcgagatccagttcgcccagggcgacagaaagacccccaaccagatgaaggccaaggagggcagaaacgtgtacagcagcagcagatacgacgactacgacagatacagaagaagcagaagcagaagctacgagagaagaagaagcagaagcagaagcttcgactacaactacagaagaagctacagccccagaaagcccaactgcagctggaacacccagtacagcagcgcctactacaccagcagaaagatctag

SEQ ID NO: 12193 - DNA, 1803 bp, Artificial Sequence; identical to SEQ ID NO: 11130
  Description of Artificial Sequence: Synthetic coding sequence

SEQ ID NO: 12194 - DNA, 465 bp, Artificial Sequence
  Description of Artificial Sequence: Synthetic coding sequence
atggtgagcagcgcccagatgggcttcaacctgcaggccctgctggagcagctgagccaggacgagctgagcaagttcaagtacctgatcaccaccttcagcctggcccacgagctgcagaagatcccccacaaggaggtggacaaggccgacggcaagcagctggtggagatcctgaccacccactgcgacagctactgggtggagatggccagcctgcaggtgttcgagaagatgcacagaatggacctgagcgagagagccaaggacgaggtgagagaggccgccctgaagagcttcaacaagagaaagcccctgagcctgggcatcaccagaaaggagagaccccccctggacgtggacgagatgctggagagattcaagaccgaggcccaggccttcaccgagaccaagggcaacgtgatctgcctgggcaaggaggtgttcaagggcaagaagccctag

SEQ ID NO: 12195 - DNA, 474 bp, Artificial Sequence; identical to SEQ ID NO: 11812
  Description of Artificial Sequence: Synthetic coding sequence

SEQ ID NO: 12196 - DNA, 348 bp, Artificial Sequence; identical to SEQ ID NO: 11792
  Description of Artificial Sequence: Synthetic coding sequence

SEQ ID NO: 12197 - DNA, 432 bp, Artificial Sequence
  Description of Artificial Sequence: Synthetic coding sequence
gtgagagagctggaggccgagctggacgccgagcagaagaagcacgccgaggccctgaagggcgtgagaaagcacgagagaagagtgaaggagctggcctaccaggtgggcgacagagtgagcctgggcagcggccccggcgccggccccgcccaggccagccccgagagccccctgcccgcccaggccgaggaggacagaaagaacctggccagaatgcaggacctggtggacaagctgcagagcaaggtgaagagctacaagagacagttcgaggaggccgagcagcaggccaacaccaacctggccaagtacagaaaggcccagcacgagctggacgacgccgaggagagagccgacatggccgagacccaggccaacaagctgagagccagaaccagagacgccctgggccccaagcacaaggagtag

SEQ ID NO: 12198 - DNA, 828 bp, Artificial Sequence; identical to SEQ ID NO: 10301
  Description of Artificial Sequence: Synthetic coding sequence

SEQ ID NO: 12199 - DNA, 339 bp, Artificial Sequence
  Description of Artificial Sequence: Synthetic coding sequence
tgatgcgccagaaccgccggcggctgcctgggctgcctgagcggccagtgctgctgcagactgtgccccctgaccctgcccgccaccagaagcctgtgccccggcagagtggtgtgggccagaagaagatggtggcccagctggctggcctggagatgcctgtggtgcaccaccagaccccccgcctgcatggagaacaccgacgccttcctgttcctgttcagcttcaccgacagagccagcttcgaggacctgcccggccagctggccagaatcgccggcgaggcccccggcgtggtgagaatggtgatcggcagcaagttcgaccagtacatgtag

SEQ ID NO: 12200 - DNA, 3330 bp, Artificial Sequence
  Description of Artificial Sequence: Synthetic coding sequence
atgggcaccggcgacttcatctgcatcagcatgaccggcggcgccccctggggcttcagactgcagggcggcaaggagcagaagcagcccctgcaggtggccaagatcagaaaccagagcaaggccagcggcagcggcctgtgcgagggcgacgaggtggtgagcatcaacggcaacccctgcgccgacctgacctaccccgaggtgatcaagctgatggagagcatcaccgacagcctgcagatgctgatcaagagacccagcagcggcatcagcgaggccctgatcagcgagaacgagaacaagaacctggagcacctgacccacggcggctacgtggagagcaccaccctgcagatcagacccgccaccaagacccagtgcaccgagttcttcctggcccccgtgaagaccgaggtgcccctggccgagaaccagagaagcggccccgactgcgccggcagcctgaaggaggagaccggccccagctaccagagagccccccagatgcccgacagccagagaggcagagtggccgaggagctgatcctgagagagaaggtggaggccgtgcagcccggccccgtggtggagctgcagctgagcctgagccaggagagacacaagggcgccagcggccccctggtggccctgcccggcgccgagaagagcaagagccccgaccccgaccccaacctgagccacgacagaatcgtgcacatcaacagcatccccaccaacgagaaggccgaccccttcctgagaagcagcaagatcatccagatcagcagcggcagagagctgagagtgatccaggagagcgaggccggcgacgccggcctgcccagagtggaggtgatcctggactgcagcgacagacagaagaccgagggctgcagactgcaggccggcaaggagtgcgtggacagccccgtggagggcggccagagcgaggccccccccagcctggtgagcttcgccgtgagcagcgagggcaccgagcagggcgaggaccccagaagcgagaaggaccacagcagaccccacaagcacagagccagacacgccagactgagaagaagcgagagcctgagcgagaagcaggtgaaggaggccaagagcaagtgcaagagcatcgccctgctgctgaccgacgcccccaaccccaacagcaagggcgtgctgatgttcaagaagagaagaagaagagccagaaagtacaccctggtgagctacggcaccggcgagctggagagagaggccgacgaggaggaggagggcgacaaggaggacacctgcgaggtggccttcctgggcgccagcgagagcgaggtggacgaggagctgctgagcgacgtggacgacaacacccaggtggtgaacttcgactgggacagcggcctggtggacatcgagaagaagctgaacagaggcgacaagatggagatgctgcccgacaccaccggcaagggcgccctgatgttcgccaagagaagagagagaatggaccagatcaccgcccagaaggaggaggacaaggtgggcggcacccccagcagagagcaggacgccgcccagaccgacggcctgagaaccaccaccagctaccagagaaaggaggaggagagcgtgagaacccagagcagcgtgagcaagagctacatcgaggtgagccacggcctgggccacgtgccccagcagaacggcttcagcggcaccagcgagaccgccaacatccagagaatggtgcccatgaacagaaccgccaagcccttccccggcagcgtgaaccagcccgccacccccttcagccccaccagaaacatgaccagccccatcgccgacttccccgccccccccccctacagcgccgtgacccccccccccgacgccttcagcagaggcgtgagcagccccatcgccggccccgcccagccccccccctggccccagcccgccccctggagccagcccgccttctacgacagcagcgagagaatcgccagcagagacgagagaatcagcgtgcccgccaagagaaccggcatcctgcaggaggccaagagaagaagcaccaccaagcccatgttcaccttcaaggagcccaaggtgagccccaaccccgagctgctgagcctgctgcagaacagcgagggcaagagaggcaccggcgccggcggcgacagcggccccgaggaggactacctgagcctgggcgccgaggcctgcaacttcatgcagagcagcagcgccaagcagaagacccccccccccgtggcccccaagcccgccgtgaagagcagcagcagccagcccgtgacccccgtgagccccgtgtggagccccggcgtggcccccacccagccccccgccttccccaccagcaaccccagcaagggcaccgtggtgagcagcatcaagatcgcccagcccagctacccccccgccagacccgccagcaccctgaacgtggccggccccttcaagggcccccaggccgccgtggccagccagaactacacccccaagcccaccgtgagcacccccaccgtgaacgccgtgcagcccggcgccgtgggccccagcaacgagctgcccggcatgagcggcagaggcgcccagctgttcgccaagagacagagcagaatggagaagtacgtggtggacagcgacaccgtgcaggcccacgccgccagagcccagagccccacccccagcctgcccgccagctggaagtacagcagcaacgtgagagcccccccccccgtggcctacaaccccatccacagccccagctaccccctggccgccctgaagagccagcccagcgccgcccagcccagcaagatgggcaagaagaagggcaagaagcccctgaacgccctggacgtgatgaagcaccagccctaccagctgaacgccagcctgttcaccttccagccccccgacgccaaggacggcctgccccagaagagcagcgtgaaggtgaacagcgccctggccatgaagcaggccctgccccccagacccgtgaacgccgccagccccaccaacgtgcaggccagcagcgtgtacagcgtgcccgcctacaccagcccccccagcttcttcgccgaggccagcagccccgtgagcgccagccccgtgcccgtgggcatccccaccagccccaagcaggagagcgccagcagcagctacttcgtggcccccagacccaagttcagcgccaagaagagcggcgtgaccatccaggtgaagtgcaagagcggcatccacagccaggacatcatcagaacctacttccccgcctacctgagcagcagcacctag

SEQ ID NO: 12201 - DNA, 1554 bp, Artificial Sequence; identical to SEQ ID NO: 9849
  Description of Artificial Sequence: Synthetic coding sequence

SEQ ID NO: 12202 - DNA, 348 bp, Artificial Sequence; identical to SEQ ID NO: 11792
  Description of Artificial Sequence: Synthetic coding sequence

SEQ ID NO: 12203 - DNA, 1014 bp, Artificial Sequence
  Description of Artificial Sequence: Synthetic coding sequence
atggagctgaagaccctgtgggagaacaagctgatgcagagcagagccgtggacggcttccacagcgaggagcagcagctgctgctgcaggtgcagcagcagcaccagccccagcagcagcagcaccaccaccaccaccaccaccagcaggcccagccccagcagaccgtgccccagcaggcccagacccagcaggtgctgatccccgccagccagcaggccaccgccccccaggtgatcgtgcccgacagcaagctgatccagcacatgaacgccagcaacatgagcgccgccgccaccgccgccaccctggccctgcccgccggcgtgacccccgtgcagcagatcctgaccaacagcggccagctgctgcaggtggtgagagccgccaacggcgcccagtacatcttccagccccagcagagcgtggtgctgcagcagcaggtgatcccccagatgcagcccggcggcgtgcaggcccccgtgatccagcaggtgctggcccccctgcccggcggcatcagcccccagaccggcgtgatcatccagccccagcagatcctgttcaccggcaacaagacccaggtgatccccaccaccgtggccgcccccacccccgcccaggcccagatcaccgccaccggccagcagcagccccaggcccagcccgcccagacccaggcccccctggtgctgcaggtggacggcaccggcgacaccagcagcgaggaggacgaggacgaggaggaggactacgacgacgacgaggaggaggacaaggagaaggacggcgccgaggacggccaggtggaggaggagcccctgaacagcgaggacgacgtgagcgacgaggagggccaggagctgttcgacaccgagaacgtggtggtgtgccagtacgacaagatccacagaagcaagaacaagtggaagttccacctgaaggacggcatcatgaacctgaacggcagagactacatcttcagcaaggccatcggcgacgccgagtggtag

SEQ ID NO: 12204 - DNA, 3012 bp, Artificial Sequence
  Description of Artificial Sequence: Synthetic coding sequence
atgagccagtggacccccgagtacaacgagctgtacaccctgaaggtggacatgaagagcgagatccccagcgacgcccccaagacccaggagagcctgaagggcatcctgctgcaccccgagcccatcggcgccgccaagagcttccccgccggcgtggagatgatcaacagcaaggtgggcaacgagttcagccacctgtgcgacgacagccagaagcaggagaaggagatgaacggcaaccagcaggagcaggagaagagcctggtggtgagaaagaagagaaagagccagcaggccggccccagctacgtgcagaactgcgtgaaggagaaccagggcatcctgggcctgagacagcacctgggcacccccagcgacgaggacaacgacagcagcttcagcgactgcctgagcagccccagcagcagcctgcacttcggcgacagcgacaccgtgaccagcgacgaggacaaggaggtgagcgtgagacacagccagaccatcctgaacgccaagagcagaagccacagcgccagaagccacaagtggcccagaaccgagaccgagagcgtgagcggcctgctgatgaagagaccctgcctgcacggcagcagcctgagaagactgccctgcagaaagagattcgtgaagaacaacagcagccagagaacccagaagcagaaggagagaatcctgatgcagagaaagaagagagaggtgctggccagaagaaagtacgccctgctgcccagcagcagcagcagcagcgagaacgacctgagcagcgagagcagcagcagcagcagcaccgagggcgaggaggacctgttcgtgagcgccagcgagaaccaccagaacaaccccgccgtgcccagcggcagcatcgacgaggacgtggtggtgatcgaggccagcagcaccccccaggtgaccgccaacgaggagatcaacgtgaccagcaccgacagcgaggtggagatcgtgaccgtgggcgagagctacagaagcagaagcaccctgggccacagcagaagccactggagccagggcagcagcagccacgccagcagaccccaggagcccagaaacagaagcagaatcagcaccgtgatccagcccctgagacagaacgccgccgaggtggtggacctgaccgtggacgaggacgagcccaccgtggtgcccaccaccagcgccagaatggagagccaggccaccagcgccagcatcaacaacagcaaccccagcaccagcgagcaggccagcgacaccgccagcgccgtgaccagcagccagcccagcaccgtgagcgagaccagcgccaccctgaccagcaacagcaccaccggcaccagcatcggcgacgacagcagaagaaccaccagcagcgccgtgaccgagaccggcccccccgccatgcccagactgcccagctgctgcccccagcacagcccctgcggcggcagcagccagaaccaccacgccctgggccacccccacaccagctgcttccagcagcacggccaccacttccagcaccaccaccaccaccaccacaccccccaccccgccgtgcccgtgagccccagcttcagcgaccccgcctgccccgtggagagacccccccaggtgcaggccccctgcggcgccaacagcagcagcggcaccagctaccacgagcagcaggccctgcccgtggacctgagcaacagcggcatcagaagccacggcagcggcagcttccacggcgccagcgccttcgacccctgctgccccgtgagcagcagcagagccgccatcttcggccaccaggccgccgccgccgcccccagccagcccctgagcagcatcgacggctacggcagcagcatggtggcccagccccagccccagccccccccccagcccagcctgagcagctgcagacactacatgccccccccctacgccagcctgaccagacccctgcaccaccaggccagcgcctgcccccacagccacggcaacccccccccccagacccagccccccccccaggtggactacgtgatcccccaccccgtgcacgccttccacagccagatcagcagccacgccaccagccaccccgtggccccccccccccccacccacctggccagcaccgccgcccccatcccccagcacctgccccccacccaccagcccatcagccaccacatccccgccaccgccccccccgcccagagactgcacccccacgaggtgatgcagagaatggaggtgcagagaagaagaatgatgcagcaccccaccggcctgttcgtgttctgcgtgagcagaagagcccacgagagaccccccccccacccccacagaatgcaccccaactacggccacggccaccacatccacgtgccccagaccatgagcagccaccccagacaggcccccgagagaagcgcctgggagctgggcatcgaggccggcgtgaccgccgccacctacacccccggcgccctgcacccccacctggcccactaccacgccccccccagactgcaccacctgcagctgggcgccctgcccctgatggtgcccgacatggccggctacccccacatcagatacatcagcagcggcctggacggcaccagcttcagaggccccttcagaggcaacttcgaggagctgatccacctggaggagagactgggcaacgtgaacagaggcgccagccagggcaccatcgagagatgcacctacccccacaagtacaagaaggtgaccaccgactggttcagccagagaaagctgcactgcaagcaggacggcgaggagggcaccgaggaggacaccgaggagaagtgcaccatctgcctgagcatcctggaggagggcgaggacgtgagaagactgccctgcatgcacctgttccaccaggtgtgcgtggaccagtggctgatcaccaacaagaagtgccccatctgcagagtggacatcgaggcccagctgcccagcgagagctag

SEQ ID NO: 12205 - DNA, 3309 bp, Artificial Sequence
  Description of Artificial Sequence: Synthetic coding sequence
atggccgagaaggaggccagaagaaagttcaagcagatcgtgaccgccgtgtacttctgccactgcagaaacatcgtgcacagagacctgaaggccgagaacctgctgctggacgccaacctgaacatcaagatcgccgacttcggcttcagcaacctgttcacccccggccagctgctgaagacctggtgcggcagccccccctacgccgcccccgagctgttcgagggcaaggagtacgacggccccaaggtggacatctggagcctgggcgtggtgctgtacgtgctggtgtgcggcgccctgcccttcgacggcagcaccctgcagaacctgagagccagagtgctgagcggcaagttcagaatccccttcttcatgagcaccgagtgcgagcacctgatcagacacatgctggtgctggaccccaacaagagactgagcatggagcagatctgcaagcacaagtggatgaagctgggcgacgccgaccccaacttcgacagactgatcgccgagtgccagcagctgaaggaggagagacaggtggaccccctgaacgaggacgtgctgctggccatggaggacatgggcctggacaaggagcagaccctgcagagcctgagaagcgacgcctacgaccactacagcgccatctacagcctgctgtgcgacagacacaagagacacaagaccctgagactgggcgccctgcccagcatgcccagagccctggccttccaggcccccgtgaacatccaggccgagcaggccggcaccgccatgaacatcagcgtgccccaggtgcagctgatcaaccccgagaaccagatcgtggagcccgacggcaccctgaacctggacagcgacgagggcgaggagcccagccccgaggccctggtgagatacctgagcatgagaagacacaccgtgggcgtggccgaccccagaaccgaggtgatggaggacctgcagaagctgctgcccggcttccccggcgtgaacccccaggcccccttcctgcaggtggcccccaacgtgaacttcatgcacaacctgctgcccatgcagaacctgcagcccaccggccagctggagtacaaggagcagagcctgctgcagccccccaccctgcagctgctgaacggcatgggccccctgggcagaagagccagcgacggcggcgccaacatccagctgcacgcccagcagctgctgaagagacccagaggccccagccccctggtgaccatgacccccgccgtgcccgccgtgacccccgtggacgaggagagcagcgacggcgagcccgaccaggaggccgtgcagagcagcacctacaaggacagcaacaccctgcacctgcccaccgagagattcagccccgtgagaagattcagcgacggcgccgccagcatccaggccttcaaggcccacctggagaagatgggcaacaacagcagcatcaagcagctgcagcaggagtgcgagcagctgcagaagatgtacggcggccagatcgacgagagaaccctggagaagacccagcagcagcacatgctgtaccagcaggagcagcaccaccagatcctgcagcagcagatccaggacagcatctgccccccccagcccagcccccccctgcaggccgcctgcgagaaccagcccgccctgctgacccaccagctgcagagactgagaatccagcccagcagccccccccccaaccaccccaacaaccacctgttcagacagcccagcaacagccccccccccatgagcagcgccatgatccagccccacggcgccgccagcagcagccagttccagggcctgcccagcagaagcgccatcttccagcagcagcccgagaactgcagcagcccccccaacgtggccctgacctgcctgggcatgcagcagcccgcccagagccagcaggtgaccatccaggtgcaggagcccgtggacatgctgagcaacatgcccggcaccgccgccggcagcagcggcagaggcatcagcatcagccccagcgccggccagatgcagatgcagcacagaaccaacctgatggccaccctgagctacggccacagacccctgagcaagcagctgagcgccgacagcgccgaggcccacagcgcccaccagcagcccccccactacaccaccagcgccctgcagcaggccctgctgagccccaccccccccgactacaccagacaccagcaggtgccccacatcctgcagggcctgctgagccccagacacagcctgaccggccacagcgacatcagactgccccccaccgagttcgcccagctgatcaagagacagcagcagcagagacagcagcagcagcagcagcagcagcagcaggagtaccaggagctgttcagacacatgaaccagggcgacgccggcagcctggcccccagcctgggcggccagagcatgaccgagagacaggccctgagctaccagaacgccgacagctaccaccaccacaccagcccccagcacctgctgcagatcagagcccaggagtgcgtgagccaggccagcagccccacccccccccacggctacgcccaccagcccgccctgatgcacagcgagagcatggaggaggactgcagctgcgagggcgccaaggacggcttccaggacagcaagagcagcagcaccctgaccaagggctgccacgacagccccctgctgctgagcaccggcggccccggcgaccccgagagcctgctgggcaccgtgagccacgcccaggagctgggcatccacccctacggccaccagcccaccgccgccttcagcaagaacaaggtgcccagcagagagcccgtgatcggcaactgcatggacagaagcagccccggccaggccgtggagctgcccgaccacaacggcctgggctaccccgccagacccagcgtgcacgagcaccacagacccagagccctgcagagacaccacaccatccagaacagcgacgacgcctacgtgcagctggacaacctgcccggcatgagcctggtggccggcaaggccctgagcagcgccagaatgagcgacgccgtgctgagccagagcagcctgatgggcagccagcagttccaggacggcgagaacgaggagtgcggcgccagcctgggcggccacgagcaccccgacctgagcgacggcagccagcacctgaacagcagctgctaccccagcacctgcatcaccgacatcctgctgagctacaagcaccccgaggtgagcttcagcatggagcaggccggcgtgtag

SEQ ID NO: 12206 - DNA, 1461 bp, Artificial Sequence
  Description of Artificial Sequence: Synthetic coding sequence
atgaccctgatggtgctgaccttcagcagctacatcctggacttcatcaacgtgctgagctacgacctgcacggcagctgggagagattcaccggccacaacagccccctgttcagcctgcccgaggaccccaagagcagcgcctacgccatgaactactggagaaagctgggcgcccccagcgagaagctgatcatgggcatccccacctacggcagaaccttcagactgctgaaggccagcaagaacggcctgcaggccagagccatcggccccgccagccccggcaagtacaccaagcaggagggcttcctggcctacttcgagatctgcagcttcgtgtggggcgccaagaagcactggatcgactaccagtacgtgccctacgccaacaagggcaaggagtgggtgggctacgacaacgccatcagcttcagctacaaggcctggttcatcagaagagagcacttcggcggcgccatggtgtggaccctggacatggacgacgtgagaggcaccttctgcggcaccggccccttccccctggtgtacgtgctgaacgacatcctggtgagagccgagttcagcagcaccagcctgccccagttctggctgagcagcgccgtgaacagcagcagcaccgaccccgagagactggccgtgaccaccgcctggaccaccgacagcaagatcctgccccccggcggcgaggccggcgtgaccgagatccacggcaagtgcgagaacatgaccatcacccccagaggcaccaccgtgacccccaccaaggagaccgtgagcctgggcaagcacaccgtggccctgggcgagaagaccgagatcaccggcgccatgaccatgaccagcgtgggccaccagagcatgacccccggcgagaaggccctgacccccgtgggccaccagagcgtgaccaccggccagaagaccctgaccagcgtgggctaccagagcgtgacccccggcgagaagaccctgacccccgtgggccaccagagcgtgacccccgtgagccaccagagcgtgagccccggcggcaccaccatgacccccgtgcacttccagaccgagaccctgagacagaacaccgtggcccccagaagaaaggccgtggccagagagaaggtgaccgtgcccagcagaaacatcagcgtgacccccgagggccagaccatgcccctgagaggcgagaacctgaccagcgaggtgggcacccaccccagaatgggcaacctgggcctgcagatggaggccgagaacagaatgatgctgagcagcagccccgtgatccagctgcccgagcagacccccctggccttcgacaacagattcgtgcccatctacggcaaccacagcagcgtgaacagcgtgaccccccagaccagccccctgagcctgaagaaggagatccccgagaacagcgccgtggacgaggaggcctag

SEQ ID NO: 12207 - DNA, 1017 bp, Artificial Sequence
  Description of Artificial Sequence: Synthetic coding sequence
atggagctgtggggcagaatgctgtgggccctgctgagcggccccggcagaagaggcagcaccagaggctgggccttcagcagctggcagccccagccccccctggccggcctgagcagcgccatcgagctggtgagccactggaccggcgtgttcgagaagagaggcatccccgaggccagagagagcagcgagtacatcgtggcccacgtgctgggcgccaagaccttccagagcctgagacccgccctgtggacccagcccctgaccagccagcagctgcagtgcatcagagagctgagcagcagaagactgcagagaatgcccgtgcagtacatcctgggcgagtgggacttccagggcctgagcctgagaatggtgccccccgtgttcatccccagacccgagaccgaggagctggtggagtgggtgctggaggaggtggcccagagaagccacgccgtgggcagccccggcagccccctgatcctggaggtgggctgcggcagcggcgccatcagcctgagcctgctgagccagctgccccagagcagagtgatcgccgtggacaagagagaggccgccatcagcctgacccacgagaacgcccagagactgagactgcaggacagaatctggatcatccacctggacatgaccagcgagagaagctggacccacctgccctggggccccatggacctgatcgtgagcaaccccccctacgtgttccaccaggacatggagcagctggcccccgagatcagaagctacgaggaccccgccgccctggacggcggcgaggagggcatggacatcatcacccacatcctggccctggcccccagactgctgaaggacagcggcagcatcttcctggaggtggaccccagacaccccgagctggtgagcagctggctgcagagcagacccgacctgtacctgaacctggtggccgtgagaagagacttctgcggcagacccagattcctgcacatcagaagaagcggcccctag

SEQ ID NO: 12208 - DNA, 1899 bp, Artificial Sequence; identical to SEQ ID NO: 9855
  Description of Artificial Sequence: Synthetic coding sequence

SEQ ID NO: 12209 - DNA, 1791 bp, Artificial Sequence
  Description of Artificial Sequence: Synthetic coding sequence
atgagcaaccagcaggagaagtacgaggcccagaacatcgtgaacagcaccgaggagagcgacgacgccttcgacaccgtgaccatccccgtgcccagcgaggagccccaggagagcgaccagaccgaggagcacgagagcggcatcgagcagttcagcgagagccacgccatccacgtggaggagcagagcgaccagagcttcagcagcctggagcccgacaacgagcagctgatggaggaggtgatcagccccagacaggtgagctacaccccccagcaccacgagaagcagtacgccatgcagagacccaacgacgacagcctggccttcctggacaagatcaagagcgtgaaggagagcctgcaggagagcgtggaggacagcctggccaccgtgaaggtggtgctgatccccgtgggccaggagatcgtgatccccttcaaggtggacaccatcctgaagtacctgaaggaccacttcagccacctgctgggcatcccccacagcgtgctgcagatcagatacagcggcaagatcctgaagaacaacgagaccctggtgcagcacggcgtgaagccccaggagatcgtgcaggtggagatcttcagcaccaaccccgacctgtaccccgtgagaagaatcgacggcctgaccgacgtgagccagatcatcaccgtgaccgtgcagaccggcctggaccagtaccagcaggtgcccgtggagatcgtgaagagcgacttccacaagcccttcctgggcggcttcagacacaaggtgaccggcgtggagtaccacaacgccggcacccagaccgtgcccaagagaatccccgagagactgagcatcttctgcagagacacccagaccgtgttccagaagaagaacctgcagcagaccaccaacaccaccagcacccagatgaccaacatcggcgtgtacgtgagcaacatgaccgacaagctggtgacccccggcaagtacttcagcgccgccgagtaccacgcccagagactgaaggccgtgatcgtgatccagacctactacagacagtggcacgccaagatcttcgtggagaacctgagaagacagaagagcctgagactggagtgggagacccagcaggagctgagaaagatcagagagaaggaggagtggatcaagctggactaccacagaagacacaaccccaagaccaacgaggacttcgagttcctgtacaacgccctggagttctggagacaggaggagctgaccagaatcaaccagagcttcaccggcgccgagagaaaggccgccctgtgcgagctgctggagaaggagacccagatcatcgccagcatcggcagacacagatacatcgcctacatggccaaccaggaggccgccatccaggccttcctggacaagtgcagcgcccccaagatctggagaacccccaacggcaagaccatcgagatggacacccagttcaccatcagagccagagagctgcagaacatctacaagtgcatcatgctgaagaacatcagccaggacgagagactggacgtgctgctgaccctgaagcacaccgtgaaggagcacgagtgcaagctgacccaggagatcctggagctgatcgacagagaggtggacctgatgatgagaggcgtgaagcaccacaacctggagggcctgagaaagagaatcgccaccctgttcttccactacatcaagacccccctgttcaaccccgaggtggccaagtacctgaagatgggcggcgagtacctgagcatggccctgtag

SEQ ID NO: 12210 - DNA, 1305 bp, Artificial Sequence
  Description of Artificial Sequence: Synthetic coding sequence
atggtgcaggacggcaccttcaagaccagagacagcacctggacctgcgagagcaccagaatggccgccgccccccccagctactgcttcgtggccttcccccccagagccaaggacggcctggtggtgttcggcaagaacagcgccagacccagagacgaggtgcaggaggtggtgtacttcagcgccgccgaccacgagcccgagagcaaggtggagtgcacctacatcagcatcgaccaggtgcccagaacctacgccatcatgatcagcagacccgcctggctgtggggcgccgagatgggcgccaacgagcacggcgtgtgcatcgccaacgaggccatcaacaccagagagcccgccgccgagatcgaggccctgctgggcatggacctggtgagactgggcctggagagaggcgagaccgccaaggaggccctggacgtgatcgtgagcctgctggaggagcacggccagggcggcaactacttcgaggacgccaacagctgccacagcttccagagcgcctacctgatcgtggacagagacgaggcctgggtgctggagaccatcggcaagtactgggccgccgagaaggtgaccgagggcgtgagatgcatctgcagccagctgagcctgaccaccaagatggacgccgagcaccccgagctgagaagctacgcccagagccagggctggtggaccggcgagggcgagttcaacttcagcgaggtgttcagccccgtggaggaccacctggactgcggcgccggcaaggacagcctggagaagcaggaggagagcatcaccgtgcagaccatgatgaacaccctgagagacaaggccagcggcgtgtgcatcgacagcgagttcttcctgaccaccgccagcggcgtgagcgtgctgccccagaacagaagcagcccctgcatccactacttcaccggcacccccgaccccagcagaagcatcttcaagcccttcatcttcgtggacgacgtgaagctggtgcccaagacccagagcccctgcttcggcgacgacgaccccgccaagaaggagcccagattccaggagaagcccgacagaagacacgagctgtacaaggcccacgagtgggccagagccatcatcgagagcgaccaggagcagggcagaaagctgagaagcaccatgctggagctggagaagcagggcctggaggccatggaggagatcctgaccagcagcgagcccctggaccccgccgaggtgggcgacctgttctacgactgcgtggacaccgagatcaagttcttcaagtag

SEQ ID NO: 12211 - DNA, 1320 bp, Artificial Sequence
  Description of Artificial Sequence: Synthetic coding sequence
atggcctggccctgcatcaccagagcctgctgcatcgccagattctggaaccagctggacaaggccgacatcgccgtgcccctggtgttcaccaagtacagcgaggccaccgagcaccccggcgcccccccccagcccccccccccccagcagcaggcccagcccgccctggccccccccagcgccagagccgtggccatcgagacccagcccgcccagggcgagctggacgccgtggccagagccaccggccccgcccccggccccaccggcgagagagagcccgccgccggccccggcagaagcggccccggccccggcctgggcagcggcagcaccagcggccccgccgacagcgtgatgagacaggactacagagcctggaaggtgcagagacccgagcccagctgcagacccagaagcgagtaccagcccagcgacgcccccttcgagagagagacccagtaccagaaggacttcagagcctggcccctgcccagaagaggcgaccacccctggatccccaagcccgtgcagatcagcgccgccagccaggccagcgcccccatcctgggcgcccccaagagaagaccccagagccaggagagatggcccgtgcaggccgccgccgaggccagagagcaggaggccgcccccggcggcgccggcggcctggccgccggcaaggccagcggcgccgacgagagagacaccagaagaaaggccggccccgcctggatcgtgagaagagccgagggcctgggccacgagcagacccccctgcccgccgcccaggcccaggtgcaggccaccggccccgaggccggcagaggcagagccgccgccgacgccctgaacagacagatcagagaggaggtggccagcgccgtgagcagcagctacagaaacgagttcagagcctggaccgacatcaagcccgtgaagcccatcaaggccaagccccagtacaagccccccgacgacaagatggtgcacgagaccagctacagcgcccagttcaagggcgaggccagcaagcccaccaccgccgacaacaaggtgatcgacagaagaagaatcagaagcctgtacagcgagcccttcaaggagccccccaaggtggagaagcccagcgtgcagagcagcaagcccaagaagaccagcgccagccacaagcccaccagaaaggccaaggacaagcaggccgtgagcggccaggccgccaagaagaagagcgccgagggccccagcaccaccaagcccgacgacaaggagcagagcaaggagatgaacaacaagctggccgaggccaaggagtag

SEQ ID NO: 12212 - DNA, 813 bp, Artificial Sequence
  Description of Artificial Sequence: Synthetic coding sequence
atgggcggctgcttcagcaagcccaagcccgtggagctgaagatcgaggtggtgctgcccgagaaggagagaggcaaggaggagctgagcgccagcggcaagggcagccccagagcctaccagggcaacggcaccgccagacacttccacaccgaggagagactgagcaccccccacccctaccccagcccccaggactgcgtggaggccgccgtgtgccacgtgaaggacctggagaacggccagatgagagaggtggagctgggctggggcaaggtgctgctggtgaaggacaacggcgagttccacgccctgggccacaagtgcccccactacggcgcccccctggtgaagggcgtgctgagcagaggcagagtgagatgcccctggcacggcgcctgcttcaacatcagcaccggcgacctggaggacttccccggcctggacagcctgcacaagttccaggtgaagatcgagaaggagaaggtgtacgtgagagccagcaagcaggccctgcagctgcagagaagaaccaaggtgatggccaagtgcatcagccccagcgccggctacagcagcagcaccaacgtgctgatcgtgggcgccggcgccgccggcctggtgtgcgccgagaccctgagacaggagggcttcagcgacagaatcgtgctgtgcaccctggacagacacctgccctacgacagacccaagctgagcaagagcctggacacccagcccgagcagctggccctgagacccaaggagttcttcagagcctacggcatcgaggtgctgaccgaggcccaggtgtag

SEQ ID NO: 12213 - DNA, 369 bp, Artificial Sequence; identical to SEQ ID NO: 12080
  Description of Artificial Sequence: Synthetic coding sequence

SEQ ID NO: 12214 - DNA, 1269 bp, Artificial Sequence
  Description of Artificial Sequence: Synthetic coding sequence
atgacccccagcatccccagcatcagaagactgggcagcggctacttcagcagcaacggcaagctggaggaggtgaagacccccaagaaccccgtgaagagaaaggacctgctgagacacgaccccgacctgcacatgcaccagggctacgacaagtacgacgtgagcgagttctgcagctacatcaagagcagcagcagcctgggcaacgccaccagcgacgaggaccccaacaccaacatcatgaacatcaacgagaacaagaacatccccaaggccaagaacaagagcgagagcgagaacgagcccaaggccggcaccgacagccccgtgagctgcgccagcgtgaccgaggagagagtggccagcgacagccccaagcccgccctgaccctgcagcagggccaggagttcagcgccggcggccagaacgccgagaacctgtgccagttcttcaagatcagccccgacctgaacatcaagtgcgagagaaaggacgacttcctgggcgccgccgagggcaagctgcagtgcaacagactgatgcccaacagccagaaggactgccactgcctgggcgacgtgctgatcgagaacaccaaggagagcaagagccagagcgaggacctgggcagaaagcccatggagagcagcagcgtggtgagctgcagagacagaaaggacagaagaagaagcatgtgctacagcgacggcagaagcctgcacctggagaagaacggcaaccacacccccagcagcagcgtgggcagcagcgtggagatcagcctggagaacagcgagctgttcaaggacctgagcgacgccatcgagcagaccttccagagaagaaacagcgagaccaaggtgagaagaagcaccagactgcagaaggacctggagaacgagggcctggtgtggatcagcctgcccctgcccagcaccagccagaaggccaagagaagaaccatctgcaccttcgacagcagcggcttcgagagcatgagccccatcaaggagaccgtgagcagcagacagaagccccagatggccccccccgtgagcgaccccgagaacagccagggccccgccgccggcagcagcgacgagcccggcaagagaagaaagagcttctgcatcagcaccctggccaacaccaaggccaccagccagttcaagggctacagaagaagaagcagcctgaacggcaagggcgagagcagcctgaccgccctggagagaatcgagcacaacggcgagagaaagcagtag

SEQ ID NO: 12215 - DNA, 3336 bp, Artificial Sequence
  Description of Artificial Sequence: Synthetic coding sequence
atggtgagagagagaaagtgcatcctgtgccacatcgtgtacagcagcaagaaggagatggacgagcacatgagaagcatgctgcaccacagagagctggagaacctgaagggcagattcggcatcgagatggtgcccctggtgcagaacgagcaggaggccctggacctggacggcgagcccgacctgagcagcctggagggcttccagtgggagggcgtgagcatcagcagcagccccggcctggccagaaagagaagcctgagcgagagcagcgtgatcatggacagagcccccagcgtgtacagcttcttcagcgaggagggcaccggcaaggagaacgagccccagcagatggtgagccccagcaacagcctgagagccggccagagccagaaggccaccatgcacctgaagcaggaggtgacccccagagccgccagcctgagaaccggcgagagagccgagaacgtggccacccagagaagacacagcgcccagctgagcagcgaccacatcatccccctgatgcacctggccaaggacctgaacagccaggagagaagcatcccccccagcgagaaccagaacagccaggagagcaacggcgagggcaactgcctgagcagcagcgccagcagcgccctggccatcagcagcctggccgacgccgccaccgacagcagctgcaccagcggcgccgagcagaacgacggccagagcatcagaaagaagagaagagccaccggcgacggcagcagccccgagctgcccagcctggagagaaagaacaagagaagaaagatcaagggcaagaaggagagaagccaggtggaccagctgctgaacatcagcctgagagaggaggagctgagcaagagcctgcagtgcatggacaacaacctgctgcaggccagagccgccctgcagaccgcctacgtggaggtgcagagactgctgatgctgaagcagcagatcaccatggagatgagcgccctgagaacccacagaatccagatcctgcagggcctgcaggagacctacgagcccagcgagcaccccgaccaggtgccctgcagcctgaccagagagagaagaaacagcagaagccagaccagcatcgacgccgccctgctgcccacccccttcttccccctgttcctggagccccccagcagccacgtgagccccagccccaccggcgccagcctgcagatcaccaccagccccaccttccagacccacggcagcgtgcccgcccccgacagcagcgtgcagatcaagcaggagcccatgagccccgagcaggacgagaacgtgaacgccgtgccccccagcagcgcctgcaacgtgagcaaggagctgctggaggccaacagagagatcagcgacagctgccccgtgtaccccgtgatcaccgccagactgagcctgcccgagagcaccgagagcttccacgagcccagccaggagctgaagttcagcgtggagcagagaaacaccagaaacagagagaacagccccagcagccagagcgccggcctgagcagcatcaacaaggagggcgaggagcccaccaagggcaacagcggcagcgaggcctgcaccagcagcttcctgagactgagcttcgccagcgagacccccctggagaaggagccccacagccccgccgaccagcccgagcagcaggccgagagcaccctgaccagcgccgagaccagaggcagcaagaagaagaagaagctgagaaagaagaagagcctgagagccgcccacgtgcccgagaacagcgacaccgagcaggacgtgctgaccgtgaagcccgtgagaaaggtgaaggccggcaagctgatcaagggcggcaaggtgaccaccagcacctgggaggacagcagaaccggcagagagcaggagagcgtgagagacgagcccgacagcgacagcagcctggaggtgctggagatccccaacccccagctggaggtggtggccatcgacagcagcgagagcggcgaggagaagcccgacagccccagcaagaaggacatctggaacagcaccgagcagaaccccctggagaccagcagaagcggctgcgacgaggtgagcagcaccagcgagatcggcaccagatacaaggacggcatccccgtgagcgtggccgagacccagaccgtgatcagcagcatcaagggcagcaagaacagcagcgagatcagcagcgagcccggcgacgacgacgagcccaccgagggcagcttcgagggccaccaggccgccgtgaacgccatccagatcttcggcaacctgctgtacacctgcagcgccgacaagaccgtgagagtgtacaacctggtgagcagaaagtgcatcggcgtgttcgagggccacaccagcaaggtgaactgcctgctggtgacccagaccagcggcaagaacgccgccctgtacaccggcagcagcgaccacaccatcagatgctacaacgtgaagagcagagagtgcgtggagcagctgcagctggaggacagagtgctgtgcctgcacagcagatggagaatcctgtacgccggcctggccaacggcaccgtggtgaccttcaacatcaagaacaacaagagactggagatcttcgagtgccacggccccagagccgtgagctgcctggccaccgcccaggagggcgccagaaagctgctggtggtgggcagctacgactgcaccatcagcgtgagagacgccagaaacggcctgctgctgagaaccctggagggccacagcaagaccatcctgtgcatgaaggtggtgaacgacctggtgttcagcggcagcagcgaccagagcgtgcacgcccacaacatccacaccggcgagctggtgagaatctacaagggccacaaccacgccgtgaccgtggtgaacatcctgggcaaggtgatggtgaccgcctgcctggacaagttcgtgagagtgtacgagctgcagagccacgacagactgcaggtgtacggcggccacaaggacatgatcatgtgcatgaccatccacaagagcatgatctacaccggctgctacgacggcagcatccaggccgtgagactgaacctgatgcagaactacagatgctggtggcacggctgcagcctgatcttcggcgtggtggaccacctgaagcagcacctgctgaccgaccacaccaaccccaacttccagaccctgaagtgcagatggaagaactgcgacgccttcttcaccgccagaaagggcagcaagcaggacgccgccggccacatcgagagacacgccgaggacgacagcaagatcgacagctag

SEQ ID NO: 12216 - DNA, 354 bp, Artificial Sequence
  Description of Artificial Sequence: Synthetic coding sequence
atgtacagccccatcatctaccaggccctgtgcgagcacgtgcagacccagatgagcctgatgaacgacctgaccagcaagaacatccccaacggcatccccgccgtgccctgccacgcccccagccacagcgagagccaggccaccccccacagcagctacggcctgtgcaccagcacccccgtgtggagcctgcagagacccccctgcccccccaaggtgcacagcgaggtgcagaccgacggcaacagccagttcgccagccagggcaagaccgtgagcgccacctgcaccgacgtgctgagaaacagcttcaacaccagccccggcgtgccctgcagcctgcccaagtag

SEQ ID NO: 12217 - DNA, 189 bp, Artificial Sequence
  Description of Artificial Sequence: Synthetic coding sequence
atggccgccctgagacccctggtgaagcccaagatcgtgaagaagagaaccaagaagttcatcagacaccagagcgacagatacgtgaagatcaagagaaactggagaaagcccagaggcatcgacaacagagtgagaagaagattcaagggccagatcctgatgcccaacatcggctacggcagctag

SEQ ID NO: 12218 - DNA, 411 bp, Artificial Sequence
  Description of Artificial Sequence: Synthetic coding sequence
atgagcgccagctgcgacggctgcgtgggcagcagaccccccgtgcacctggccagcggctacagcctggccgacctgctggtgctggagatgggcatgggcacccagtgctggaccgaggaccagagaagatggagcagcctgtggccctggagccacctgagcagcgtgctgctggccgacaaggagggcggcccccccgccgtggacgaggtgctggacgaggccgtgcccgagtacagagcccccggcagaaagagcctgctggagatcagacagctggaccccgacgacagaagcctggccaagtacaagagagtgctgctgggccccctgccccccgccgtggaccccagcctgcccaacgtgcaggtgaccagactgaccctgctgagcgagcaggccccctag

SEQ ID NO: 12219 - DNA, 1803 bp, Artificial Sequence
  Description of Artificial Sequence: Synthetic coding sequence
atgcccgagatcagagtgacccccctgggcgccggccaggacgtgggcagaagctgcatcctggtgagcatcgccggcaagaacgtgatgctggactgcggcatgcacatgggcttcaacgacgacagaagattccccgacttcagctacatcacccagaacggcagactgaccgacttcctggactgcgtgatcatcagccacttccacctggaccactgcggcgccctgccctacttcagcgagatggtgggctacgacggccccatctacatgacccaccccacccaggccatctgccccatcctgctggaggactacagaaagatcgccgtggacaagaagggcgaggccaacttcttcaccagccagatgatcaaggactgcatgaagaaggtggtggccgtgcacctgcaccagaccgtgcaggtggacgacgagctggagatcaaggcctactacgccggccacgtgctgggcgccgccatgttccagatcaaggtgggcagcgagagcgtggtgtacaccggcgactacaacatgacccccgacagacacctgggcgccgcctggatcgacaagtgcagacccaacctgctgatcaccgagagcacctacgccaccaccatcagagacagcaagagatgcagagagagagacttcctgaagaaggtgcacgagaccgtggagagaggcggcaaggtgctgatccccgtgttcgccctgggcagagcccaggagctgtgcatcctgctggagaccttctgggagagaatgaacctgaaggtgcccatctacttcagcaccggcctgaccgagaaggccaaccactactacaagctgttcatcccctggaccaaccagaagatcagaaagaccttcgtgcagagaaacatgttcgagttcaagcacatcaaggccttcgacagagccttcgccgacaaccccggccccatggtggtgttcgccacccccggcatgctgcacgccggccagagcctgcagatcttcagaaagtgggccggcaacgagaagaacatggtgatcatgcccggctactgcgtgcagggcaccgtgggccacaagatcctgagcggccagagaaagctggagatggagggcagacaggtgctggaggtgaagatgcaggtggagtacatgagcttcagcgcccacgccgacgccaagggcatcatgcagctggtgggccaggccgagcccgagagcgtgctgctggtgcacggcgaggccaagaagatggagttcctgaagcagaagatcgagcaggagctgagagtgaactgctacatgcccgccaacggcgagaccgtgaccctgcccaccagccccagcatccccgtgggcatcagcctgggcctgctgaagagagagatggcccagggcctgctgcccgaggccaagaagcccagactgctgcacggcaccctgatcatgaaggacagcaacttcagactggtgagcagcgagcaggccctgaaggagctgggcctggccgagcaccagctgagattcacctgcagagtgcacctgcacgacaccagaaaggagcaggagaccgccctgagagtgtacagccacctgaagagcgtgctgaaggaccactgcgtgcagcacctgcccgacggcagcgtgaccgtggagagcgtgctgctgcaggccgccgcccccagcgaggaccccggcaccaaggtgctgctggtgagctggacctaccaggacgaggagctgggcagcttcctgaccagcctgctgaagaagggcctgccccaggcccccagctag

SEQ ID NO: 12220 - DNA, 774 bp, Artificial Sequence
  Description of Artificial Sequence: Synthetic coding sequence
atgctggagtacgccctgaagcaggagagagccaagtaccacaagctgaagttcggcaccgacctgaaccagggcgagaagaaggccgacgtgagcgagcaggtgagcaacggccccgtggagagcgtgaccctggagaacagccccctggtgtggaaggagggcagacagctgctgagacagtacctggaggaggtgggctacaccgacaccatcctggacatgagaagcaagagagtgagaagcctgctgggcagaagcctggagctgaacggcgccgtggagcccagcgagggcgcccccagagccccccccggccccgccggcctgagcggcggcgagagcctgctggtgaagcagatcgaggagcagatcaagagaaacgccgccggcaaggacggcaaggagagactgggcggcagcgtgctgggccagatccccttcctgcagaactgcgaggacgaggacagcgacgaggacgacgagctggacagcgtgcagcacaagaagcagagagtgaagctgcccagcaaggccctggtgcccgagatggaggacgaggacgaggaggacgacagcgaggacgccatcaacgagttcgacttcctgggcagcggcgaggacggcgagggcgcccccgaccccagaagatgcaccgtggacggcagcccccacgagctgggccccgagctgcacagccccaccgagtggcagggcgccctgagcgtgggcaaggccagccccatgcccgactgggtgggcaccgccggctag

SEQ ID NO: 12221 - DNA, 381 bp, Artificial Sequence
  Description of Artificial Sequence: Synthetic coding sequence
atgcccggcgtgaagctgaccacccaggcctactgcaagatggtgctgcacggcgccaagtacccccactgcgccgtgaacggcctgctggtggccgagaagcagaagcccagaaaggagcacctgcccctgggcggccccggcgcccaccacaccctgttcgtggactgcatccccctgttccacggcaccctggccctggcccccatgctggaggtggccctgaccctgatcgacagctggtgcaaggaccacagctacgtgatcgccggctactaccaggccaacgagagagtgaaggacgccagccccaaccaggtggccgagaaggtggccagcagaatcgccgagggcttcagcgacaccgccctgatcatgtag

SEQ ID NO: 12222 - DNA, 450 bp, Artificial Sequence
  Description of Artificial Sequence: Synthetic coding sequence
gtgagagagctggaggccgagctggacgccgagcagaagaagcacgccgaggccctgaagggcgtgagaaagcacgagagaagagtgaaggagctggcctaccaggtgggcgacagagtgagcctgggcagcggccccggcgccggccccgcccaggccagccccgagagccccctgcccgcccaggccgaggaggacagaaagaacctggccagaatgcaggacctggtggacaagctgcagagcaaggtgaagagctacaagagacagttcgaggaggccgagcagcaggccaacaccaacctggccaagtacagaaaggcccagcacgagctggacgacgccgaggagagagccgacatggccgagacccaggccaacaagctgagagccagaaccagagacgccctgggccccaagctgagcctgagcccccagcacaaggagtag

SEQ ID NO: 12223 - DNA, 2349 bp, Artificial Sequence; identical to SEQ ID NO: 9570
  Description of Artificial Sequence: Synthetic coding sequence

SEQ ID NO: 12224 - DNA, 495 bp, Artificial Sequence
  Description of Artificial Sequence: Synthetic coding sequence
atgatgagcgaggtggaggaggccatgcagtgcgtggaggagctgaacgcccagggcctgctgcacgtgttcgtgagagtgggcgtggagagcaccctggagagaagccagatcaccagagaccacatgggccagctgctgtaccagctggtgcagagcgagaagctgagcaagcaggacttcttcaagggcttcagcgagaccctggagctggccgacgacatggccatcgacatcccccacatctggctgtacctggccgagctggtgacccccatgctgaaggagggcggcatcagcatgagagagctgaccatcgagttcagcaagcccctgctgcccgtgggcagagccggcgtgctgctgagcgagatcctgcacctgctgtgcaagcagatgagccacaagaaggtgggcgccctgtggagagaggccgacctgagctggaaggacttcctgcccgagggcgaggacgtgcacaacttcctgctgtag

SEQ ID NO: 12225 - DNA, 369 bp, Artificial Sequence; identical to SEQ ID NO: 12080
  Description of Artificial Sequence: Synthetic coding sequence

SEQ ID NO: 12226 - DNA, 3345 bp, Artificial Sequence
  Description of Artificial Sequence: Synthetic coding sequence
atggcctgcagaagaagatacttcgtggagggcgaggcccccagcagcgagaccggcaccagcctggacagccccagcgcctacccccagggccccctggtgcccggcagcagcctgagccccgaccactacgagcacaccagcgtgggcgcctacggcctgtacagcggcccccccggccagcagcagagaaccagaagacccaagctgcagcacagcaccagcatcctgagaaagcaggccgaggaggaggccatcaagagaagcagaagcctgagcgagagctacgagctgagcagcgacctgcaggacaagcaggtggagatgctggagagaaagtacggcggcagactggtgaccagacacgccgccagaaccatccagaccgccttcagacagtaccagatgaacaagaacttcgagagactgagaagcagcatgagcgagaacagaatgagcagaagaatcgtgctgagcaacatgagaatgcagttcagcttcgagggccccgagaaggtgcacagcagctacttcgagggcaagcaggtgagcgtgaccaacgacggcagccagctgggcgccctggtgagccccgagtgcggcgacctgagcgagcccaccaccctgaagagccccgcccccagcagcgacttcgccgacgccatcaccgagctggaggacgccttcagcagacaggtgaagagcctggccgagagcatcgacgacgccctgaactgcagaagcctgcacaccgaggaggcccccgccctggacgccgccagagccagagacaccgagccccagaccgccctgcacggcatggaccacagaaagctggacgagatgaccgccagctacagcgacgtgaccctgtacatcgacgaggaggagctgagcccccccctgcccctgagccaggccggcgacagacccagcagcaccgagagcgacctgagactgagagccggcggcgccgcccccgactactgggccctggcccacaaggaggacaaggccgacaccgacaccagctgcagaagcacccccagcctggagagacaggagcagagactgagagtggagcacctgcccctgctgaccatcgagccccccagcgacagcagcgtggacctgagcgacagaagcgagagaggcagcctgaagagacagagcgcctacgagagaagcctgggcggccagcagggcagccccaagcacggcccccacagcggcgcccccaagagcctgcccagagaggagcccgagctgagacccagaccccccagacccctggacagccacctggccatcaacggcagcgccaacagacagagcaagagcgagagcgactacagcgacggcgacaacgacagcatcaacagcaccagcaacagcaacgacaccatcaactgcagcagcgagagcagcagcagagacagcctgagagagcagaccctgagcaagcagacctaccacaaggaggccagaaacagctgggacagccccgccttcagcaacgacgtgatcagaaagagacactacagaatcggcctgaacctgttcaacaagaagcccgagaagggcgtgcagtacctgatcgagagaggcttcgtgcccgacacccccgtgggcgtggcccacttcctgctgcagagaaagggcctgagcagacagatgatcggcgagttcctgggcaacagacagaagcagttcaacagagacgtgctggactgcgtggtggacgagatggacttcagcaccatggagctggacgaggccctgagaaagttccaggcccacatcagagtgcagggcgaggcccagaaggtggagagactgatcgaggccttcagccagagatactgcatctgcaaccccggcgtggtgagacagttcagaaaccccgacaccatcttcatcctggccttcgccatcatcctgctgaacaccgacatgtacagccccaacgtgaagcccgagagaaagatgaagctggaggacttcatcaagaacctgagaggcgtggacgacggcgaggacatccccagagagatgctgatgggcatctacgagagaatcagaaagagagagctgaagaccaacgaggaccacgtgagccaggtgcagaaggtggagaagctgatcgtgggcaagaagcccatcggcagcctgcaccccggcctgggctgcgtgctgagcctgccccacagaagactggtgtgctactgcagactgttcgaggtgcccgaccccaacaagccccagaagctgggcctgcaccagagagagatcttcctgttcaacgacctgctggtggtgaccaagatcttccagaagaagaagaacagcgtgacctacagcttcagacagagcttcagcctgtacggcatgcaggtgctgctgttcgagaaccagtactaccccaacggcatcagactgaccagcagcgtgcccggcgccgacatcaaggtgctgatcaacttcaacgcccccaacccccaggacagaaagaagttcaccgacgacctgagagagagcatcgccgaggtgcaggagatggagaagcacagaatcgagagcgagctggagaagcagaagggcgtggtgagacccagcatgagccagtgcagcagcctgaagaaggagagcggcaacggcaccctgagcagagcctgcctggacgacagctacgccagcggcgagggcctgaagagaagcgccctgagcagcagcctgagagacctgagcgaggccggcaagagaggcagaagaagcagcgccggcagcctggagagcaacgtggagggcagcatcatcagcagcccccacatgagaagaagagccaccagcaccagagagtgccccagcagaccccaccagaccatgcccaacagcagcagcctgctgggcagcctgttcggcagcaagagaggcaagccccccccccaggcccacctgcccagcgcccccgccctgccccccccccacccccccgtggtgctgccccacctgcagcacagcgtggccggccaccacctgggcccccccgagggcctgccccaggccgccatgcacggccaccacacccagtactgccacatgcagaacccccccccctaccaccaccaccaccaccaccaccccccccagcacatccagcacgcccaccagtaccaccacggcccccacggcggccaccccgcctacggcgcccacgcccacggccacccccccctgcccagcgcccacgtgggccacaccgtgcaccaccacggccagccccccgccccccccccccccaccagcagcaaggccaagcccagcggcatcagcaccatcgtgtag

SEQ ID NO: 12227 - DNA, 903 bp, Artificial Sequence
  Description of Artificial Sequence: Synthetic coding sequence
atggccgaggaggtgagcaccctgatgaaggccaccgtgctgatgagacagcccggcagagtgcaggagatcgtgggcgccctgagaaagggcggcggcgacagactgcaggtgatcagcgacttcgacatgaccctgagcagattcgcctacaacggcaagagatgccccagcagctacaacatcctggacaacagcaagatcatcagcgaggagtgcagaaaggagctgaccgccctgctgcaccactactaccccatcgagatcgacccccacagaaccgtgaaggagaagctgccccacatggtggagtggtggaccaaggcccacaacctgctgtgccagcagaagatccagaagttccagatcgcccaggtggtgagagagagcaacgccatgctgagagagggctacaagaccttcttcaacaccctgtaccacaacaacatccccctgttcatcttcagcgccggcatcggcgacatcctggaggagatcatcagacagatgaaggtgttccaccccaacatccacatcgtgagcaactacatggacttcaacgaggacggcttcctgcagggcttcaagggccagctgatccacacctacaacaagaacagcagcgcctgcgagaacagcggctacttccagcagctggagggcaagaccaacgtgatcctgctgggcgacagcatcggcgacctgaccatggccgacggcgtgcccggcgtgcagaacatcctgaagatcggcttcctgaacgacaaggtggaggagagaagagagagatacatggacagctacgacatcgtgctggagaaggacgagaccctggacgtggtgaacggcctgctgcagcacatcctgtgccagggcgtgcagctggagatgcagggcccctag

SEQ ID NO: 12228 - DNA, 834 bp, Artificial Sequence
  Description of Artificial Sequence: Synthetic coding sequence
atgttccccggcgccaccacccccctgcccaaggccgccgcctaccccggcgtgtacggcagcaacggcagaaccccccagcccgcctacctgagcgaggccatgaagctgacccagagcgagcaggcccacctgagcctggagctgcagagagacagccacatgaagcagctgctgctgatccaggagagatggaagagagcccagagagaggagagactgaaggcccagcagaacaccgacaaggacgccgccgcccacctgcagaccagccacaagcccagcgccgaggacgccgagggccagagccccctgagccagaagtacagccccagcaccgagaagtgcctgcccgagatccagggcatcttcgacagagaccccgacaccctgctgtacctgctgcagcagaagagcgagcccgccgagccctgcatcggcagcaaggcccccaaggacgacaagaccatcatcgaggagcaggccaccaagatcgccgacctgaagagacacgtggagttcctggtggccgagaacgagagactgagaaaggagaacaagcagctgaaggccgagaaggccagactgctgaagggccccatcgagaaggagctggacgtggacgccgacttcgtggagaccagcgagctgtggagcctgcccccccacgccgagaccgccaccgccagcagcacctggcagaagttcgccgccaacaccggcaaggccaaggacatccccatccccaacctgccccccctggacttccccagccccgagctgcccctgatggagctgagcgaggacatcctgaagggcttcatgaacaactag

SEQ ID NO: 12229 - DNA, 138 bp, Artificial Sequence
  Description of Artificial Sequence: Synthetic coding sequence
atgagcccccagaagagagtgaagaacgtgcaggcccagaacagaaccagccagggcagcagcagcttccagaccaccctgagcgcctggaaggtgaagcaggaccccagcaacagcaagaacatcagcaagcactag

SEQ ID NO: 12230 - DNA, 819 bp, Artificial Sequence
  Description of Artificial Sequence: Synthetic coding sequence
atgcccggcgaccacagaagaatcagaggccccgaggagagccagcccccccagctgtacgccgccgacgaggaggaggcccccggcaccagagaccccaccagactgagacccgtgtacgccagagccggcctgctgagccaggccaagggcagcgcctacctggaggccggcggcaccaaggtgctgtgcgccgtgagcggccccagacaggccgagggcggcgagagaggcggcggccccgccggcgccggcggcgaggcccccgccgccctgagaggcagactgctgtgcgacttcagaagagcccccttcgccggcagaagaagaagagccccccccggcggctgcgaggagagagagctggccctggccctgcaggaggccctggagcccgccgtgagactgggcagataccccagagcccagctggaggtgagcgccctgctgctggaggacggcggcagcgccctggccgccgccctgaccgccgccgccctggccctggccgacgccggcgtggagatgtacgacctggtggtgggctgcggcctgagcctggcccccggccccgcccccacctggctgctggaccccaccagactggaggaggagagagccgccgccggcctgaccgtggccctgatgcccgtgctgaaccaggtggccggcctgctgggcagcggcgagggcggcctgaccgagagctgggccgaggccgtgagactgggcctggagggctgccagagactgtaccccgtgctgcagcagagcctggtgagagccgccagaagaagaggcgccgccgcccagccctag

SEQ ID NO: 12231 - DNA, 429 bp, Artificial Sequence
  Description of Artificial Sequence: Synthetic coding sequence
atggccagcggcaacgccagaatcggcaagcccgcccccgacttcaaggccaccgccgtggtggacggcgccttcaaggaggtgaagctgagcgactacaagggcaagtacgtggtgctgttcttctaccccctggacttcaccttcgtgtgccccaccgagatcatcgccttcagcaacagagccgaggacttcagaaagctgggctgcgaggtgctgggcgtgagcgtggacagccagttcacccacctggcctggtacgagcagggccccaagagagaggtggccgccaagctgacccccagcggccccagcagcgtggccagctggcccctgctgaacctgtggaacctgagattccccatcgtgaagatcatggagaccctgccccccaagagcctgagaatgatgaccgtgatcagcatctag

SEQ ID NO: 12232 - DNA, 1137 bp, Artificial Sequence; identical to SEQ ID NO: 11303
  Description of Artificial Sequence: Synthetic coding sequence

SEQ ID NO: 12233 - DNA, 324 bp, Artificial Sequence
  Description of Artificial Sequence: Synthetic coding sequence
tgaatccacgagcagtgggagaaggccaacgtgagcagcccccacagagagttcccccccgccaccgccagagaggtggaccccctgagaatccccccccaccacccccacaccagcagacagcccccctggcccagaagaggcggcatgatcgtggaccccctgagaagcggcttccccagagccctgatcgaccccagcagcggcctgcccaacagactgccccccggcgccgtgccccccggcgccagattcgaccccttcggccccatcggcaccagcccccccggccccaaccccgaccacctgcccccccccggctag

SEQ ID NO: 12234 - DNA, 201 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagtag

SEQ ID NO: 12235 - DNA, 2115 bp, Artificial Sequence
  Description of Artificial Sequence: Synthetic coding sequence
atgctgcccaccgccagcagcaagagaagaaccttcgccgccagatacttcaccagaagcaagagcctggtgatgggcgagcagagcagaagccccggcagaatgccctgcccccacagactgggccccgtgctgaaggccggctggctgaagaagcagagaagcatcatgaagaactggcagcagagatggttcgtgctgagaggcgaccagctgttctactacaaggacaaggacgagatcaagccccagggcttcatcagcctgcagggcacccaggtgaccgagctgccccccggccccgaggaccccggcaagcacctgttcgagatcagccccggcggcgccggcgagagagagaaggtgcccgccaaccccgaggccctgctgctgatggccagcagccagagagacatggaggactgggtgcaggccatcagaagagtgatctgggcccccctgggcggcggcatcttcggccagagactggaggagaccgtgcaccacgagagaaagtacggccccagactggcccccctgctggtggagcagtgcgtggacttcatcagagagagaggcctgaccgaggagggcctgttcagaatgcccggccaggccaacctggtgagagacctgcaggacagcttcgactgcggcgagaagcccctgttcgacagcaccaccgacgtgcacaccgtggccagcctgctgaagctgtacctgagagagctgcccgagcccgtggtgcccttcgccagatacgaggacttcctgagctgcgcccagctgctgaccaaggacgagggcgagggcaccctggagctggccaagcaggtgagcaacctgccccaggccaactacaacctgctgagatacatctgcaagttcctggacgaggtgcaggcctacagcaacgtgaacaagatgagcgtgcagaacctggccaccgtgttcggccccaacatcctgagaccccaggtggaggaccccgtgaccatcatggagggcaccagcctggtgcagcacctgatgaccgtgctgatcagaaagcacagccagctgttcaccgcccccgtgcccgagggccccaccagccccagaggcggcctgcagtgcgccgtgggctggggcagcgaggaggtgaccagagacagccagggcgagcccggcggccccggcctgcccgcccacagaaccagcagcctggacggcgccgccgtggccgtgctgagcagaaccgcccccaccggccccggcagcagatgcagccccggcaagaaggtgcagaccctgcccagctggaagagcagcttcagacagcccagaagcctgagcggcagccccaagggcggcggcagcagcctggaggtgcccatcatcagcagcggcggcaactggctgatgaacggcctgagcagcctgagaggccacagaagagccagcagcggcgacagactgaaggacagcggcagcgtgcagagactgagcacctacgacaacgtgcccgcccccggcctggtgcccggcatccccagcgtggccagcatggcctggagcggcgccagcagcagcgagagcagcgtgggcggcagcctgagcagctgcaccgcctgcagagccagcgacagcagcgccagaagcagcctgcacaccgactgggccctggagcccagccccctgcccagcagcagcgaggaccccaagagcctggacctggaccacagcatggacgaggccggcgccggcgccagcaacagcgagcccagcgagcccgacagccccaccagagagcacgccagaagaagcgaggccctgcagggcctggtgaccgagctgagagccgagctgtgcagacagagaaccgagtacgagagaagcgtgaagagaatcgaggagggcagcgccgacctgagaaagagaatgagcagactggaggaggagctggaccaggagaagaagaagtacatcatgctggagatcaagctgagaaacagcgagagagccagagaggacgccgagagaagaaaccagctgctgcagagagagatggaggagttcttcagcaccctgggcagcctgaccgtgggcgccaagggcgccagagcccccaagtag

SEQ ID NO: 12236 - DNA, 630 bp, Artificial Sequence
  Description of Artificial Sequence: Synthetic coding sequence
atgatcagcaactacagaaacggcagcgagctggtgtgcttcaacagcggcgtgggctgcttcctgatcggctgcgactgggccttcaccgtgctggtgaacaccttcttcagcttcctgagaagaaagaccgacttcttcatcggcggcgaggagggcatggccgagaagctgatcacccagaccttcagccaccacaaccagctggcccagaagaccagaagagagaagagagccagacaggaggccgagagaagagagaaggccgagagagccgccagactggccaaggaggccaagagcgagaccagcggcccccagatcaaggagctgaccgacgaggaggccgagagactgcagctggagatcgaccagaagaaggacgccgagaaccacgaggcccagctgaagaacggcagcctggacagccccggcaagcaggacaccgaggaggacgaggaggaggacgagaaggacaagggcaagctgaagcccaacctgggcaacggcgccgacctgcccaactacagatggacccagaccctgagcgagctggacctggccgtgcccttctgcgtgaacttcagactgaagggcaaggacatggtggtggacatccagagaagatag

SEQ ID NO: 12237 - DNA, 309 bp, Artificial Sequence; identical to SEQ ID NO: 11999
  Description of Artificial Sequence: Synthetic coding sequence

SEQ ID NO: 12238 - DNA, 273 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagcatccccctgggccaggccgaccccagcctggccccctacatcatcgacctgcccagctggacccagttcagacaggacaccggctag

SEQ ID NO: 12239 - DNA, 207 bp, Artificial Sequence
  Description of Artificial Sequence: Synthetic coding sequence
atggacgccaacagcaaggacaagccccccgagaccaaggagagcgccatgaacaacgccggcaacgccagcttcatcctgggcaccggcaagatcgtgaccccccagaagcacgccgagctgccccccaacccctgcacccccgacaccttcaagagccccctgaacttcagcaccgtgaccgtggagcagctgggcatcaactag

SEQ ID NO: 12240 - DNA, 879 bp, Artificial Sequence
  Description of Artificial Sequence: Synthetic coding sequence
atggacggcagcttcgtgcagcacagcgtgagagtgctgcaggagctgaacaagcagagagagaagggccagtactgcgacgccaccctggacgtgggcggcctggtgttcaaggcccactggagcgtgctggcctgctgcagccacttcttccagagcctgtacggcgacggcagcggcggcagcgtggtgctgcccgccggcttcgccgagatcttcggcctgctgctggacttcttctacaccggccacctggccctgaccagcggcaacagagaccaggtgctgctggccgccagagagctgagagtgcccgaggccgtggagctgtgccagagcttcaagcccaagaccagcgtgggccaggccgccggcggccagagcggcctgggcccccccgccagccagaacgtgaacagccacgtgaaggagcccgccggcctggaggaggaggaggtgagcagaaccctgggcctggtgcccagagaccaggagcccagaggcagccacagcccccagagaccccagctgcacagccccgcccagagcgagggccccagcagcctgtgcggcaagctgaagcaggccctgaagccctgccccctggaggacaagaagcccgaggactgcaaggtgccccccagacccctggaggccgagggcgcccagctgcagggcggcagcaacgagtgggaggtggtggtgcaggtggaggacgacggcgacggcgactacatgagcgagcccgaggccgtgctgaccagaagaaagagcaacgtgatcagaaagccctgcgccgccgagcccgccctgagcgccggcagcctggccgccgagcccgccgagaacagaaagggcaccgccgtgcccgtggagtag

SEQ ID NO: 12241 - DNA, 408 bp, Artificial Sequence; identical to SEQ ID NO: 11485
  Description of Artificial Sequence: Synthetic coding sequence

SEQ ID NO: 12242 - DNA, 810 bp, Artificial Sequence
  Description of Artificial Sequence: Synthetic coding sequence
atgaagacccccgtggagctggccgtgagcggcatgcagaccctgggcctgcagcacagatgcagaggcggctacagagtgaaggccagaaccagctacgtggacgagaccctgttcggcagccccgccggcaccagacccaccccccccgacttcgaccccccctgggtggagaaggccaacagaaccagaggcgtgggcaaggaggccagcaaggccctgggcgccaagggcagctgcgagaccacccccagcagaggcagcacccccaccctgacccccagaaagaagaacaagtacagacccatcagccacacccccagctactgcgacgagagcctgttcggcagcagaagcgagggcgccagcttcggcgcccccagaatggccaagggcgacgccgccaagctgagagccctgctgtggacccccccccccacccccagaggcagccacagccccagacccagagaggcccccctgagagccatccaccccgccggccccagcaagaccgagcccggccccgccgccgacagccagaagctgagcatgggcggcctgcacagcagcagacccctgaagagaggcctgagccacagcctgacccacctgaacgtgcccagcaccggccaccccgccaccagcgccccccacaccaacggcccccaggacctgagacccagcaccagcggcgtgaccttcagaagccccctggtgaccagcagagccagaagcgtgagcatcagcgtgcccagcacccccagaagaggcggcgccacccagaagcccaagcccccctggaagtag

SEQ ID NO: 12243 - DNA, 840 bp, Artificial Sequence
  Description of Artificial Sequence: Synthetic coding sequence
atggtggaccacctggccaacaccgagatcaacagccagagaatcgccgccgtggagagctgcttcggcgccagcggccagcccctggccctgcccggcagagtgctgctgggcgagggcgtgctgaccaaggagtgcagaaagaaggccaagcccagaatcttcttcctgttcaacgacatcctggtgtacggcagcatcgtgctgaacaagagaaagtacagaagccagcacatcatccccctggaggaggtgaccctggagctgctgcccgagaccctgcaggccaagaacagatggatgatcaagaccgccaagaagagcttcgtggtgagcgccgccagcgccaccgagagacaggagtggatcagccacatcgaggagtgcgtgagaagacagctgagagccaccggcagaccccccagcaccgagcacgccgccccctggatccccgacaaggccaccgacatctgcatgagatgcacccagaccagattcagcgccctgaccagaagacaccactgcagaaagtgcggcttcgtggtgtgcgccgagtgcagcagacagagattcctgctgcccagactgagccccaagcccgtgagagtgtgcagcctgtgctacagagagctggccgcccagcagagacaggaggaggccgaggagcagggcgccggcagccccggccagcccgcccacctggccagacccatctgcggcgccagcagcggcgacgacgacgacagcgacgaggacaaggagggcagcagagacggcgactggcccagcagcgtggagttctacgccagcggcgtggcctggagcgccttccacagctag

SEQ ID NO: 12244 - DNA, 279 bp, Artificial Sequence
  Description of Artificial Sequence: Synthetic coding sequence
tgaagaagcagcaccagcccctgcggcaccagcaagagccccaacagagagtgggagggcaagagcgtggcctacatgccctacgccgaggtgaagagagccctggagcaggaggcccagatgcacaacaccgccgccagaagcgccagcccctgcagactgagccccagagaggtgagcaaggccgccccccagcccgacatgagcgccgccagatacagcgtgccccccgtgctgcagcccgccccccaccaggtgatcaccaacctgcccgagtag

SEQ ID NO: 12245 - DNA, 771 bp, Artificial Sequence
  Description of Artificial Sequence: Synthetic coding sequence
atgagcaacaacctgagcgagctggacaccaagatccaggagaaggccatgaaggtggacatggacatctgcagaagaatcgacatcaccgccaagctgtgcgacgtggcccagcagagaaactgcgaggacatgatccagatgttccagaagaagctggtgcccagcatgggcggcagaaagagagagagaaaggccgccgtggaggaggacaccagcctgagcgagagcgagggccccagacagcccgacggcgacgaggaggagagcaccgccctgagcatcaacgaggagatgcagagaatgctgaaccagctgagagagtacgacttcgaggacgactgcgacagcctgacctgggaggagaccgaggagaccctgctgctgtgggaggacttcagcggctacgccatggccgccgccgaggcccagggcgagcagcaggaggacagcctggagaaggtgatcaaggacaccgagagcctgttcaagaccagagagaaggagtaccaggagaccatcgaccagatcgagctggagctggccaccgccaagaacgacatgaacagacacctgcacgagtacatggagatgtgcagcatgaagagaggcctggacgtgcagatggagacctgcagaagactgatcacccagagcggcgacagaaagagccccgccttcaccgccgtgcccctgagcgaccccccccccccccccagcgaggccgaggacagcgacagagacgtgagcagcgacagcagcatgagatag

SEQ ID NO: 12246 - DNA, 1620 bp, Artificial Sequence; identical to SEQ ID NO: 10018
  Description of Artificial Sequence: Synthetic coding sequence

SEQ ID NO: 12247 - DNA, 750 bp, Artificial Sequence
  Description of Artificial Sequence: Synthetic coding sequence
atggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagcccggcgacagcctggccccccccgaggtggacttcgacagactgctggccagcctgcaggacctgagcgagctggtggtggagggcgacacccaggtgacccccgtgcccggcggcgccagactgagaaccctggagcccatccccctgaagctgtacagaaacggcatcatgatgttcgacggccccttccagcccttctacgaccccagcacccagagatgcctgagagacatcctggacggcttcttccccagcgagctgcagagactgtaccccaacggcgtgcccttcaaggtgatcagctgcagcagcaaccacaccttcggcgacttcgagggcagcggcgacacccagcccccccagaccccccccatcctgagaggcagcagatgcaccccctggggcacccccgtgtag

SEQ ID NO: 12248 - DNA, 2763 bp, Artificial Sequence
  Description of Artificial Sequence: Synthetic coding sequence
atgagcgaggacagcgagaaggaggactacagcgacagaaccatcagcgacgaggacgagagcgacgaggacatgttcatgaagttcgtgagcgaggacctgcacagatgcgccctgctgaccgccgacagcttcggcgaccccttcttccccagaaccacccagatcctgctggagtaccagctgggcagatgggtgcccagactgagagagcccagagacctgtacggcgtgagcagcagcggccccctgagccccaccagatggccctaccactgcgaggtgatcgacgagaaggtgcagcacatcgactggacccccagctgccccgagcccgtgtacatccccaccggcctggagaccgagcccctgtaccccgacagcaaggaggccaccgtggtgtacctggccgaggacgcctacaaggagccctgcttcgtgtacagcagagtgggcggcaacagaacccccctgaagcagcccgtggactacagagacaacaccctgatgttcgaggccagattcgagagcggcaacctgcagaaggtggtgaaggtggccgagtacgagtaccagctgaccgtgagacccgacctgttcaccaacaagcacacccagtggtactacttccaggtgaccaacatgagagccggcatcgtgtacagattcaccatcgtgaacttcaccaagcccgccagcctgtacagcagaggcatgagacccctgttctacagcgagaaggaggccaaggcccaccacatcggctggcagagaatcggcgaccagatcaagtactacagaaacaaccccggccaggacggcagacactacttcagcctgacctggaccttccagttcccccacaacaaggacacctgctacttcgcccactgctacccctacacctacaccaacctgcaggagtacctgagcggcatcaacaacgaccccgtgagaagcaagttctgcaagatcagagtgctgtgccacaccctggccagaaacatggtgtacatcctgaccatcaccacccccctgaagaacagcgacagcagaaagagaaaggccgtgatcctgaccgccagagtgcaccccggcgagaccaacagcagctggatcatgaagggcttcctggactacatcctgggcaacagcagcgacgcccagctgctgagagacaccttcgtgttcaaggtggtgcccatgctgaaccccgacggcgtgatcgtgggcaactacagatgcagcctggccggcagagacctgaacagaaactacaccagcctgctgaaggagagcttccccagcgtgtggtacaccagaaacatggtgcacagactgatggagaagagagaggtgatcctgtactgcgacctgcacggccacagcagaaaggagaacatcttcatgtacggctgcgacggcagcgacagaagcaagaccctgtacctgcagcagagaatcttccccctgatgctgagcaagaactgccccgacaagttcagcttcagcgcctgcaagttcaacgtgcagaagagcaaggagggcaccggcagagtggtgatgtggaagatgggcatcagaaacagcttcaccatggaggccaccttctgcggcagcaccctgggcaacaagagaggcacccacttcagcaccaaggacctggagagcatgggctaccacttctgcgacagcctgctggactactgcgaccccgacagaaccaagtactacagatgcctgaaggagctggaggagatggagagacacatcaccctggagaaggtgttcgaggacagcgacacccccgtgatcgacatcaccctggacgtggagagcagcagcagaggcagcgacagcagcgagagcatcgacagcctgacctacctgctgaagctgaccagccagaagaagcacctgaagaccaagaaggagagaaacagcaccatcgccagccaccagaacgccagaggccaggaggtgtacgacagaggccacctgctgcagagacacacccagagcaacagcgacgtgaaggacaccagacccaacgagcccgacgactacatggtggactacttcagaagacagctgcccaaccagggcctggacctgcaccacaacctgaagagcaagatcaaggagtgcatcagcttccagagcaagaagaccggcatcaactggaccgacgacgagaagagaagctacaaggacaagggcatcgtgcagacccaggagatcctgcagtacctgctgcccatcgtgcacagcaccaagaacatgcagaccacccagatcaagcagctgttcaaccccagaaccaacttccagatccagcaccagctgaaccccgccacctgcagaaacatcaagaagtacagcaccagctggaccgcccccagaaaccaccccttcgtgatccagggcgacgtgatggccaacagcagcgagtgggtgcagagcaagccccacagaagcctggagagcctgagccccctgaagggccccaagaagaacaagcacagccagatctgggccatcaagaacgaggacatcaagcccctgagcagcaagtgggagaccgccagcagcagcttcggcatggacgccaacgtgctgaagtacaagagcctgcaggccgaggagaccaaccagcagagcagcaagcacaccgccctgcacctgaccaagaacaaggacgagcaggccaacaagaacgacggccagcccaccctgtacctgaagttccagagagagagctag

SEQ ID NO: 12249 - DNA, 858 bp, Artificial Sequence
  Description of Artificial Sequence: Synthetic coding sequence
atgaccaacgcccagatcatcctgctgatcgacaacgccagaatggccgtggacgacttcaacctgaagtacgagaacgagcacagcttcaagaaggacctggagatcgaggtggagggcctgagaagaaccctggacaacctgaccatcgtgaccaccgacctggagcaggaggtggagggcatgagaaaggagctgatcctgatgaagaagcaccacgagcaggagatggagaagcaccacgtgcccagcgacttcaacgtgaacgtgaaggtggacaccggccccagagaggacctgatcaaggtgctggaggacatgagacaggagtacgagctgatcatcaagaagaagcacagagacctggacacctggtacaaggagcagagcgccgccatgagccaggaggccgccagccccgccaccgtgcagagcagacagggcgacatccacgagctgaagagaaccttccaggccctggagatcgacctgcagacccagtacagcaccaagagcgccctggagaacatgctgagcgagacccagagcagatacagctgcaagctgcaggacatgcaggagatcatcagccactacgaggaggagctgacccagctgagacacgagctggagagacagaacaacgagtaccaggtgctgctgggcatcaagacccacctggagaaggagatcaccacctacagaagactgctggagggcgagagcgagggcaccagagaggagagcaagagcagcatgaaggtgagcgccacccccaagatcaaggccatcacccaggagaccatcaacggcagactggtgctgtgccaggtgaacgagatccagaagcacgcctag

SEQ ID NO: 12250 - DNA, 2013 bp, Artificial Sequence
  Description of Artificial Sequence: Synthetic coding sequence
atgagcccctgcagcggcggcagaggcgagctgagagccgcctgcctgcagcccgaggtgcccggcgcccccggcctgagctggtggcccagcaccgccggcctgagacagagccagaccgacctgcagctgagcctgagcatctggtgcggcaagaagatgggcagctacctgagcgtgcccgcctacttcaccagcagagacctgttcagatgcagcgagtgccaggacagcctgaccaactggtactacgagaaggacggcaagctgtactgccccaaggactactggggcaagttcggcgagttctgccacggctgcagcctgctgatgaccggccccttcatggtggccggcgagttcaagtaccaccccgagtgcttcgcctgcatgagctgcaaggtgatcatcgaggacggcgacgcctacgccctggtgcagcacgccaccctgtactgcggcaagtgccacaacgaggtggtgctggcccccatgttcgagagactgagcaccgagagcgtgcaggagcagctgccctacagcgtgaccctgatcagcatgcccgccaccaccgagggcagaagaggcttcagcgtgagcgtggagagcgcctgcagcaactacgccaccaccgtgcaggtgaaggaggtgaacagaatgcacatcagccccaacaacagaaacgccatccaccccggcgacagaatcctggagatcaacggcacccccgtgagaaccctgagagtggaggaggtggaggacgccatcagccagaccagccagaccctgcagctgctgatcgagcacgaccccgtgagccagagactggaccagctgagactggaggccagactggccccccacatgcagaacgccggccacccccacgccctgagcaccctggacaccaaggagaacctggagggcaccctgagaagaagaagcctgagaagaagcaacagcatcagcaagagccccggccccagcagccccaaggagcccctgctgttcagcagagacatcagcagaagcgagagcctgagatgcagcagcagctacagccagcagatcttcagaccctgcgacctgatccacggcgaggtgctgggcaagggcttcttcggccaggccatcaaggtgacccacaaggccaccggcaaggtgatggtgatgaaggagctgatcagatgcgacgaggagacccagaagaccttcctgaccgaggtgaaggtgatgagaagcctggaccaccccaacgtgctgaagttcatcggcgtgctgtacaaggacaagaagctgaacctgctgaccgagtacatcgagggcggcaccctgaaggacttcctgagaagcatggaccccttcccctggcagcagaaggtgagattcgccaagggcatcgccagcggcatggcctacctgcacagcatgtgcatcatccacagagacctgaacagccacaactgcctgatcaagctggacaagaccgtggtggtggccgacttcggcctgagcagactgatcgtggaggagagaaagagagcccccatggagaaggccaccaccaagaagagaaccctgagaaagaacgacagaaagaagagatacaccgtggtgggcaacccctactggatggcccccgagatgctgaacggcaagagctacgacgagaccgtggacatcttcagcttcggcatcgtgctgtgcgagatcatcggccaggtgtacgccgaccccgactgcctgcccagaaccctggacttcggcctgaacgtgaagctgttctgggagaagttcgtgcccaccgactgcccccccgccttcttccccctggccgccatctgctgcagactggagcccgagagcagacccgccttcagcaagctggaggacagcttcgaggccctgagcctgtacctgggcgagctgggcatccccctgcccgccgagctggaggagctggaccacaccgtgagcatgcagtacggcctgaccagagacagccccccctag

SEQ ID NO: 12251 - DNA, 459 bp, Artificial Sequence
  Description of Artificial Sequence: Synthetic coding sequence
atggcccacctgagaggcttcgccaaccagcacagcagagtggaccccgaggagctgttcaccaagctggacagaatcggcaagggcagcttcggcgaggtgtacaagggcatcgacaaccacaccaaggaggtggtggccatcaagatcatcgacctggaggaggccgaggacgagatcgaggacatccagcaggagatcaccgtgctgagccagtgcgacagcccctacatcaccagatacttcggcagctacctgaagagcaccaagctgtggatcatcatggagtacctgggcggcggcagcgccctggacctgctgaagcccggccccctggaggagacctacatcgccaccatcctgagagagatcctgaagggcctggactacctgcacagcgagagaaagatccacagagacatcaaggccgccaacgtgctgctgagcgagcagggctag

SEQ ID NO: 12252 - DNA, 1365 bp, Artificial Sequence
  Description of Artificial Sequence: Synthetic coding sequence
atggccccctgcagagccagaaccggccccagcacctggagaagcgccaccagcagcaccagaagaagaaagggcgccagaagacacctgagcgccctgcaggtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacaccccccagagaaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggcatgaacctgggcagcagcagcgtgagagccggcctgcagagcctggaggccagcggcagactggaggacgagttcgacatgttcgccctgaccagaggcagcagcctggccgaccagagaaaggaggtgaagtacgaggccccccaggccaccgacggcctggccggcgccctggacgccagacagcagagcaccggcgccatccccgtgacccaggcctgcctgatggaggacatcgagcagtggctgagcaccgacgtgggcaacgacgccgaggagcccaagggcgtgaccagcgaggagttcgacaagttcctggaggagagagccaaggccgccgacagactgcccaacctgagcagccccagcgccgagggcccccccggcccccccagcggccccgcccccagaaagaagacccaggagaaggacgacgacatgctgttcgccctgtag

SEQ ID NO: 12253 - DNA, 378 bp, Artificial Sequence
  Description of Artificial Sequence: Synthetic coding sequence
atgcagaccagcagcagcagaagcgtgcacctgagcgagtggcagaagaactacttcgccatcaccagcggcatctgcaccggccccaaggccgacgcctacagagcccagatcctgagaatccagtacgcctgggccaacagcgagatcagccaggtgtgcgccaccaagctgttcaagaagtacgccgagaagtacagcgccatcatcgacagcgacaacgtggagagcggcctgaacaactacgccgagaacatcctgaccctggccggcagccagcagaccgacagcgacaagtggcagagcggcctgagcatcaacaacgtgttcaagatgagcagcgtgcagaagatgatgcaggccggcaagaagttctag

SEQ ID NO: 12254 - DNA, 30 bp, Artificial Sequence
  Description of Artificial Sequence: Synthetic coding sequence
atgagccacctgcagagcctgctgctgtag

SEQ ID NO: 12255 - DNA, 270 bp, Artificial Sequence; identical to SEQ ID NO: 11466
  Description of Artificial Sequence: Synthetic coding sequence

SEQ ID NO: 12256 - DNA, 3732 bp, Artificial Sequence
  Description of Artificial Sequence: Synthetic coding sequence
atgctgatcaaggagtaccacatcctgctgcccatgagcctggacgagtaccaggtggcccagctgtacatgatccagaagaagagcagagaggagagcagcggcgagggcagcggcgtggagatcctggccaacagaccctacaccgacggccccggcggcagcggccagtacacccacaaggtgtaccacgtgggcagccacatccccggctggttcagagccctgctgcccaaggccgccctgcaggtggaggaggagagctggaacgcctacccctacaccagaaccagatacacctgccccttcgtggagaagttcagcatcgagatcgagacctactacctgcccgacggcggccagcagcccaacgtgttcaacctgagcggcgccgagagaagacagagaatcctggacaccatcgacatcgtgagagacgccgtggcccccggcgagtacaaggccgaggaggaccccagactgtaccacagcgtgaagaccggcagaggccccctgagcgacgactgggccagaaccgccgcccagaccggccccctgatgtgcgcctacaagctgtgcaaggtggagttcagatactggggcatgcaggccaagatcgagcagttcatccacgacgtgggcctgagaagagtgatgctgagagcccacagacaggcctggtgctggcaggacgagtggaccgagctgagcatggccgacatcagagccctggaggaggagaccgccagaatgctggcccagagaatggccaagtgcaacaccggcagcgagggcagcgaggcccagccccccggcaagcccagcaccgaggccagaagcgccgccagcaacaccggcacccccgacggccccgaggccccccccggccccgacgccagccccgacgccagcttcggcaagcagtggagcagcagcagcagaagcagctacagcagccagcacggcggcgccgtgagcccccagagcctgagcgagtggagaatgcagaacatcgccagagacagcgagaacagcagcgaggaggagttcttcgacgcccacgagggcttcagcgacagcgaggaggtgttccccaaggagatgaccaagtggaacagcaacgacttcatcgacgccttcgccagccccgtggaggccgagggcacccccgagcccggcgccgaggccgccaagggcatcgaggacggcgcccaggcccccagagacagcgagggcctggacggcgccggcgagctgggcgccgaggcctgcgccgtgcacgccctgttcctgatcctgcacagcggcaacatcctggacagcggccccggcgacgccaacagcaagcaggccgacgtgcagaccctgagcagcgccttcgaggccgtgaccagaatccacttccccgaggccctgggccacgtggccctgagactggtgccctgcccccccatctgcgccgccgcctacgccctggtgagcaacctgagcccctacagccacgacggcgacagcctgagcagaagccaggaccacatccccctggccgccctgcccctgctggccaccagcagcagcagataccagggcgccgtggccaccgtgatcgccagaaccaaccaggcctacagcgccttcctgagaagccccgagggcgccggcttctgcggccaggtggccctgatcggcgacggcgtgggcggcatcctgggcttcgacgccctgtgccacagcgccaacgccggcaccggcagcagaggcagcagcagaagaggcagcatgaacaacgagctgctgagccccgagttcggccccgtgagagaccccctggccgacggcgtggagggcctgggcagaggcagccccgagcccagcgccctgcccccccagagaatccccagcgacatggccagccccgagcccgagggcagccagaacagcctgcaggccgcccccgccaccaccagcagctgggagcccagaagagccagcaccgccttctgcccccccgccgccagcagcgaggcccccgacggccccagcagcaccgccagactggacttcaaggtgagcggcttcttcctgttcggcagccccctgggcctggtgctggccctgagaaagaccgtgatgcccgccctggaggcccagatgagacccgcctgcgagcagatctacaacctgttccacgccgccgacccctgcgccagcagactggagcccctgctggcccccaagttccaggccatcgcccccctgaccgtgcccagataccagaagttccccctgggcgacggcagcagcctgctgctggccgacaccctgcagacccacagcagcctgttcctggaggagctggagatgctggtgcccagcacccccaccagcaccagcggcgccttctggaagggcagcgagctggccaccgacccccccgcccagcccgccgcccccagcaccaccagcgaggtggtgaagatcctggagagatggtggggcaccaagagaatcgactacagcctgtactgccccgaggccctgaccgccttccccaccgtgaccctgccccacctgttccacgccagctactgggagagcgccgacgtggtggccttcatcctgagacaggtgatcgagaaggagagaccccagctggccgagtgcgaggagcccagcatctacagccccgccttccccagagagaagtggcagagaaagagaacccaggtgaagatcagaaacgtgaccagcaaccacagagccagcgacaccgtggtgtgcgagggcagaccccaggtgctgagcggcagattcatgtacggccccctggacgtggtgaccctgaccggcgagaaggtggacgtgtacatcatgacccagcccctgagcggcaagtggatccacttcggcaccgaggtgaccaacagcagcggcagactgaccttccccgtgccccccgagagagccctgggcatcggcgtgtaccccgtgagaatggtggtgagaggcgaccacacctacgccgagtgctgcctgaccgtggtggccagaggcaccgaggccgtggtgttcagcatcgacggcagcttcaccgccagcgtgagcatcatgggcagcgaccccaaggtgagagccggcgccgtggacgtggtgagacactggcaggacagcggctacctgatcgtgtacgtgaccggcagacccgacatgcagaagcacagagtggtggcctggctgagccagcacaacttcccccacggcgtggtgagcttctgcgacggcctgacccacgaccccctgagacagaaggccatgttcctgcagagcctggtgcaggaggtggagctgaacatcgtggccggctacggcagccccaaggacgtggccgtgtacgccgccctgggcctgagccccagccagacctacatcgtgggcagagccgtgagaaagctgcaggcccagtgccagttcctgagcgacggctacgtggcccacctgggccagctggaggccggcagccacagccacgccagcagcggcccccccagagccgccctgggcaagagcagctacggcgtggccgcccccgtggacttcctgagaaagcagagccagctgctgagaagcagaggccccagccaggccgagagagagggccccggcaccccccccaccaccctggccagaggcaaggccagaagcatcagcctgaagctggacagcgaggagtag

SEQ ID NO: 12257 - DNA, 1614 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggagttcgccgtgcccgactacagaagcagccacctggaggtgagccaggccagccagctgctgcagcagcagcagcagcagcagctgagaagaagacccagcctgctgagcgagttccaccccggcagcgacagaccccaggagagaagaaccagctacgagcccttccaccccggccccagccccgtggaccacgacagcctggagagcaagagacccagactggagcaggtgagcgacagccacttccagagagtgagcgccgccgtgctgcccctggtgcaccccctgcccgagggcctgagagccagcgccgacgccaagaaggaccccgccttcggcggcaagcacgaggcccccagcagccccatcagcggccagccctgcggcgacgaccagaacgccagccccagcaagctgagcaaggaggagctgatccagagcatggacagagtggacagagagatcgccaaggtggagcagcagatcctgaagctgaagaagaagcagcagcagctggaggaggaggccgccaagccccccgagcccgagaagcccgtgagccccccccccgtggagcagaagcacagaagcatcgtgcagatcatctacgacgagaacagaaagaaggccgaggaggcccacaagatcttcgagggcctgggccccaaggtggagctgcccctgtacaaccagcccagcgacaccaaggtgtaccacgagaacatcaagaccggcgtgcccgccagaagaatgatgaagaaccaggtgatgagaaagaagctgatcctgttcttcaagagaagaaaccacgccagaaagcagagagagcagaagatctgccagagatacgaccagctgatggaggcctgggagaagaaggtggacagaatcgagaacaaccccagaagaaaggccaaggagagcaagaccagagagtactacgagaagcagttccccgagatcagaaagcagagagagcagcaggagagattccagagagtgggccagagaggcgccggcctgagcgccaccatcgccagaagcgagcacgagatcagcgagatcatcgacggcctgagcgagcaggagaacaacgagaagcagatgagacagctgagcgtgatcccccccatgatgttcgacgccgagcagagaagagtgaagttcatcaacatgaacggcctgatggaggaccccatgaaggtgtacaaggacagacagttcatgaacgtgtggaccgaccacgagaaggagatcttcaaggacaagttcatccagcaccccaagaacttcggcctgatcgccagctacctggagagaaagagcgtgcccgactgcgtgctgtactactacctgaccaagaagaacgagaactacaaggccctggtgagaagaaactacggcaagagaagaggcagaaaccagcagatcgccagacccagccaggaggagaaggtggaggagaaggaggaggacaaggccgagaagaccgagaagaagtag

SEQ ID NO: 12258 - DNA, 147 bp, Artificial Sequence
  Description of Artificial Sequence: Synthetic coding sequence
atggaggacctgttcgagaccttccaggacgagatgggcttcagcaacatggaggacgacggccccgaggaggaggagagagtggccgagccccaggccaacttcaacaccccccaggccctgagacagctgctgctgctgatgtag

SEQ ID NO: 12259 - DNA, 798 bp, Artificial Sequence
  Description of Artificial Sequence: Synthetic coding sequence
atggccagcagcagcgtgccccccgccaccgtgagcgccgccaccgccggccccggccccggcttcggcttcgccagcaagaccaagaagaagcacttcgtgcagcagaaggtgaaggtgttcagagccgccgaccccctggtgggcgtgttcctgtggggcgtggcccacagcatcaacgagctgagccaggtgcccccccccgtgatgctgctgcccgacgacttcaaggccagcagcaagatcaaggtgaacaaccacctgttccacagagagaacctgcccagccacttcaagttcaaggagtactgcccccaggtgttcagaaacctgagagacagattcggcatcgacgaccaggactacctggtgagcctgaccagaaacccccccagcgagagcgagggcagcgacggcagattcctgatcagctacgacagaaccctggtgatcaaggaggtgagcagcgaggacatcgccgacatgcacagcaacctgagcaactaccaccagtacatcgtgaagtgccacggcaacaccctgctgccccagttcctgggcatgtacagagtgagcgtggacaacgaggacagctacatgctggtgatgagaaacatgttcagccacagactgcccgtgcacagaaagtacgacctgaagggcagcctggtgagcagagagcccgccatcagaaagagactgaagaactgcccccccctgagaatctggaccttcagcaccagaaccagaaagtacatcctggtgaagagaagaagaaagtacttctggagaagctag

SEQ ID NO: 12260 - DNA, 462 bp, Artificial Sequence
  Description of Artificial Sequence: Synthetic coding sequence
atgagccccgaggtggccctgaacagaatcagccccatgctgagccccttcatcagcagcgtggtgagaaacggcaaggtgggcctggacgccaccaactgcctgagaatcaccgacctgaagagcggctgcaccagcctgacccccggccccaactgcgacagattcaagctgcacatcccctacgccggcgagaccctgaagtgggacatcatcttcaacgcccagtaccccgagctgccccccgacttcatcttcggcgaggacgccgagttcctgcccgaccccagcgccctgcagaacctggccagctggaaccccagcaaccccgagtgcctgctgctggtggtgaaggagctggtgcagcagtaccaccagttccagtgcagcagactgagagagagcagcagactgatgttcgagtaccagaccctgctggaggagccccagtacggcgagtag

SEQ ID NO: 12261 - DNA, 78 bp, Artificial Sequence
  Description of Artificial Sequence: Synthetic coding sequence
atggagctgagatgcggcggcctgctgttcagcagcagattcgacagcggcaacctggcccacgtggagaaggtgtag

SEQ ID NO: 12262 - DNA, 228 bp, Artificial Sequence
  Description of Artificial Sequence: Synthetic coding sequence
atggccagcgaggtgggccacaacctggagagccccgagacccccggcggcggcggctggaccagagtggagttccccccccccgcccccaagggcgccgccaccgtgtggtgcctgaacagactgggcagcagaaagctgagcctgatctggatcaccttcaacaccggctggaacatgaagagcagactgatcatcctgatccagcaggtgagctgccaccactag

SEQ ID NO: 12263 - DNA, 1620 bp, Artificial Sequence; identical to SEQ ID NO: 10018
  Description of Artificial Sequence: Synthetic coding sequence

SEQ ID NO: 12264 - DNA, 390 bp, Artificial Sequence
  Description of Artificial Sequence: Synthetic coding sequence
atgcccggcctgagctgcagattctaccagcacaagttccccgaggtggaggacgtggtgatggtgaacgtgagaagcatcgccgagatgggcgcctacgtgagcctgctggagtacaacaacatcgagggcatgatcctgctgagcgagctgagcagaagaagaatcagaagcatcaacaagctgatcagaatcggcagaaacgagtgcgtggtggtgatcagagtggacaaggagaagggctacatcgacctgagcaagagaagactgaccctgtgggagaccgagagcaacctgagaaacaccgagcagagattcctggccgtgaaccccagactggagagcttccccgtgctgaagaccagcaagctgaacatcttctacttctag

SEQ ID NO: 12265 - DNA, 1842 bp, Artificial Sequence; identical to SEQ ID NO: 9548
  Description of Artificial Sequence: Synthetic coding sequence

SEQ ID NO: 12266 - DNA, 1983 bp, Artificial Sequence
  Description of Artificial Sequence: Synthetic coding sequence
atcgccaagccccagggcacctaccaggtgctgccccccaacaccggcagcctgtacatcgacaaggactgcagcgccgtgtactgccacgagagcagcagcaacatctactaccccttccagaagagagagcagctgagagccggcagatacatcatgagacacaccagcgaggtgatctgcgaggtgctggaccccgagggcaacaccttccaggtgatggccgacggcagcatcagcaccatcctgcccgagaagaagctggaggacgacctgaacgagaagaccgagggctacgacagcctgagcagcatgcacctggagaagaaccaccagcagatctacggcgagcacgtgcccagattcttcgtgatgtacgccgacggcagcggcatggagctgctgagagacagcgacatcgaggagtacctgagcctggcctacaaggagagcaacaccgtggtgctgcaggagcccgtgcaggagcagcccggcaccctgaccatcaccgtgctgagacccttccacgaggccagcccctggcaggtgaagaaggaggacaccatcgtgccccccaacctgagaagcagaagctgggagaccttccccagcgtggagaagaagacccccggcccccccttcggcacccagatctggaagggcctgtgcatcgagagcaagcagctggtgagcgcccccggcgccatcctgaagagccccagcgtgctgcagatgagacagttcatccagcacgaggtgatcaagaacgaggtgaagctgagactgcaggtgagcctgaaggactacatcaactacatcctgaagaaggaggacgagctgcaggagatgatggtgaaggacagcagaaccgaggaggagagaggcaacgccgccgacctgctgaagctggtgatgagcttccccaagatggaggagaccaccaagagccacgtgaccgaggtggccgcccacctgaccgacctgttcaagcagagcctggccaccccccccaagtgcccccccgacaccttcggcaaggacttcttcgagaagacctggagacacaccgccagcagcaagagatggaaggagaagatcgacaagaccagaaaggagatcgagaccacccagaactacctgatggacatcaagaacagaatcatcccccccttcttcaagagcgagctgaaccagctgtaccagagccagtacaaccacctggacagcctgagcaagaagctgcccagcttcaccaagaagaacgaggacgccaacgagaccgccgtgcaggacaccagcgacctgaacctggacttcaagccccacaaggtgagcgagcagaagagcagcagcgtgcccagcctgcccaagcccgagatcagcgccgacaagaaggacttcaccgcccagaaccagaccgagaacctgaccaagagccccgaggaggccgagagctacgagcccgtgaagatccccacccagagcctgctgcaggacgtggccggccagaccagaaaggagaaggtgaagctgccccactacctgctgagcagcaagcccaagagccagcccctggccaaggtgcaggacagcgtgggcggcaaggtgaacaccagcagcgtggccagcgccgccatcaacaacgccaagagcagcctgttcggcttccacctgctgcccagcagcgtgaagttcggcgtgctgaaggagggccacacctacgccaccgtggtgaagctgaagaacgtgggcgtggacttctgcagattcaaggtgaagcagcccccccccagcaccggcctgaaggtgacctacaagcccggccccgtggccgccggcatgcagaccgagctgaacatcgagctgttcgccaccgccgtgggcgaggacggcgccaagggcagcgcccacatcagccacaacatcgagatcatgaccgagcacgaggtgctgttcctgcccgtggaggccaacatcctgtag

SEQ ID NO: 12267 - DNA, 2475 bp, Artificial Sequence
  Description of Artificial Sequence: Synthetic coding sequence
atgtacagcaacgaggacagcagacagaccatcgtgtacagcgaggagagcaacaccaccatgagctacacccagaagatcaccaaccccctgcccgccgccagcagcaccgaccccgcccccttcgccaacatcaacacccccgtgctgcaggaggactacagacaggacagccagaccagaagaatcagcaccctgaagctgacccacaaccaggacctgggcagcagcagccccatcagcaccccccagttcagcaagagcgtggaggtgcccagcttcctgaagagacccagaagcctgacccccaaccccgtgcccgagacccacaccgccagcctgagcatccagatcgcccccctgagcggccaggacctggagagccacaagcagctgcccgagctgagccccgagaccgccaagatccccctgcagcaggagagacagaagagcgccgtggccgccgccagccagagcagcgactgcagagtgagccagatcaccgtgaacggcaacagcggcggcgccgtgagccccatgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagaccatgttcaagcagatccacatggtgcacaagcccgacgacgacaccgacatgtacaacaccccctacacctacaacgccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccccccccctgcccaccacccccacccccgtgcccagagagcccggcagaaagcccctgagcagcagcagactgggcgaggtgaccggcagccccagccccccccccagaagcggcgcccccacccccagcagcagagcccccgccctgagccccaccagaccccccaagaagcccctggactacgtgcaggaccacagcagcggcgtgttcaacgaggccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 12268 - DNA, 228 bp, Artificial Sequence
  Description of Artificial Sequence: Synthetic coding sequence
atgagatactacggcagctactacagaggcctgggctacggctgcggcggcttcggcggcctgggctacggctgcggctgcggcggctacagatacggcagcggctacggcggctacagatacggctgctgcagacccagctgcagagagggctacggcttcagcggcttcaagaagctggccgacagccacaccctgacccccagaagctgcccctacgccagctag

SEQ ID NO: 12269 - DNA, 183 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagatag

SEQ ID NO: 12270 - DNA, 600 bp, Artificial Sequence
  Description of Artificial Sequence: Synthetic coding sequence
atgaagctgggcaagaagcccatgtacaagcccgtggacccctacagcagaatgcagagcacctacaactacaacatgagaggcggcgcctacccccccagatacttctaccccttccccgtgccccccctgctgtaccaggtggagctgagcgtgggcggccagcagttcaacggcaagggcaagaccagacaggccgccaagcacgacgccgccgccaaggccctgagaatcctgcagaacgagcccctgcccgagagactggaggtgaacggcagagagagcgaggaggagaacctgaacaagagcgagatcagccaggtgttcgagatcgccctgaagagaaacctgcccgtgaacttcgagagcttccccctgaagcaggtggccagagagagcggccccccccacatgaagaacttcgtgaccaaggtgagcgtgggcgagttcgtgggcgagggcgagggcaagagcaagaagatcagcaagaagaacgccgccatcgccgtgctggaggagctgaagaagctgccccccctgcccgccgtggagagagtgaagcccagaatcaagaagaagaccaagcccatcgtgaagtag

SEQ ID NO: 12271 - DNA, 2685 bp, Artificial Sequence
  Description of Artificial Sequence: Synthetic coding sequence
atgcccgagcagttcagcgtggccgagttcctggccgtgaccgccgaggacctgagcagccccgccggcgccgccgccttcgccgccaagatgcccagatacagaggcgccgccctggccagagaggagatcctggagggcgaccaggccatcctgcagagaatcaagaaggccgtgagagccatccacagcagcggcctgggccacgtggagaacgaggagcagtacagagaggccgtggagagcctgggcaacagccacctgagccagaacagccacgagctgagcaccggcttcctgaacctggccgtgttcaccagagaggtggccgccctgttcaagaacctgatccagaacctgaacaacatcgtgagcttccccctggacagcctgatgaagggccagctgagagacggcagacaggccagcctgagcctgggcagcagagccaagctggagaaggagagagacagagccagagtgaccggcggcatccccggcgaggtggcccaggacatgcagagagagagaagaatcttccagctgcacatgtgcgagtacctgctgaaggccggcgagagccagatgaagcagggccccgacttcctgcagagcctgatcaagttcttccacgcccagcacaacttcttccaggacggctggaaggccgcccagagcctgttccccttcatcgagaagctggccgccagcgtgcacgccctgcaccaggcccaggaggacgagctgcagaagctgacccagctgagagacagcctgagaggcaccctgcagctggagagcagagaggagcacctgagcagaaagaacagcggctgcggctacagcatccaccagcaccagggcaacaagcagttcggcaccgagaaggtgggcttcctgtacaagaagagcgacggcatcagaagagtgtggcagaagagaaagtgcggcgtgaagtacggctgcctgaccatcagccacagcaccatcaacagaccccccgtgaagctgaccctgctgacctgccaggtgagacccaaccccgaggagaagaagtgcttcgacctggtgacccacaacagaacctaccacttccaggccgaggacgagcacgagtgcgaggcctgggtgagcgtgctgcagaacagcaaggacgaggccctgagcagcgccttcctgggcgagcccagcgccggccccggcagctggggcagcgccggccacgacggcgagccccacgacctgaccaagctgctgatcgccgaggtgaagagcagacccggcaacagccagtgctgcgactgcggcgccgccgaccccacctggctgagcaccaacctgggcgtgctgacctgcatccagtgcagcggcgtgcacagagagctgggcgtgagattcagcagaatgcagagcctgaccctggacctgctgggccccagcgagctgctgctggccctgaacatgggcaacaccagcttcaacgaggtgatggaggcccagctgcccagccacggcggccccaagcccagcgccgagagcgacatgggcaccagaagagactacatcatggccaagtacgtggagcacagattcgccagaagatgcacccccgagccccagagactgtggaccgccatctgcaacagagacctgctgagcgtgctggaggccttcgccaacggccaggacttcggccagcccctgcccggccccgacgcccaggcccccgaggagctggtgctgcacctggccgtgaaggtggccaaccaggccagcctgcccctggtggacttcatcatccagaacggcggccacctggacgccaaggccgccgacggcaacaccgccctgcactacgccgccctgtacaaccagcccgactgcctgaagctgctgctgaagggcagagccctggtgggcaccgtgaacgaggccggcgagaccgccctggacatcgccagaaagaagcaccacaaggagtgcgaggagctgctggagcaggcccaggccggcaccttcgccttccccctgcacgtggactacagctgggtgatcagcaccgagcccggcagcgacagcgaggaggacgaggaggagaagagatgcctgctgaagctgcccgcccaggcccactgggccagcggcagactggacatcagcaacaagacctacgagaccgtggccagcctgggcgccgccaccccccagggcgagagcgaggactgccccccccccctgcccgtgaagaacagcagcagaaccctggtgcagggctgcgccagacacgccagcggcgacagaagcgaggtgagcagcctgagcagcgaggcccccgagacccccgagagcctgggcagccccgccagcagcagcagcctgatgagccccctggagcccggcgaccccagccaggccccccccaacagcgaggagggcctgagagagccccccggcaccagcagacccagcctgaccagcggcaccacccccagcgagatgtacctgcccgtgagattcagcagcgagagcaccagaagctacagaagaggcgccagaagccccgaggacggccccagcgccagacagcccctgcccagaagaaacgtgcccgtgggcatcaccgagggcgacggcagcagaaccggcagcctgcccgccagcagcgtgcagctgctgcaggactag

SEQ ID NO: 12272 - DNA, 354 bp, Artificial Sequence; identical to SEQ ID NO: 11779
  Description of Artificial Sequence: Synthetic coding sequence

SEQ ID NO: 12273 - DNA, 1797 bp, Artificial Sequence
  Description of Artificial Sequence: Synthetic coding sequence
atgttcgtgagcgacttcagaaaggagttctacgaggtggtgcagagccagagagtgctgctgttcgtggccagcgacgtggacgccctgtgcgcctgcaagatcctgcaggccctgttccagtgcgaccacgtgcagtacaccctggtgcccgtgagcggctggcaggagctggagaccgccttcctggagcacaaggagcagttccactacttcatcctgatcaactgcggcgccaacgtggacctgctggacatcctgcagcccgacgaggacaccatcttcttcgtgtgcgacacccacagacccgtgaacgtggtgaacgtgtacaacgacacccagatcaagctgctgatcaagcaggacgacgacctggaggtgcccgcctacgaggacatcttcagagacgaggaggaggacgaggagcacagcggcaacgacagcgacggcagcgagcccagcgagaagagaaccagactggaggaggagatcgtggagcagaccatgagaagaagacagagaagagagtgggaggccagaagcggcagcggcagcgagcccgtggccgccgccctggagaagagcagcagactgttcgccggccccatgagcgacagaaccgcccccagaagccccagaagagacatcctgttcgactacgagcagtacgagtaccacggcaccagcagcgccatggtgatgttcgagctggcctggatgctgagcaaggacctgaacgacatgctgtggtgggccatcgtgggcctgaccgaccagtgggtgcaggacaagatcacccagatgaagtacgtgaccgacgtgggcgtgctgcagagacacgtgagcagacacaaccacagaaacgaggacgaggagaacaccctgagcgtggactgcaccagaatcagcttcgagtacgacctgagactggtgctgtaccagcactggagcctgcacgacagcctgtgcaacaccagctacaccgccgccagattcaagctgtggagcgtgcacggccagaagagactgcaggagttcctggccgacatgggcctgcccctgaagcaggtgaagcagaagttccaggccatggacatcagcctgaaggagaacctgagagagatgatcgaggagagcgccaacaagttcggcatgaaggacatgagagtgcagaccttcagcatccacttcggcttcaagcacaagttcctggccagcgacgtggtgttcgccaccatgagcctgatggagagccccgagaaggacggcagcggcaccgaccacttcatccaggccctggacagcctgagcagaagcaacctggacaagctgtaccacggcctggagctggccaagaagcagctgagagccacccagcagaccatcgccagctgcctgtgcaccaacctggtgatcagccagggccccttcctgtactgcagcctgatggagggcacccccgacgtgatgctgttcagcagacccgccagcctgagcctgctgagcaagcacctgctgaagagcttcgtgtgcagcaccaagaacagaagatgcaagctgctgcccctggtgatggccgcccccctgagcatggagcacggcaccgtgaccgtggtgggcatcccccccgagaccgacagcagcgacagaaagaacttcttcggcagagccttcgagaaggccgccgagagcaccagcagcagaatgctgcacaaccacttcgacctgagcgtgatcgagctgaaggccgaggacagaagcaagttcctggacgccctgatcagcctgctgagctag

SEQ ID NO: 12274 - DNA, 2994 bp, Artificial Sequence
  Description of Artificial Sequence: Synthetic coding sequence
atgcccagcgagaagaagatcagcagcgccaacgactgcatcagcttcatgcaggccggctgcgagctgaagaaggtgagacccaacagcagaatctacaacagattcttcaccctggacaccgacctgcaggccctgagatgggagcccagcaagaaggacctggagaaggccaagctggacatcagcgccatcaaggagatcagactgggcaagaacaccgagaccttcagaaacaacggcctggccgaccagatctgcgaggactgcgccttcagcatcctgcacggcgagaactacgagagcctggacctggtggccaacagcgccgacgtggccaacatctgggtgagcggcctgagatacctggtgagcagaagcaagcagcccctggacttcatggagggcaaccagaacacccccagattcatgtggctgaagaccgtgttcgaggccgccgacgtggacggcaacggcatcatgctggaggacaccagcgtggagctgatcaagcagctgaaccccaccctgaaggaggccaagatcagactgaagttcaaggagatccagaagagcaaggagaagctgaccaccagagtgaccgaggaggagttctgcgaggccttctgcgagctgtgcaccagacccgaggtgtacttcctgctggtgcagatcagcaagaacaaggagtacctggacgccaacgacctgatgctgttcctggaggccgagcagggcgtgacccacatcaccgaggacatctgcctggacatcatcagaagatacgagctgagcgaggagggcagacagaagggcttcctggccatcgacggcttcacccagtacctgctgagcagcgagtgcgacatcttcgaccccgagcagaagaaggtggcccaggacatgacccagcccctgagccactactacatcaacgccagccacaacacctacctgatcgaggaccagttcagaggccccgccgacatcaacggctacatcagagccctgaagatgggctgcagaagcgtggagctggacgtgagcgacggcagcgacaacgagcccatcctgtgcaacagaaacaacatgaccacccacgtgagcttcagaagcgtgatcgaggtgatcaacaagttcgccttcgtggccagcgagtaccccctgatcctgtgcctgggcaaccactgcagcctgccccagcagaaggtgatggcccagcagatgaagaaggtgttcggcaacaagctgtacaccgaggcccccctgcccagcgagagctacctgcccagccccgagaagctgaagagaatgatcatcgtgaagggcaagaagctgcccagcgaccccgacgtgctggagggcgaggtgaccgacgaggacgaggaggccgagatgagcagaagaatgagcgtggactacaacggcgagcagaagcagatcagactgtgcagagagctgagcgacctggtgagcatctgcaagagcgtgcagtacagagacttcgagctgagcatgaagagccagaactactgggagatgtgcagcttcagcgagaccgaggccagcagaatcgccaacgagtaccccgaggacttcgtgaactacaacaagaagttcctgagcagaatctaccccagcgccatgagaatcgacagcagcaacctgaacccccaggacttctggaactgcggctgccagatcgtggccatgaacttccagacccccggccccatgatggacctgcacaccggctggttcctgcagaacggcggctgcggctacgtgctgagacccagcatcatgagagacgaggtgagctacttcagcgccaacaccaagggcatcctgcccggcgtgagccccctggccctgcacatcaagatcatcagcggccagaacttccccaagcccaagggcgcctgcgccaagggcgacgtgatcgacccctacgtgtgcatcgagatccacggcatccccgccgactgcagcgagcagagaaccaagaccgtgcagcagaacagcgacaaccccatcttcgacgagaccttcgagttccaggtgaacctgcccgagctggccatgatcagattcgtggtgctggacgacgactacatcggcgacgagttcatcggccagtacaccatccccttcgagtgcctgcagcccggctacagacacgtgcccctgagaagcttcgtgggcgacatcatggagcacgtgaccctgttcgtgcacatcgccatcaccaacagaagcggcggcggcaaggcccagaagagaagcctgagcgtgagaatgggcaagaaggtgagagagtacaccatgctgagaaacatcggcctgaagaccatcgacgacatcttcaagatcgccgtgcaccccctgagagaggccatcgacatgagagagaacatgcagaacgccatcgtgagcatcaaggagctgtgcggcctgccccccatcgccagcctgaagcagtgcctgctgaccctgagcagcagactgatcaccagcgacaacacccccagcgtgagcctggtgatgaaggacagcttcccctacctggagcccctgggcgccatccccgacgtgcagaagaagatgctgaccgcctacgacctgatgatccaggagagcagattcctgatcgagatggccgacaccgtgcaggagaagatcgtgcagtgccagaaggccggcatggagttccacgaggagctgcacaacctgggcgccaaggagggcctgaagggcagaaagctgaacaaggccaccgagagcttcgcctggaacatcaccgtgctgaagggccagggcgacctgctgaagaacgccaagaacgaggccatcgagaacatgaagcagatccagctggcctgcctgagctgcggcctgagcaaggcccccagcagcagcgccgaggccaagagcaagagaagcctggaggccatcgaggagaaggagagcagcgaggagaacggcaagctgtag

SEQ ID NO: 12275 - DNA, 612 bp, Artificial Sequence
  Description of Artificial Sequence: Synthetic coding sequence
atgagaaacggcgacttcctgcccaccagactgcaggcccagcaggacgccgtgaacatcgtgtgccacagcaagaccagaagcaaccccgagaacaacgtgggcctgatcaccctggccaacgactgcgaggtgctgaccaccctgacccccgacaccggcagaatcctgagcaagctgcacaccgtgcagcccaagggcaagatcaccttctgcaccggcatcagagtggcccacctggccctgaagcacagacagggcaagaaccacaagatgagaatcatcgccttcgtgggcagccccgtggaggacaacgagaaggacctggtgaagctggccaagagactgaagaaggagaaggtgaacgtggacatcatcaacttcggcgaggaggaggtgaacaccgagaagctgaccgccttcgtgaacaccctgaacggcaaggacggcaccggcagccacctggtgaccgtgccccccggccccagcctggccgacgccctgatcagcagccccatcctggccggcgagggcggcgccatgctgggcctgggcgccagcgacttcgagttcggcgtggaccccagcgccgaccccgagctggccctgtag

SEQ ID NO: 12276 - DNA, 429 bp, Artificial Sequence; identical to SEQ ID NO: 10351
  Description of Artificial Sequence: Synthetic coding sequence

SEQ ID NO: 12277 - DNA, 1410 bp, Artificial Sequence
  Description of Artificial Sequence: Synthetic coding sequence
atgtgcagcctggccagcggcgccaccggctacagccacctgctgaagaagcacttccacaccgtgagcctgagcatcagcctgatcctgaccgcctggttcatcaacatgaaccccaccgtggagtacatgaacagcatctacaaccccgtgccctgggagaaggaggagtacctgaagcccgtgctggaggacgacctgctgctgcagttcgacgtggaggacctgtacgagcccgtgagcgtgcccttcagctaccccaacggcctgagcgagaacaccagcgtggtggagaagctgaagcacatggaggccagagccctgagcgccgaggccgccctggccagagccagagaggacctgcagaagatgaagcagttcgcccaggacttcgtgatgcacaccgacgtgagaacctgcagcagcagcaccagcgtgatcgccgacctgcaggaggacgaggacggcgtgtacttcagcagctacggccactacggcatccacgaggagatgctgaaggacaagatcagaaccgagagctacagagacttcatctaccagaacccccacatcttcaaggacaaggtggtgctggacgtgggctgcggcaccggcatcctgagcatgttcgccgccaaggccggcgccaagaaggtgctgggcgtggaccagagcgagatcctgtaccaggccatggacatcatcagactgaacaagctggaggacaccatcaccctgatcaagggcaagatcgaggaggtgcacctgcccgtggagaaggtggacgtgatcatcagcgagtggatgggctacttcctgctgttcgagagcatgctggacagcgtgctgtacgccaagaacaagtacctggccaagggcggcagcgtgtaccccgacatctgcaccatcagcctggtggccgtgagcgacgtgaacaagcacgccgacagaatcgccttctgggacgacgtgtacggcttcaagatgagctgcatgaagaaggccgtgatccccgaggccgtggtggaggtgctggaccccaagaccctgatcagcgagccctgcggcatcaagcacatcgactgccacaccaccagcatcagcgacctggagttcagcagcgacttcaccctgaagatcaccagaaccagcatgtgcaccgccatcgccggctacttcgacatctacttcgagaagaactgccacaacagagtggtgttcagcaccggcccccagagcaccaagacccactggaagcagaccgtgttcctgctggagaagcccttcagcgtgaaggccggcgaggccctgaagggcaaggtgaccgtgcacaagagcaagaaggaccccagaagcctgaccgtgaccctgaccctgaacaacagcacccagacctacggcctgcagtag

SEQ ID NO: 12278 - DNA, 525 bp, Artificial Sequence
  Description of Artificial Sequence: Synthetic coding sequence
atggccagcgccggcacccagcactacagcatcggcctgagacagaagaacagcttcaagcagagcggccccagcggcaccgtgcccgccaccccccccgagaagcccagcgagggcagagtgtggccccaggcccaccagcaggtgaagcccatctggaagctggagaagaagcaggtggagaccctgagcgccggcctgggccccggcctgctgggcgtgcccccccagcccgcctacttcttctgccccagcaccctgtgcagcagcggcaccaccgccgtgatcgccggccacagcagcagctgctacctgcacagcctgcccgacctgttcaacagcaccctgctgtacagaagaagcagctacagacagaagccctaccagcagctggagagcttctgcctgagaagcagccccagcgagaagagccccttcagcctgccccagaagagcctgcccgtgagcctgaccgccaacaaggccaccagcagcatggtgttcagcatggcccagcccatgtag

SEQ ID NO: 12279 - DNA, 1572 bp, Artificial Sequence
  Description of Artificial Sequence: Synthetic coding sequence
atgcagaaggagagagagctgcaggagaccatctacttcaagaacacctggcccgcctgcatgttcctgatcgtggcccccctgagcgtgctgtacaactggaaggacgagctggacacctggggctacttcagagtgaccgtgctgcacggcaacagaaaggacaacgagctgatcagagtgaagcagagaaagtgcgagatcgccctgaccacctacgagaccctgagactgtgcctggacgagctgaacagcctggagtggagcgccgtgatcgtggacgaggcccacagaatcaagaaccccaaggccagagtgaccgaggtgatgaaggccctgaagtgcaacgtgagaatcggcctgaccggcaccatcctgcagaacaacatgaaggagctgtggtgcgtgatggactgggccgtgcccggcctgctgggcagcggcacctacttcaagaagcagttcagcgaccccgtggagcacggccagagacacaccgccaccaagagagagctggccaccggcagaaaggccatgcagagactggccaagaagatgagcggctggttcctgagaagaaccaagaccctgatcaaggaccagctgcccaagaaggaggacagaatggtgtactgcagcctgaccgacttccagaaggccgtgtaccagaccgtgctggagaccgaggacgtgaccctgatcctgcagagcagcgagccctgcacctgcagaagcggccagaagagaagaaactgctgctacaagaccaacagccacggcgagaccgtgaagaccctgtacctgagctacctgaccgtgctgcagaaggtggccaaccacgtggccctgctgcaggccgccagcaccagcaagcagcaggagaccctgatcaagagaatctgcgaccaggtgttcagcagattccccgacttcgtgcagaagagcaaggacgccgccttcgagaccctgagcgaccccaagtacagcggcaagatgaaggtgctgcagcagctgctgaaccactgcagaaagaacagagacaaggtgctgctgttcagcttcagcaccaagctgctggacgtgctgcagcagtactgcatggccagcggcctggactacagaagactggacggcagcaccaagagcgaggagagactgaagatcgtgaaggagttcaacagcacccaggacgtgaacatctgcctggtgagcaccatggccggcggcctgggcctgaacttcgtgggcgccaacgtggtggtgctgttcgaccccacctggaaccccgccaacgacctgcaggccatcgacagagcctacagaatcggccagtgcagagacgtgaaggtgctgagactgatcagcctgggcaccgtggaggagatcatgtacctgagacagatctacaagcagcagctgcactgcgtggtggtgggcagcgagaacgccaagagatacttcgaggccgtgcagggcagcaaggagcaccagggcgagctgttcggcatccacaacctgttcaagttcagaagccagggcagctgcctgaccaaggacatcctggaggtgtag

SEQ ID NO: 12280 - DNA, 1179 bp, Artificial Sequence; identical to SEQ ID NO: 11426
  Description of Artificial Sequence: Synthetic coding sequence

SEQ ID NO: 12281 - DNA, 1566 bp, Artificial Sequence
  Description of Artificial Sequence: Synthetic coding sequence
atggagcagagcagcctgtacttctgggacctgctggagggcagcgagaaggccgtggtgggcaccacctacaagcacctgaaggacctgctgagcaagctgctgaacagcggctacttcgagagcatccccgtgcccaagaacgccaaggagaaggaggtgcccctggaggaggagatgctgatccagagcgagaagaagacccagctgagcaagaccgagagcgtgaaggagagcgagagcctgatggagttcgcccagcccgagatccagccccaggagttcctgaacagaagatacatgaccgaggtggactacagcaacaagcagggcgaggagcagccctgggaggccgactacgccagaaagcccaacctgcccaagagatgggacatgctgaccgagcccgacggccaggagaagaagcaggagagcttcaagagctgggaggccagcggcaagcaccaggaggtgagcaagcccgccgtgagcctggagcagagaaagcaggacaccagcaagctgagaagcaccctgcccgaggagcagaagaagcaggagatcagcaagagcaagcccagccccagccagtggaagcaggacacccccaagagcaaggccggctacgtgcaggaggagcagaagaagcaggagacccccaagctgtggcccgtgcagctgcagaaggagcaggaccccaagaagcagacccccaagagctggacccccagcatgcagagcgagcagaacaccaccaagagctggaccacccccatgtgcgaggagcaggacagcaagcagcccgagacccccaagagctgggagaacaacgtggagagccagaagcacagcctgaccagccagagccagatcagccccaagagctggggcgtggccaccgccagcctgatccccaacgaccagctgctgcccagaaagctgaacaccgagcccaaggacgtgcccaagcccgtgcaccagcccgtgggcagcagcagcaccctgcccaaggaccccgtgctgagaaaggagaagctgcaggacctgatgacccagatccagggcacctgcaacttcatgcaggagagcgtgctggacttcgacaagcccagcagcgccatccccaccagccagccccccagcgccacccccggcagccccgtggccagcaaggagcagaacctgagcagccagagcgacttcctgcaggagcccctgcaggccgccatcccccccggcaagcagcccagcagcctggccagccccaacccccccatggccaagggcagcgagcagggcttccagagcccccccgccagcagcagcagcgtgaccatcaacaccgcccccttccaggccatgcagaccgtgttcaacgtgaacgcccccctgccccccagaaaggagcaggagatcaaggagagcccctacagccccggctacaaccagagcttcaccaccgccagcacccagacccccccccagtgccagctgcccagcatccacgtggagcagaccgtgcacagccaggagaccgcccccggcaaccaccacagcaccttctag

SEQ ID NO: 12282 - DNA, 480 bp, Artificial Sequence; identical to SEQ ID NO: 11816
  Description of Artificial Sequence: Synthetic coding sequence

SEQ ID NO: 12283 - DNA, 270 bp, Artificial Sequence; identical to SEQ ID NO: 11466
  Description of Artificial Sequence: Synthetic coding sequence

SEQ ID NO: 12284 - DNA, 1356 bp, Artificial Sequence
  Description of Artificial Sequence: Synthetic coding sequence
atggccgagggcgcccagccccaccagcccccccagctgggccccggcgccgccgccagaggcatgaagagagagagcgagctggagctgcccgtgcccggcgccggcggcgacggcgccgaccccggcctgagcaagagacccagaaccgaggaggccgccgccgacggcggcggcggcatgcagaacgagcccctgacccccggctaccacggcttccccgccagagacagccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgacccagaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcagcctgcccctggtgcccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacggcggctacgccgcctacagatacgcccagcccgccaccgccaccgccgccaccgccgccgccgccgccgccgccgcctacagcgacggctacggcagagtgtacaccgccgacccctaccacgccctggcccccgccgccagctacggcgtgggcgccgtggccagcctgtacagaggcggctacagcagattcgccccctactag

SEQ ID NO: 12285 - DNA, 855 bp, Artificial Sequence
  Description of Artificial Sequence: Synthetic coding sequence
atgttcagcagaagaagccacggcgacgtgaagaagagcacccagaaggtgctggaccccaagaaggacgtgctgaccagactgaagcacctgagagccctgctggacaacgtggacgccaacgacctgaagcagttcttcgagaccaactacagccagatctacttcatcttctacgagaacttcatcgccctggagaacagcctgaagctgaagggcaacaacaagagccagagagaggagctggacagcatcctgttcctgttcgagaagatcctgcagttcctgcccgagagaatcttcttcagatggcactaccagagcatcggcagcaccctgaagaagctgctgcacaccggcaacagcatcaagatcagatgcgagggcatcagactgttcctgctgtggctgcaggccctgcagaccaactgcgccgaggagcaggtgctgatcttcgcctgcctggtgcccggcttccccgccgtgatgagcagcagaggcccctgcaccctggagaccctgatcaaccccagccccagcgtggccgacgtgaagatctaccccgaggagatcacccccctgctgcccgccatcagcggcgagaagatcgccgaggaccagacctgcttcttcctgcagatcctgctgaagtacatggtgatccaggccgccagcctggagtggaagaacaaggagaaccaggacaccggcttcaagttcctgttcaccctgttcagaaagtactacctgccccacctgttccccagcttcaccaagctgaccaacatctacaagcccgtgctggacatcccccacctgagacccaagcccgtgtacatcaccaccaccagatag

SEQ ID NO: 12286 - DNA, 846 bp, Artificial Sequence
  Description of Artificial Sequence: Synthetic coding sequence
atgggcgacaccgtggtggagcccgcccccctgaagcccaccagcgagcccaccagcggcccccccggcaacaacggcggcagcctgctgagcgtgatcaccgagggcgtgggcgagctgagcgtgatcgaccccgaggtggcccagaaggcctgccaggaggtgctggagaaggtgaagctgctgcacggcggcgtggccgtgagcagcagaggcacccccctggagctggtgaacggcgacggcgtggacagcgagatcagatgcctggacgacccccccgcccagatcagagaggaggaggacgagatgggcgccgccgtggccagcggcaccgccaagggcgccagaagaagaagacagaacaacagcgccaagcagagctggctgctgagactgttcgagagcaagctgttcgacatcagcatggccatcagctacctgtacaacagcaaggagcccggcgtgcaggcctacatcggcaacagactgttctgcttcagaaacgaggacgtggacttctacctgccccagctgctgaacatgtacatccacatggacgaggacgtgggcgacgccatcaagccctacatcgtgcacagatgcagacagagcatcaacttcagcctgcagtgcgccctgctgctgggcgcctacagcagcgacatgcacatcagcacccagagacacagcagaggcaccaagctgagaaagctgatcctgagcgacgagctgaagcccgcccacagaaagagagagctgcccagcctgagccccgcccccgacaccggcctgagccccagcaagagaacccaccagagaagcaagagcgacgccaccgcctag

SEQ ID NO: 12287 - DNA, 591 bp, Artificial Sequence; identical to SEQ ID NO: 10377
  Description of Artificial Sequence: Synthetic coding sequence

SEQ ID NO: 12288 - DNA, 1620 bp, Artificial Sequence; identical to SEQ ID NO: 10018
  Description of Artificial Sequence: Synthetic coding sequence

SEQ ID NO: 12289 - DNA, 1086 bp, Artificial Sequence
  Description of Artificial Sequence: Synthetic coding sequence
gtgaccaccgagaagacctacaccagcaccagcaacaacagcatcagcggcagcctgaagagactggaggacaccaccgccagattcaccaacgccaacttccaggaggtgagcgcccacaccagcagcggcaaggacgtgagcgagaccagaggcagcgagggcaagggcaagaagagcagcgcccacagcagcggccagagaggcagaaagcccggcggcggcagaaaccccggcaccaccgtgagcgccgccagccccttcccccaggccggctacaagagagcccagaccagcggcatcgaggaggagaccgtgaaggagaagaagagaaagggcaacaagcagagcaagcacggccccggcagacccaagggcaacaagaaccaggagaacgtgagccacctgagcgtgagcagcgccagccccaccagcagcgtggccagcgccgccggcagcatcaccagcagcagcctgcagaagagccccaccctgctgagaaacggcagcctgcagagcctgagcgtgggcagcagccccgtgggcagcgagatcagcatgcagtacagacacgacggcgcctgccccaccaccaccttcagcgagctgctgaacgccatccacaacgacagaggcgacagcagcaccctgaccaagcaggagctgaagttcatcggcatctacaacagcaacgacgtggccgtgagcttccccaacgtggtgagcggcagcggcagcagcacccccgtgagcagcagccacctgccccagcagagcagcggccacctgcagcaggtgggcgccctgagccccagcgccgtgagcagcgccgcccccgccgtggccaccacccaggccaacaccctgagcggcagcagcctgagccaggcccccagccacatgtacggcaacagaagcaacagcagcatggccgccctgatcgcccagagcgagaacaaccagaccgaccaggacctgggcgacaacagcagaaacctggtgggcagaggcagcagccccagaggcagcctgagccccagaagccccgtgagcagcctgcagatcagatacgaccagcccggctag

SEQ ID NO: 12290 - DNA, 426 bp, Artificial Sequence
  Description of Artificial Sequence: Synthetic coding sequence
atggccgccgccccccccagctactgcttcgtggccttcccccccagagccaaggacggcctggtggtgttcggcaagaacagcgccagacccagagacgaggtgcaggaggtggtgtacttcagcgccgccgaccacgagcccgagagcaaggtggagtgcacctacatcagcatcgaccaggtgcccagaacctacgccatcatgatcagcagacccgcctggctgtggggcgccgagatgggcgccaacgagcacggcgtgtgcatcgccaacgaggccatcaacaccagagagcccgccgccgagatcgaggccctgctgggcatggacctggtgagactgggcctggagagaggcgagaccgccaaggaggccctggacgtgatcgtgagcctgctggaggagcacggccagggcggctag

SEQ ID NO: 12291 - DNA, 573 bp, Artificial Sequence
  Description of Artificial Sequence: Synthetic coding sequence
tgacagctggccgccctgaaggagatccaggccgaggtgcaggagaaggagagcgacgccgtgaagcccaagaaccaggacatccagggcggcaaggccgcccccgccgaggccctgggcatccccgacgagcactacctggacaacctgtgcatcttctgcggcgagagaagcgagagcttcaccgaggagggcctggacctgcactactggaagcactgcctgatgctgaccagatgcgaccactgcaagcaggtggtggagatcagcagcctgaccgagcacctgctgaccgagtgcgacaagaaggacggcttcggcaagtgctacagatgcagcgaggccgtgttcaaggaggagctgcccagacacatcaagcacaaggactgcaaccccgccaagcccgagaagctggccaacagatgccccctgtgccacgagaacttcagccccggcgaggaggcctggaaggcccacctgatgggccccgccggctgcaccatgaacctgagaaagacccacatcctgcagaaggcccccgccctgcagcccggcgagggccagagaagatag

SEQ ID NO: 12292 - DNA, 723 bp, Artificial Sequence
  Description of Artificial Sequence: Synthetic coding sequence
atgaccgtgggcaagagcagcaagatgctgcagcacatcgactacagaatgagatgcatcctgcaggacggcagaatcttcatcggcaccttcaaggccttcgacaagcacatgaacctgatcctgtgcgactgcgacgagttcagaaagatcaagcccaagaacagcaagcaggccgagagagaggagaagagagtgctgggcctggtgctgctgagaggcgagaacctggtgagcatgaccgtggagggccccccccccaaggacaccggcatcgccagagtgcccctggccggcgccgccggcggccccggcatcggcagagccgccggcagaggcatccccgccggcgtgcccatgccccaggcccccgccggcctggccggccccgtgagaggcgtgggcggccccagccagcaggtgatgaccccccagggcagaggcaccgtggccgccgccgccgccgccgccaccgccagcatcgccggcgcccccacccagtacccccccggcagaggcggcccccccccccccatgggcagaggcgcccccccccccggcatgatgggccccccccccggcatgagaccccccatgggcccccccatgggcatcccccccggcagaggcacccccatgggcatgcccccccccggcatgagaccccccccccccggcatgagaggcccccccccccccggcatgagaccccccagaccctag

SEQ ID NO: 12293 - DNA, 420 bp, Artificial Sequence
  Description of Artificial Sequence: Synthetic coding sequence
atggagaccgactgcaaccccatggagctgagcagcatgagcggcttcgaggagggcagcgagctgaacggcttcgagggcaccgacatgaaggacatgagactggaggccgaggccgtggtgaacgacgtgctgttcgccgtgaacaacatgttcgtgagcaagagcctgagatgcgccgacgacgtggcctacatcaacgtggagaccaaggagagaaacagatactgcctggagctgaccgaggccggcctgaaggtggtgggctacgccttcgaccaggtggacgaccacctgcagaccccctaccacgagaccgtgtacagcctgctggacaccctgagccccgcctacagagaggccttcggcaacgccctgctgcagagactggaggccctgaagagagacggccagagctag

SEQ ID NO: 12294 - DNA, 606 bp, Artificial Sequence
  Description of Artificial Sequence: Synthetic coding sequence
atggccggcctggaggtgctgttcgccagcgccgcccccgccatcacctgcagacaggacgccctggtgtgcttcctgcactgggaggtggtgacccacggctacttcggcctgggcgtgggcgaccagcccggccccaacgacaagaagagcgagctgctgcccgccggctggaacaacaacaaggacctgtacgtgctgagatacgagtacaaggacggcagcagaaagctgctggtgaaggccatcaccgtggagagcagcatgatcctgaacgtgctggagtacggcagccagcaggtggccgacctgaccctgaacctggacgactacatcgacgccgagcacctgggcgacttccacagatgcgaccccctgggccccttcgtggtgggcggcgaggacctggaccccttcggccccagaagaggcggcatgatcgtggaccccctgagaagcggcttccccagagccctgatcgaccccagcagcggcctgcccaacagactgccccccggcgccgtgccccccggcgccagattcgaccccttcggccccatcggcaccagcccccccggccccagacccgacagaagaggccagtag

SEQ ID NO: 12295 - DNA, 747 bp, Artificial Sequence; identical to SEQ ID NO: 11765
  Description of Artificial Sequence: Synthetic coding sequence

SEQ ID NO: 12296 - DNA, 1842 bp, Artificial Sequence; identical to SEQ ID NO: 9548
  Description of Artificial Sequence: Synthetic coding sequence

SEQ ID NO: 12297 - DNA, 1620 bp, Artificial Sequence; identical to SEQ ID NO: 10018
  Description of Artificial Sequence: Synthetic coding sequence

SEQ ID NO: 12298 - DNA, 1089 bp, Artificial Sequence
  Description of Artificial Sequence: Synthetic coding sequence
atggcccccaagcccggcgccgagtggagcaccgccctgagccacctggtgctgggcgtggtgagcctgcacgccgccgtgagcaccgccgaggccagcagaggcgccgccgccggcttcctgctgcaggtgctggccgccaccaccaccctggcccccggcctgagcacccacgaggactgcctggccggcgcctgggtggccaccgtgatcggcctgcccctgctggccttcgacttccactggtgcaccaacggccacctgatgtgcgccggctgcttcatccacctgctggccgacgccagactgaaggaggagcaggccacctgccccaactgcagatgcgagatcagcaagagcctgtgctgcagaaacctggccgtggagaaggccgtgagcgagctgcccagcgagtgcggcttctgcctgagacagttccccagaagcctgctggagagacaccagaaggaggagtgccaggacagagtgacccagtgcaagtacaagagaatcggctgcccctggcacggccccttccacgagctgaccgtgcacgaggccgcctgcgcccaccccaccaagaccggcagcgagctgatggagatcctggacggcatggaccagagccacagaaaggagatgcagctgtacaacagcatcttcagcctgctgagcttcgagaagatcggctacaccgaggtgcagttcagaccctacagaaccgacgacttcatcaccagactgtactacgagacccccagattcaccgtgctgaaccagacctgggtgctgaaggccagagtgaacgacagcgagagaaaccccaacctgagctgcaagagaaccctgagcttccagctgctgctgaagagcaaggtgaccgcccccctggagtgcagcttcctgctgctgaagggcccctacgacgacgtgagaatcagccccgtgatctaccacttcgtgttcaccaacgagagcaacgagaccgactacgtgcccctgcccatcatcgacagcgtggagtgcaacaagctgctggccgccaagaacatcaacctgagactgttcctgttccagatccagaagtag

SEQ ID NO: 12299 - DNA, 273 bp, Artificial Sequence; identical to SEQ ID NO: 12238
  Description of Artificial Sequence: Synthetic coding sequence

SEQ ID NO: 12300 - DNA, 2502 bp, Artificial Sequence
  Description of Artificial Sequence: Synthetic coding sequence
atggccgtggaggacagcaccctgcaggtggtggtgagagtgagaccccccacccccagagagctggacagccagagaagacccgtggtgcaggtggtggacgagagagtgctggtgttcaaccccgaggagcccgacggcggcttccccggcctgaagtggggcggcacccacgacggccccaagaagaagggcaaggacctgaccttcgtgttcgacagagtgttcggcgaggccgccacccagcaggacgtgttccagcacaccacccacagcgtgctggacagcttcctgcagggctacaactgcagcgtgttcgcctacggcgccaccggcgccggcaagacccacaccatgctgggcagagagggcgaccccggcatcatgtacctgaccaccgtggagctgtacagaagactggaggccagacagcaggagaagcacttcgaggtgctgatcagctaccaggaggtgtacaacgagcagatccacgacctgctggagcccaagggccccctggccatcagagaggaccccgacaagggcgtggtggtgcagggcctgagcttccaccagcccgccagcgccgagcagctgctggagatcctgaccagaggcaacagaaacagaacccagcaccccaccgacgccaacgccaccagcagcagaagccacgccatcttccagatcttcgtgaagcagcaggacagagtgcccggcctgacccaggccgtgcaggtggccaagatgagcctgatcgacctggccggcagcgagagagccagcagcacccacgccaagggcgagagactgagagagggcgccaacatcaacagaagcctgctggccctgatcaacgtgctgaacgccctggccgacgccaagggcagaaagacccacgtgccctacagagacagcaagctgaccagactgctgaaggacagcctgggcggcaactgcagaaccgtgatgatcgccgccatcagccccagcagcctgacctacgaggacacctacaacaccctgaagtacgccgacagagccaaggagatcagactgagcctgaagagcaacgtgaccagcctggactgccacatcagccagtacgccaccatctgccagcagctgcaggccgaggtggccgccctgagaaagaagctgcaggtgtacgagggcggcggccagccccccccccaggacctgcccggcagccccaagagcggccccccccccgagcacctgcccagcagccccctgcccccccacccccccagccagccctgcacccccgagctgcccgccggccccagagccctgcaggaggagagcctgggcatggaggcccaggtggagagagccatggagggcaacagcagcgaccaggagcagagccccgaggacgaggacgagggccccgccgaggaggtgcccacccagatgcccgagcagaaccccacccacgccctgcccgagagccccagactgaccctgcagcccaagcccgtggtgggccacttcagcgccagagagctggacggcgacagaagcaagcagctggccctgaaggtgctgtgcgtggcccagagacagtacagcctgctgcaggccgccaacctgctgacccccgacatgatcaccgagttcgagaccctgcagcagctggtgcaggaggagaagatcgagcccggcgccgaggccctgagaaccagcggcctggccagaggcgcccccctggcccaggagctgtgcagcgagagcatccccgtgcccagccccctgtgccccgagccccccggctacaccggccccgtgaccagaaccatggccagaagactgagcggccccctgcacaccctgggcatcccccccggccccaactgcacccccgcccagggcagcagatggcccatggagaagaagagaagaagacccagcgccctggaggccgacagccccatggcccccaagagaggcaccaagagacagagacagagcttcctgccctgcctgagaagaggcagcctgcccgacacccagcccagccagggccccagcacccccaagggcgagagagccagcagcccctgccacagccccagagtgtgccccgccaccgtgatcaagagcagagtgcccctgggccccagcgccatgcagaactgcagcacccccctggccctgcccaccagagacctgaacgccaccttcgacctgagcgaggagccccccagcaagcccagcttccacgagtgcatcggctgggacaagatcccccaggagctgagcagactggaccagcccttcatccccagagcccccgtgcccctgttcaccatgaagggccccaagcccaccagcagcctgcccggcaccagcgcctgcaagaagaagagagtggccagcagcagcgtgagccacggcagaagcagaatcgccagactgcccagcagcaccctgaagagacccgccggccccctggtgctgcccggcgactggcactag

SEQ ID NO: 12301 - DNA, 1842 bp, Artificial Sequence; identical to SEQ ID NO: 9548
  Description of Artificial Sequence: Synthetic coding sequence

SEQ ID NO: 12302 - DNA, 654 bp, Artificial Sequence
  Description of Artificial Sequence: Synthetic coding sequence
atgaacagccagccccagaccagaagccccttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagcagctgcccagccaggtgcccgagcacagccccgtggtgtacggcaccgtggagagcgcccacctggccgccagcacccccgtgaccgccgccagcgaccagaagtag

SEQ ID NO: 12303 - DNA, 969 bp, Artificial Sequence
  Description of Artificial Sequence: Synthetic coding sequence
atgtacttctgctggggcgccgacagcagagagctgcagagaagaagaaccgccggcagccccggcgccgagctgctgcaggccgccagcggcgagagacacagcctgctgctgctgaccaaccacagagtgctgagctgcggcgacaacagcagaggccagctgggcagaagaggcgcccagagaggcgagctgcccgagcccatccaggccctggagaccctgatcgtggacctggtgagctgcggcaaggagcacagcctggccgtgtgccacaagggcagagtgttcgcctggggcgccggcagcgagggccagctgggcatcggcgagttcaaggagatcagcttcacccccaagaagatcatgaccctgaacgacatcaagatcatccaggtgagctgcggccactaccacagcctggccctgagcaaggacagccaggtgttcagctggggcaagaacagccacggccagctgggcctgggcaaggagttccccagccaggccagcccccagagagtgagaagcctggagggcatccccctggcccaggtggccgccggcggcgcccacagcttcgccctgagcctgtgcggcaccagcttcggctggggcagcaacagcgccggccagctggccctgagcggcagaaacgtgcccgtgcagagcaacaagcccctgagcgtgggcgccctgaagaacctgggcgtggtgtacatcagctgcggcgacgcccacaccgccgtgctgacccaggacggcaaggtgttcaccttcggcgacaacagaagcggccagctgggctacagccccacccccgagaagagaggcccccagctggtggagagaatcgacggcctggtgagccagatcgactgcggcagactgagaggctgcagcagccagacccacttctgctggaacatctgccagctgtgcgacaacagcagcgtgaagctggagtag

SEQ ID NO: 12304 - DNA, 1743 bp, Artificial Sequence
  Description of Artificial Sequence: Synthetic coding sequence
atgagagccctgaccgtgcagagagtgaagttcgccatggacctgcccctgctgaagagagccggccaggacctggccgagaagaccaagaacttcgtgagcagaagcctggtgatcggcgaggtgctgagcatggccgacatggccaccggcgtgaagtgcggcatcatctactggctgttcggcggcgccatcagaaacctgggcagccccgagcacgtgaccaagtggttccagcccctgcaggagcagaagtacaccggcatgttcgccatgaccgagagaggccacggcagcaacgccagaggcatccagaccgaggccaccttcgacctgagcgcccaggagttcgtgatcgacaccccctgcgagaacgccgagaagatgtacatcggcaacgccatgtacggcaactacgccgccgtgttcgcccagctgatcatcgacggcagaagccagggcccccactgcttcatcgtgcccgtgagagacgagaacggcagcctgtaccccggcgtgaccgccatcgacatgatgtacaaggagggcctgcacggcgtggacaacggcatcctgatcttcgacaaggtgagaatccccagagagaacctgctggacaagttcggcagcgtggcccccgacggccagtaccacagccccatcagaaacaagagcgccagattcaacgccatgctggccgccctgacccccagcagactggccgtggccttccaggccatgggcgccatgaagctgggcctgaccatcgccatcagatacagccacagcagaagacagttcggccccaagaccaaggaggaggtgaagatcatcgagcaccagacccagaccctgagactgatgccccacctggccaccgccctggccctgaccttcgtgagcagatacgccggcgccctgctggacgaggacgtgttccagggcaaggagctggtgaacagcagaagcctgcaggccctggtggccggcctgaaggcctacagcacctgggagaacatcagatgcctgcaggactgcagagagtgcaccggcggcatggtggtgggcagagagctgctggcccagtacaccaagcagtacgaggagaagcccctgttcggcctgctgcagaactgggccgagagcgtgggcgacaagctgagaaccagcttcctggccttcaacatggacaccgtggacgacctggccttcctgctgaaggccgtgaagttcagagagagagtgctgcagagaggcctggtggccagaatctactacaaggtgaagaccaagaaggaggacttcttccacgcctggaacagctgcctgcaccacgtggccagcctgagcctggcccacacccacagagtgaccctggagcagttcagcctggccgtgaagagctgccccgaccaggaggaccagaccctgctgatgaagttctgcctgctgtacggcaccaagctggtgttccaggagagagcctggtacctggagcacaagtacctgacccccatggccagcaccagaatcagaaaccagctgctggacctgtgcgacagcgtgaaggacgacgccagaagagtgatcagcaccttcaacatcccccacacctacctgcacgcccccatcgccggcatcagcaaccccagagccgcctgggccttctaccccgcccccctgcagcccagacccagagaggaggccagaagcagaagacccaagctgggcgccaagctgtag

SEQ ID NO: 12305 - DNA, 561 bp, Artificial Sequence
  Description of Artificial Sequence: Synthetic coding sequence
atgggcgtgaaccagagcgtgggcttcccccccgtgaccggcccccacctggtgggctgcggcgacgtgatggagggccagaacctgcagggcagcttcttcagactgttctacccctgccagaaggccgaggagaccatggagcagcccctgtggatccccagatacgagtactgcaccggcctggccgagtacctgcagttcaacaagagatgcggcggcctgctgttcaacctggccgtgggcagctgcagactgcccgtgagctggaacggccccttcaagaccaaggacagcggctaccccctgatcatcttcagccacggcctgggcgccttcagaaccctgtacagcgccttctgcatggagctggccagcagaggcttcgtggtggccgtgcccgagcacagatgcgtgtacttcagagacagaagcgccgccaccacctacttctgcaagcaggcccccgaggagaaccagcccaccaacgagagcctgcaggaggagtggatccccttcagaagagtggaggagggcgagaaggagttccacgtgagatag

SEQ ID NO: 12306 - DNA, 1620 bp, Artificial Sequence; identical to SEQ ID NO: 10018
  Description of Artificial Sequence: Synthetic coding sequence

SEQ ID NO: 12307 - DNA, 2613 bp, Artificial Sequence
  Description of Artificial Sequence: Synthetic coding sequence
atgagcagaaaccccagcagcaacagccccgaggaggacaccgtgcccgtgcccaagggcagcgtgcccgccgccagacccagcagaggcggcatgagcgtggtgggcatcgacctgggcttcctgaactgctacatcgccgtggccagaagcggcggcatcgagaccatcgccaacgagtacagcgacagatgcacccccgcctgcatcagcctgggcagcagaaccagagccatcggcaacgccgccaagagccagatcgtgaccaacgtgagaaacaccatccacggcttcaagaagctgcacggcagaagcttcgacgaccccatcgtgcagaccgagagaatcagactgccctacgagctgcagaagatgcccaacggcagcgccggcgtgaaggtgagatacctggaggaggagagacccttcgccatcgagcaggtgaccggcatgctgctggccaagctgaaggagaccagcgagaacgccctgaagaagcccgtggccgactgcgtgatcagcatccccagcttcttcaccgacgccgagagaagaagcgtgatggccgccgcccaggtggccggcctgaactgcctgagactgatgaacgagaccaccgccgtggccctggcctacggcatctacaagcaggacctgccccccctggacgagaagcccagaaacgtggtgttcatcgacatgggccacagcgcctaccaggtgctggtgtgcgccttcaacaagggcaagctgaaggtgctggccaccaccttcgacccctacctgggcggcagaaacttcgacgaggccctggtggactacttctgcgacgagttcaagaccaagtacaagatcaacgtgaaggagaacagcagagccctgctgagactgtaccaggagtgcgagaagctgaagaagctgatgagcgccaacgccagcgacctgcccctgaacatcgagtgcttcatgaacgacctggacgtgagcagcaagatgaacagagcccagttcgagcagctgtgcgccagcctgctggccagagtggagccccccctgaaggccgtgatggagcaggccaacctgcagagagaggacatcagcagcatcgagatcgtgggcggcgccaccagaatccccgccgtgaaggagcagatcaccaagttcttcctgaaggacatcagcaccaccctgaacgccgacgaggccgtggccagaggctgcgccctgcagtgcgccatcctgagccccgccttcaaggtgagagagttcagcatcaccgacctggtgccctacagcatcaccctgagatggaagaccagcttcgaggacggcagcggcgagtgcgaggtgttctgcaagaaccaccccgcccccttcagcaaggtgatcaccttccacaagaaggagcccttcgagctggaggccttctacaccaacctgcacgaggtgccctaccccgacgccagaatcggcagcttcaccatccagaacgtgttcccccagagcgacggcgacagcagcaaggtgaaggtgaaggtgagagtgaacatccacggcatcttcagcgtggccagcgccagcgtgatcgagaagcagaacctggagggcgaccacagcgacgcccccatggagaccgagaccagcttcaagaacgagaacaaggacaacatggacaagatgcaggtggaccaggaggagggccaccagaagtgccacgccgagcacacccccgaggaggagatcgaccacaccggcgccaagaccaagagcgccgtgagcgacaagcaggacagactgaaccagaccctgaagaagggcaaggtgaagagcatcgacctgcccatccagagcagcctgtgcagacagctgggccaggacctgctgaacagctacatcgagaacgagggcaagatgatcatgcaggacaagctggagaaggagagaaacgacgccaagaacgccgtggaggagtacgtgtacgacttcagagacagactgggcaccgtgtacgagaagttcatcacccccgaggacctgagcaagctgagcgccgtgctggaggacaccgagaactggctgtacgaggacggcgaggaccagcccaagcaggtgtacgtggacaagctgcaggagctgaagaagtacggccagcccatccagatgaagtacatggagcacgaggagagacccaaggccctgaacgacctgggcaagaagatccagctggtgatgaaggtgatcgaggcctacagaaacaaggacgagagatacgaccacctggaccccaccgagatggagaaggtggagaagtgcatcagcgacgccatgagctggctgaacagcaagatgaacgcccagaacaagctgagcctgacccaggaccccgtggtgaaggtgagcgagatcgtggccaagagcaaggagctggacaacttctgcaaccccatcatctacaagcccaagcccaaggccgaggtgcccgaggacaagcccaaggccaacagcgagcacaacggccccatggacggccagagcggcaccgagaccaagagcgacagcaccaaggacagcagccagcacaccaagagcagcggcgagatggaggtggactag

SEQ ID NO: 12308 - DNA, 5463 bp, Artificial Sequence
  Description of Artificial Sequence: Synthetic coding sequence
atggagcccccccaggagaccaacagacccttcagcaccctggacaacagaagcggccaggtgcaggtgctgagcgccacccccctgctgcagagaaacccctacagcagccccgacatcatgcacatcaagggcagcgaggccagcagcgtgccctacgccctgaaccagggcaccaccgccctgcccaagaacaagaaccaggagggcaccggccacagactgctgaacatgctgagaaagaccctgaaggagagcgacagcgaggagctggagatcacccaggagacccccaacctggtgcccttcggcgacgtggtgggctgcctgggcatccacatcaagaactgcagacacttcatgcccaagatcagcctgcagcactacgccaacctgttcatcagaatcagcatcaacaaggccgtgaagtgcaccaagatgtgcagcctgctgagcaagaacgacgagaagaacaccgtgatcaagttcgacgaggtgaagtacttcagcgtgcaggtgcccagaagatacgacgacaagagaaacaacatcctgctggagctgatccagtacgacaacagagagaagagagccttcctgctgggcagcgtgcagatccacctgtacgaggtgatccagaagggctgcttcatcgaggaggtgcaggtgctgcacggcaacatcttcgtgtgcagactggaggtggagttcatgttcagctacggcaacttcggctacggcttcagccaccagctgaagcccctgcagaagatcaccgagcccagcatgttcatgaacctggcccccccccccgagagaaccgaccccgtgaccaaggtgatcaccccccagaccgtggagtaccccgccttcctgagccccgacctgaacgtgaccgtgggcacccccgccgtgcagagcagcaaccagcccagcgtggtgagactggagaagctgcagcagcagcccagagagagactggagaagatgaagaaggagtacagaaacctgaacacctggatcgacaaggccaactacctggagagcatcctgatgcccaagctggagcacaaggacagcgaggagaccaacatcgacgaggccagcgagaacaccaagagcaaccaccccgaggaggagctggagaacatcgtgggcgtggacatccccctggtgaacgaggaggccgagaccaccgccaacgagctgctggacaacgacagcgagaagggcctgaccatccccaccctgaaccagagcgaccaggacaacagcaccgccgacgccagcaagaacgacgagagcacccccagccccaccgaggtgcacagcctgtgcaccatcagcaaccaggagaccatcaaggccggcagaatcccccccctgggcgagagacagagcgagagcatgcccgacagaaagatgaagaacgtgttcttccccctggaggtgaagctgaaggacaactaccccagcatcctgaaggccgacagcagcctgagcgaggtggccttcagccccaaggagtacaacagccccagcttcagacccgagtacatcgagttcaagcccaagttccagttccagaagttcaacaagaacggcttcgaccccttcctgagaaacatcaacaagatgagcgtgagaaagagaaaggaccaggacatctacaagtacagaaacatcctgggcgccgaggtgatcgagcacgaggaccaggaccccccctaccccgcccagagcaagaccgccggccccgccaacaccacctgggcccacgaccccaacatcttcaccaccaagatgctggagaccgagaacaagctggcccccgaccccaccatcaacaccatcaagggcctggacaccaagaacagcctgaaggagaacctgcccaacgtgagcctgcccagcatcaagggcgagagcagcagagccggcaacgtgcaggccaacacctgccacctgagcaagagcctgaacttcaccccccacatcgagtacctgaagcagagcatgatcctgaagagcatcctgagcgagaacctgcaggacctgagcgacaagctgttcagcaagcccgaggtgagcatgaacagcgaggccagagagaagagcagcagccccctgctgagcatccacgacaagagcagcagcagcatggaggacaacgtgctggagaagaagcaggacctgaacaactggctgagcgagaaggacatcctgaacagcaagaccaccctgagccagatcatcaagaacatccccgccgacagcttcagcgagggcagccagatcatcgagaacatccccgccgacagcctgctggagggcggccaggtgatcaagaacatccccgagtacagcctgagcgagggcggccagatcatcaagaacatccccgccgacagcttcctggagagcggccccggccagagccccgaggtggaggagcacgtgagcaagaagcacttcgaggccgacgagagagacttccccatcaagaagaacagcagcaccaagaagaagcacctgatcagcgaggtgcccaacagcaagagcggcagcagcggcaccgtgcacgactacatcatgagacagatcttcaccgcccccatcttcagcgagctggagatcgaggtgaaggagcccagcgagacccccatgaacctggagaaccagctgcccaccccctggaagagaagcctgagcagccacatcctgttccacgaggagaacgccgacgagatcgagctgccccagcccagaagcgccaccagccagatcatccaggccttccccatcgacaccctgctggagagcggcatcatcaaggtgatcgagctggacaaggagcaccacaagagcagcctgctgggcaccggcatcaccagccccaagggcaacctgaaggacagccaggagtactacagcgagatcagaagcgagaccgagcccctgagcgagcagagcatccccatcatccccaaggacaccaccagcgtgagcagagccgagttcatccaggaggaccagaacatgttcccccaggacagcagctactacagcatcgccaacaaggagctgtacctgcccagaaacggccagagactgtgcaaggacaagaacgacctgagcagcaccctggagagcctgaccaacagcctgatggacaagctgagcgagagcgacgagatcatgctgaagagcttcctgaagaacatcttcaacgtgttcttcaagtacaaccacagcgagagaagaggccagcccgagaaggagctggagagactgatccagcccagcttcaccagcgacaccgagcacctggaggagctgcaggaggacttcgacaaggccgacaagctggacagaaagcccatcctgagccccaagctgagagtgttcctggaggagctgagcgagagcgaggtgaagcacctgaagagcgagctgagcaagcagatccagcactacctggtggagagactgagcgagagcggccacatcaccaaggaggacctgcccaagatctaccagaacctgtacctgatgaacgagaaggccgagcagaagggccccaacagcttccagggcaagtacagcgagaccgtgaaggagatcatgagcttcgtgaacaacttcaaccaccacttcatcgacaagcacctggagatcaagctgagaagcttcctgaaggagatcctgcagaactacttcctgaagaacatcagcgagagcagcctgttcaacgagaccgccagcgagaccatctaccccaacatcagcagcctgagaaccaagagcgtgagcatcagcttccacgagctggagcaggacatcagcaagggcagcttcggcagaagattcgagatcaacatgaagtaccccctgagcaagagcctgcagaactacctgatcgccctgagcgagaacgagctgctgcacctgaaggccgacctgagcaagcacctgcagagcctgttcatcgagaagctgagcaagagcggcctgatgaccaagaagcagctggagggcatcaaccagcacatcaacctgctgaacagcagcagcatccccctgaagtacatcaagacccacctgcccttcagagacgactgccacttcgtggagaagcacagcgagaagcagaacaagtacagcagaatcgtgcagcagaccaccctgcagaccgtgagcgaggacaagctgagagaggccgagctgatcagagagaaggagaagaagtacttccccctgcagaacctgaagggcaacagcagcctgatcaaggagcagaagagctactacaccaaggaggaggccaagacccccagcctgatcaaggtgcagcccagcagcaacgagaacatccaggccagccccctgagcaagagcagcgagatcctgaccgacatcctgctgaagaagctgagaaaggagcacgtgttcacccagctgccccaggccgagaacagcgtgcacaagaccgagatccaggacccctacagctggggcggcaagagcaagatcacccagagcaaggcctggtgcgagaagaccctgaagatgaagagcctggacagaaaggagcacgtgaacatctacaagtggaccgtgcaggagaagcccgaggccgtgctgaccagctaccccagaatccccaacgccagaatgcccagagaggacgagtacctgaacagaatcaccttccccagctggcagagcagcaccctgacccacttcaacaccgagaccggcgagaagagcaagctggaggaccagtactgccagaccctgaagggcaacaacaacaacaacaagaagcacctggtgaccttcgcccagtacaagaaggagatccagaccctgtacatcaagcccgacgagatctgcagcgagaagtgcgccaagttccccgagatccagagcttccagtacaaggtggtggaggacgagaagaacctgaagccccacctgttccccgagctgttcaagatcgaggacctgaagcccaaggtgagaaaggagagagacagagtggcccagcccaagaagagcttcaacaagatcgtgagaatcctgcccaccaccctgcccaccaccagaatccacctgaagaagagcgtgcccagaaccctgctgcactggaccgccagaagaaccatccacgactgcagcgacaagttcgaggacctgcacgacatgaccagcttcacccacctgaagaaggtgaagagcagaagcagactgctgggcaagagcagcgacgacatccacaaccacgccagacacagcgccagaccctacaccgcccccgaggtgaacaagcagagagagagctacagcggcaagttcaccagcagaagaatggtgagcagcggcctggtgcacatcaacgacaagaccagcgactacgagatgcacaagatgagacccaagaagatcaagagaggctactag

SEQ ID NO: 12309 - DNA, 498 bp, Artificial Sequence
  Description of Artificial Sequence: Synthetic coding sequence
atggagcccaccagagactgccccctgttcggcggcgccttcagcgccatcctgcccatgggcgccatcgacgtgagcgacctgagacccgtgcccgacaaccaggaggtgttctgccaccccgtgaccgaccagagcctgatcgtggagctgctggagctgcaggcccacgtgagaggcgaggccgccgccagataccacttcgaggacgtgggcggcgtgcagggcgccagagccgtgcacgtggagagcgtgcagcccctgagcctggagaacctggccctgagaggcagatgccaggaggcctgggtgctgagcggcaagcagcagatcgccaaggagaaccagcaggtgagagccagagagtgcgtgatgagctggaagggcggcagcggcgacgccgagatccaggtgagcatcctgaccctgatccccctgggcagcaagggcagagacaccagcagcggcctggccgaggccgcccccgtgcccgactag

SEQ ID NO: 12310 - DNA, 4482 bp, Artificial Sequence
  Description of Artificial Sequence: Synthetic coding sequence
atggccagcatcacccagctgttcgacgacctgtgcgaggccctgctgcccgccgccaagacccacctgggccagagaagcgtgaacagaaagagagccaagagaagcctgaagaaggtggcctacaacgccctgttcaccaacctgttccaggacgagacccagcagctgcagcccgacatgagcaagctgcccgccagaaacaagatcctgatgctgagcttcgacctgagagtgggcggcctgggccccaaggccgacagactggaggagctggtggaggagctggaggccgccccctgctgccccctgctggaggtgggcagcgtgctggacctgctggtgcagctggccggcagcggccccccccaggtgctgcccagaaagagagactacttcctgaacaacaagcacgtgggcagaaacgtgccctacagcggctacgactgcgacgacctgagcgtgttcgagatggacgtgcagagcctgatcagcagagaggagtgcctgtgccacagcatgatccaggagaccctgcaggtgatggaggccgcccccggcaccggcctgcccaccgtgggcctgttcagcttcggcgacccctgcggcgacagattcgagagagacaccagagtgagcctgttcggcgccctggtgcacagcagaacctacgacatggacgtgagactgggcctgccccccgtgcccgacaacgccgacctgagcggcctggccatcaaggtgccccccagcgtggaccagtgggaggacgagggcttccagagcgccagcaacctgacccccgacagccagagcgagcccagcgtgacccccgacgtggacctgtgggaggccgccctgacctacgaggccagcaagagaagatgctgggagagagtgggctgcccccccggccacagagaggagccctacctgaccgaggccggcagagacgccttcgacaagttctgcagactgcaccagggcgagctgcagctgctggccggcggcgtgctgcaggccccccagcccgtgctggtgaaggagtgcgagctggtgaaggacgtgctgaacgtgctgatcggcgtggtgagcgccaccttcagcctgtgccagcccgcccaggccttcgtggtgaagagaggcgtgcacgtgagcggcgccagccccgagagcatcagcagcctgctgagcgaggtggccgagtacggcacctgctacaccagactgagccacttcagcctgcagcccgtgctggacagcctgtacagcaagggcctggtgttccaggccttcaccagcggcctgagaagatacctgcagtactacagagcctgcgtgctgagcaccccccccaccctgagcctgctgaccatcggcttcctgttcaagaagctgggcagacagctgagatacctggccgagctgtgcggcgtgggcgccgtgctgcccggcacctgcggcggcggccccagagccgccttccccaccggcgtgaagctgctgagctacctgtaccaggaggccctgcacaactgcagcaacgagcactaccccgtgctgctgagcctgctgaagaccagctgcgagccctacaccagattcatccacgactgggtgtacagcggcgtgttcagagacgcctacggcgagttcatgatccaggtgaaccacgagtacctgagcttcagagacaagctgtactggacccacggctacgtgctgatcagcaaggaggtggaggactgcgtgcccgtgttcctgaagcacatcgcccacgacatctacgtgtgcggcaagaccatcaacctgctgaagctgtgctgccccagacactacctgtgctggagcgacgtgcccgtgcccagaatcagcgtgatcttcagcctggaggagctgaaggagatcgagaaggactgcgccgtgtacgtgggcagaatggagagagtggccagacacagcagcgtgagcaaggaggagaaggagctgagaatggagatcgccaagcaggagctgatcgcccacgccagagaggccgccagcagagtgctgagcgccctgagcgacagacagatgagcgagagaatggccctggacgccagaaagagagagcagttccagagactgaaggagcagttcgtgaaggaccaggagagaagacaggccgccagacaggaggagctggacgacgacttcagctacgccagagagctgagagacagagagagaagactgaagagcctggaggaggagctggagagaaaggccagacaggccctggtggaccactacagcaagctgagcgccgaggccgccagaagagagcagaaggccctgtggagaatccagagacacagactggagagcgccagactgagattcctgctggaggacgagaagcacatccaggagatgctgaaggccgtgagcgaggcccaccagccccaggagccccccgacgtgctgctgagcgtgcacccccaggtgaccagccccggccccgagcaccccgagggcggccagggctgcgacagcggcagcgccgagcagcacagccccgcctgggacggctggaacagacccggcctgctgaccccccagcccctgaagcccctggccgtgggcgccggcggcagaggcctgcagcaggccgagggcgccagacccttcagcgacagcctgagcatcggcgacttcctgcccgtgggccccggcgccgagcccagcgtgcagaccggcatggtgcccctgctggaggtggccctgcagaccatcaacctggacctgccccccagcgcccccggcgaggcccccgccgccgccagcacccagcccagcagaccccaggagtacgacttcagcaccgtgctgagacccgccgtggccaccagccccgcccccggccccctgcaggccgccgagtgcagcctgggcagcagcggcctgcagctgtgggaggacagctgcggcaagatggacgcctgcggcagcgccagcagagagaccctgctgcccagccacccccccagaagagccgccctggaggagggcagcagccagcccaccgagagactgttcggccaggtgagcggcggcggcctgcccaccggcgactacgccagcgagatcgcccccaccagacccagatggaacacccacggccacgtgagcgacgccagcatcagagtgggcgagaacgtgagcgacgtggcccccacccagcccagatggaacacccacggccacgtgagcaacgccagcatcagcctgggcgagagcgtgagcgacgtggcccccaccagacccagatggaacatccacggccacgtgagcaacgccagcatcagagtgggcgagaacgtgagcgacgtggcccccaccagacccagatggaacacccacggccacgtgagcaacgccagcatcagagtgggcgagaacgtgagcgacgtggcccccaccagacccagatggaacacccacggccacgtgagcgacgccagcatcagcctgggcgagagcgtgagcgacatggcccccgccagacccagatggaacacccacggccacgtgagcgacgccagcatcagcctgggcgagagcgtgagcgacatggcccccaccagacccagatggaacacccacggccacgtgagcgacaccagcatcagagtgggcgagaacgtgagcgacgtggcccccatcagaagcagatgcaacacccacggccacgtgagcgacgccagcatcagcctgggcgagcccgtgagcgacgtggtgagcaccagacccagatggaacacccacgtgcccatcccccccccccacatggtgctgggcgccctgagccccgaggccgagcccaacacccccagaccccagcagagcccccccggccacaccagccagagcgccctgagcctgggcgcccagagcaccgtgctggactgcggccccagactgcccgtggaggtgggccccagcctgagcagccccagcagcggctgcggcgagggcagcatcagcgtgggcgagaacgtgagcgacgtggcccccacccagccctggtggcccaacacccccggcgacagcgtgagcgaggagctgggccagagcagagtggccggcggccaggagtgggactgcggcacccacagagcctgggaggccctgggcggcgccggcaccctgagaaccagcctgcagatcggcctgagcacccacagaaagacccagctgcccagagccgcccaggccgtggtgagaagaagaagacacagaagaagaagactgagagtgggcagcagacccacctggcaggcctggcagggcagcaccacctggagcggcaccagaaccgtgaccagcccctgccccagcagacccctgctgatcttctgcgccccctgcttccccggccccagccccagcccctggacccccagaagcagcctgcccctgatgagactgctgtgcagctag

SEQ ID NO: 12311 - DNA, 1077 bp, Artificial Sequence; identical to SEQ ID NO: 9480
  Description of Artificial Sequence: Synthetic coding sequence

SEQ ID NO: 12312 - DNA, 2757 bp, Artificial Sequence; identical to SEQ ID NO: 10812
  Description of Artificial Sequence: Synthetic coding sequence

SEQ ID NO: 12313 - DNA, 222 bp, Artificial Sequence
  Description of Artificial Sequence: Synthetic coding sequence
atgagctaccagcagcagcagtgcaagcagccctgccagccccccccccccgtgtgcagactgcccaagagacccgagccctgcccccccctgaagtgccccgagccctgccccccccccaagtgcccccagccctgccccccccagcagtgccagcagaagtaccccctggtgacccccagccccccctgccagcccaagtgcccccccaagagcaagtag

SEQ ID NO: 12314 - DNA, 576 bp, Artificial Sequence; identical to SEQ ID NO: 9211
  Description of Artificial Sequence: Synthetic coding sequence

SEQ ID NO: 12315 - DNA, 60 bp, Artificial Sequence
  Description of Artificial Sequence: Synthetic coding sequence
atgctgaagaacaagggccacagcagcaagaaggacaacctggccgtgaacgccgtgtag

SEQ ID NO: 12316 - DNA, 1026 bp, Artificial Sequence
  Description of Artificial Sequence: Synthetic coding sequence
atggagagcaacttcaaccaggagggcgtgcccagacccagctacgtgttcagcgccgaccccatcgccagacccagcgagatcaacttcgacggcatcaagctggacctgagccacgagttcagcctggtggcccccaacaccgaggccaacagcttcgagagcaaggactacctgcaggtgtgcctgagaatcagacccttcacccagagcgagaaggagctggagagcgagggctgcgtgcacatcctggacagccagaccgtggtgctgaaggagccccagtgcatcctgggcagactgagcgagaagagcagcggccagatggcccagaagttcagcttcagcaaggtgttcggccccgccaccacccagaaggagttcttccagggctgcatcatgcagcccgtgaaggacctgctgaagggccagagcagactgatcttcacctacggcctgaccaacagcggcaagacctacaccttccagggcaccgaggagaacatcggcatcctgcccagaaccctgaacgtgctgttcgacagcctgcaggagagactgtacaccaagatgaacctgaagccccacagaagcagagagtacctgagactgagcagcgagcaggagaaggaggagatcgccagcaagagcgccctgctgagacagatcaaggaggtgaccgtgcacaacgacagcgacgacaccctgtacggcagcctgaccaacagcctgaacatcagcgagttcgaggagagcatcaaggactacgagcaggccaacctgaacatggccaacagcatcaagttcagcgtgtgggtgagcttcttcgagatctacaacgagtacatctacgacctgttcgtgcccgagctggccaagaccaagggcgagctgatcaagaccaaggaggagctgaagaagagagagaacgagagcgacagcctgatccaggagctggagaccagcaacaagaagatcatcacccagaaccagagaatcaaggagctgatcaacatcatcgactag

SEQ ID NO: 12317 - DNA, 27 bp, Artificial Sequence
  Description of Artificial Sequence: Synthetic coding sequence
atggccgacaccgacctgttcatgtag

SEQ ID NO: 12318 - DNA, 2628 bp, Artificial Sequence
  Description of Artificial Sequence: Synthetic coding sequence
atgatgtacaccgtgctgcccgacggcagccccgtgccccagggcatggccctgtacgccccccccccccccctgcccaacaacagcagacccctgacccccggcaccgtggtgtacggccccccccccgccggcgcccccatggtgtacggcccccccccccccaacttcagcatccccttcatccccatgggcgtgctgcactgcaacgtgcccgagcaccacaacctggagaacgaggtgagcagactggaggacatcatgcagcacctgaagagcaagaagagagaggagagatggatgagagccagcaagagacagagcgagaaggagatggaggagctgcaccacaacatcgacgacctgctgcaggagaagaagagcctggagtgcgaggtggaggagctgcacagaaccgtgcagaagagacagcagcagaaggacttcatcgacggcaacgtggagagcctgatgaccgagctggagatcgagaagagcctgaagcaccacgaggacatcgtggacgagatcgagtgcatcgagaagaccctgctgaagagaagaagcgagctgagagaggccgacagactgctggccgaggccgagagcgagctgagctgcaccaaggagaagaccaagaacgccgtggagaagttcaccgacgccaagagaagcctgctgcagaccgagagcgacgccgaggagctggagagaagagcccaggagaccgccgtgaacctggtgaaggccgaccagcagctgagaagcctgcaggccgacgccaaggacctggagcagcacaagatcaagcaggaggagatcctgaaggagatcaacaagatcgtggccgccaaggacagcgacttccagtgcctgagcaagaagaaggagaagctgaccgaggagctgcagaagctgcagaaggacatcgagatggccgagagaaacgaggaccaccacctgcaggtgctgaaggagagcgaggtgctgctgcaggccaagagagccgagctggagaagctgaagagccaggtgaccagccagcagcaggagatggccgtgctggacagacagctgggccacaagaaggaggagctgcacctgctgcagggcagcatggtgcaggccaaggccgacctgcaggaggccctgagactgggcgagaccgaggtgaccgagaagtgcaaccacatcagagaggtgaagagcctgctggaggagctgagcttccagaagggcgagctgaacgtgcagatcagcgagagaaagacccagctgaccctgatcaagcaggagatcgagaaggaggaggagaacctgcaggtggtgctgagacagatgagcaagcacaagaccgagctgaagaacatcctggacatgctgcagctggagaaccacgagctgcagggcctgaagctgcagcacgaccagagagtgagcgagctggagaagacccaggtggccgtgctggaggagaagctggagctggagaacctgcagcagatcagccagcagcagaagggcgagatcgagtggcagaagcagctgctggagagagacaagagagagatcgagagaatgaccgccgagagcagagccctgcagagctgcgtggagtgcctgagcaaggagaaggaggacctgcaggagaagtgcgacatctgggagaagaagctggcccagaccaagagagtgctggccgccgccgaggagaacagcaagatggagcagagcaacctggagaagctggagctgaacgtgagaaagctgcagcaggagctggaccagctgaacagagacaagctgagcctgcacaacgacatcagcgccatgcagcagcagctgcaggagaagagagaggccgtgaacagcctgcaggaggagctggccaacgtgcaggaccacctgaacctggccaagcaggacctgctgcacaccaccaagcaccaggacgtgctgctgagcgagcagaccagactgcagaaggacatcagcgagtgggccaacagattcgaggactgccagaaggaggaggagaccaagcagcagcagctgcaggtgctgcagaacgagatcgaggagaacaagctgaagctggtgcagcaggagatgatgttccagagactgcagaaggagagagagagcgaggagagcaagctggagaccagcaaggtgaccctgaaggagcagcagcaccagctggagaaggagctgaccgaccagaagagcaagctggaccaggtgctgagcaaggtgctggccgccgaggagagagtgagaaccctgcaggaggaggagagatggtgcgagagcctggagaagaccctgagccagaccaagagacagctgagcgagagagagcagcagctggtggagaagagcggcgagctgctggccctgcagaaggaggccgacagcatgagagccgacttcagcctgctgagaaaccagttcctgaccgagagaaagaaggccgagaagcaggtggccagcctgaaggaggccctgaagatccagagaagccagctggagaagaacctgctgaccgccagagaggccgaggcccagaagctgaagaagcaggtgtgcgcccagaaggcccagctggccagcctgggcagagagtag

SEQ ID NO: 12319 - DNA, 1188 bp, Artificial Sequence
  Description of Artificial Sequence: Synthetic coding sequence
atggagcccccccaggagaccaacagacccttcagcaccctggacaacagaagcggccaggtgcaggtgctgagcgccacccccctgctgcagagaaacccctacagcagccccgacatcatgcacatcaagggcagcgaggccagcagcgtgccctacgccctgaaccagggcaccaccgccctgcccaagaacaagaaccaggagggcaccggccacagactgctgaacatgctgagaaagaccctgaaggagagcgacagcgaggagctggagatcacccaggagacccccaacctggtgcccttcggcgacgtggtgggctgcctgggcatccacatcaagaactgcagacacttcatgcccaagatcagcctgcagcactacgccaacctgttcatcagaatcagcatcaacaaggccgtgaagtgcaccaagatgtgcagcctgctgagcaagaacgacgagaagaacaccgtgatcaagttcgacgaggtgaagtacttcagcgtgcaggtgcccagaagatacgacgacaagagaaacaacatcctgctggagctgatccagtacgacaacagagagaagagagccttcctgctgggcagcgtgcagatccacctgtacgaggtgatccagaagggctgcttcatcgaggaggtgcaggtgctgcacggcaacatcttcgtgtgcagactggaggtggagttcatgttcagctacggcaacttcggctacggcttcagccaccagctgaagcccctgcagaagatcaccgagcccagcatgttcatgaacctggcccccccccccgagagaaccgaccccgtgaccaaggtgatcaccccccagaccgtggagtaccccgccttcctgagccccgacctgaacgtgaccgtgggcacccccgccgtgcagagcagcaaccagcccagcgtggtgagactggagaagctgcagcagcagcccagagagagactggagaagatgaagaaggagtacagaaacctgaacacctggatcgacaaggccaactacctggagagcatcctgatgcccaagctggagcacaaggacagcgaggagaccaacatcgacgaggccagcgagaacaccaagagcaaccaccccgaggaggagctggagaacatcgtgggcgtgggcggcttcttcaccaagagaatctag

SEQ ID NO: 12320 - DNA, 282 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagatag

SEQ ID NO: 12321 - DNA, 558 bp, Artificial Sequence
  Description of Artificial Sequence: Synthetic coding sequence
atggccgccagcgtggagcagagagagggcaccatccaggtgcagggccaggccctgttcttcagagaggccctgcccggcagcggccaggccagattcagcgtgctgctgctgcacggcatcagattcagcagcgagacctggcagaacctgggcaccctgcacagactggcccaggccggctacagagccgtggccatcgacctgcccggcctgggccacagcaaggaggccgccgcccccgcccccatcggcgagctggcccccggcagcttcctggccgccgtggtggacgccctggagctgggcccccccgtggtgcccgtggcccccatctgcaccgacaagatcaacgccgccaactacgccagcgtgaagacccccgccctgatcgtgtacggcgaccaggaccccatgggccagaccagcttcgagcacctgaagcagctgcccaaccacagagtgctgatcatgaagggcgccggccacccctgctacctggacaagcccgaggagtggcacaccggcctgctggacttcctgcagggcctgcagtag

SEQ ID NO: 12322 - DNA, 1443 bp, Artificial Sequence
  Description of Artificial Sequence: Synthetic coding sequence
atgctggagagaccccccgccctggccatgcccatgcccaccgagggcacccccccccccctgagcggcacccccatccccgtgcccgcctacttcagacacgccgagcccggcttcagcctgaagagacccagaggcctgagcagaagcctgcccccccccccccccgccaagggcagcatccccatcagcagactgttcccccccagaacccccggctggcaccagctgcagcccagaagagtgagcttcagaggcgaggccagcgagaccctgcagagccccggctacgaccccagcagacccgagagcttcttccagcagagcttccagagactgagcagactgggccacggcagctacggcgaggtgttcaaggtgagaagcaaggaggacggcagactgtacgccgtgaagagaagcatgagccccttcagaggccccaaggacagagccagaaagctggccgaggtgggcagccacgagaaggtgggccagcacccctgctgcgtgagactggagcaggcctgggaggagggcggcatcctgtacctgcagaccgagctgtgcggccccagcctgcagcagcactgcgaggcctggggcgccagcctgcccgaggcccaggtgtggggctacctgagagacaccctgctggccctggcccacctgcacagccagggcctggtgcacctggacgtgaagcccgccaacatcttcctgggccccagaggcagatgcaagctgggcgacttcggcctgctggtggagctgggcaccgccggcgccggcgaggtgcaggagggcgaccccagatacatggcccccgagctgctgcagggcagctacggcaccgccgccgacgtgttcagcctgggcctgaccatcctggaggtggcctgcaacatggagctgccccacggcggcgagggctggcagcagctgagacagggctacctgccccccgagttcaccgccggcctgagcagcgagctgagaagcgtgctggtgatgatgctggagcccgaccccaagctgagagccaccgccgaggccctgctggccctgcccgtgctgagacagcccagagcctggggcgtgctgtggtgcatggccgccgaggccctgagcagaggctgggccctgtggcaggccctgctggccctgctgtgctggctgtggcacggcctggcccaccccgccagctggctgcagcccctgggcccccccgccaccccccccggcagccccccctgcagcctgctgctggacagcagcctgagcagcaactgggacgacgacagcctgggccccggccaccccccctgcctggcctgcccccccgccggcctgcacagccccctgagactgagctggcccggcctgtggggcgccccccccccccccggcgccggcgcccaccccggcatgccctggacctag

SEQ ID NO: 12323 - DNA, 1740 bp, Artificial Sequence; identical to SEQ ID NO: 12040
  Description of Artificial Sequence: Synthetic coding sequence

SEQ ID NO: 12324 - DNA, 975 bp, Artificial Sequence
  Description of Artificial Sequence: Synthetic coding sequence
atggaggccctgggccccggcggcgacagagccagccccgccagcagcaccagcagcctggacctgtggcacctgagcatgagagccgacagcgcctacagcagcttcagcgccgccagcggcggccccgagcccagaacccagagccccggcaccgacctgctgccctacctggactgggactacgtgagagtggtgtggggcggccccggccccgccccccccgacgccgccctgtgcaccagccccagacccagacccgccgtggccgccagaagcggcccccagcccaccgaggtgcccggcacccccggccccctgaacagacaggccacccccctgctgtacgccctggccgccgaggccgaggccgccgcccaggccgccgagccccccagcccccccgccagcagagccgcctacagacagagactgcagggcgcccagagaagagtgctgagagagaccagcttccagagaaaggagctgagaatgagcctgcccgccagactgagacccaccgtgcccgccagaccccccgccacccaccccagaagcgccagcctgagccaccccggcggcgagggcgagcccgccagaagcagagcccccgcccccggcaccgccggcagaggccccctggccaaccagcagagaaagtggtgcttcagcgagcccggcaagctggacagagtgggcagaggcggcggccccgccagagagtgcctgggcgaggcctgcagcagcagcggcctgcccggccccgagcccctggagttccagcaccccgccctggccaagttcgaggaccacgaggtgggctggctgcccgagacccagccccagggcagcatgaacctggacagcggcagcctgaagctgggcgacgccttcagacccgccagcagaagcagaagcgccagcggcgaggtgctgggcagctggggcggcagcggcggcaccatccccatctag

SEQ ID NO: 12325 - DNA, 780 bp, Artificial Sequence
  Description of Artificial Sequence: Synthetic coding sequence
atgcccagagccagaagcggcagaagaagcagaggcgccggcggcagagaggagaccttcctgagagtgagagccaacagacagaccagactgaacgccagaatcggcaagatgaagagaagaaagcaggacgagggccagagagagggcagctgcatggccgaggacgacgccgtggacatcgagcacgagaacaacaacagattcgaggagtacgagtggtgcggccagaagagaatcagagccaccaccctgctggagggcggcttcagaggcagcggcttcatcatgtgcagcggcaaggagaaccccgacagcgacgccgacctggacgtggacggcgacgacaccctggagtacggcaagccccagtacaccgaggccgacgtgatcccctgcaccggcgaggagcccggcgaggccaaggagagagaggccctgagaggcgccgtgctgaacggcggcccccccagcaccagaatcacccccgagttcagcaagtgggccagcgacgagatgcccagcaccagcaacggcgagagcagcaagcaggaggccatgcagaagacctgcaagaacagcgacatcgagaagatcaccgaggacagcgccgtgaccaccttcgaggccctgaaggccagagtgagagagctggagagacagctgagcagaggcgacagatacaagtgcctgatctgcatggacagctacagcatgcccctgaccagcatccagtgctggcacgtgcactgcgaggagtgctggctgagaaccctgtag

SEQ ID NO: 12326 - DNA, 369 bp, Artificial Sequence; identical to SEQ ID NO: 12080
  Description of Artificial Sequence: Synthetic coding sequence

SEQ ID NO: 12327 - DNA, 984 bp, Artificial Sequence
  Description of Artificial Sequence: Synthetic coding sequence
atggccagcttcctgaagggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12328 - DNA, 438 bp, Artificial Sequence
  Description of Artificial Sequence: Synthetic coding sequence
atgcagggcagaatcaccaaggtgctgaacatgaagccccccgagatcctgagcatgatcgaggaggccgccggcaccagaatgtacgagtacaagaagatcgccgcccagaagaccatcgagaagaaggaggccaagctgaaggagatcaagaccatcctggaggaggagatcacccccaccatccagaagctgaaggaggagagaagcagctacctggagtaccagaaggtgatgagagagatcgagcacctgagcagactgtacatcgcctaccagttcctgctggccgaggacaccaaggtgagaagcgccgaggagctgaaggagatgcaggacaaggtgatcaagctgcaggaggagctgagcgagaacgacaagaagatcaaggccctgaaccacgagatcgaggagctggagaagagaaaggacaagtag

SEQ ID NO: 12329 - DNA, 816 bp, Artificial Sequence
  Description of Artificial Sequence: Synthetic coding sequence
atggagaaggagaccggcatcagccagcagagaaactactacttcacccagagcaagggcgagcccctgcagatcgaccacctggtgttcgtggtgcacggcatcggccccgcctgcgacctgagattcagaagcatcgtgcagtgcgtgaacgacttcagaagcgtgagcctgaacctgctgcagacccacttcaagaaggcccaggagaaccagcagatcggcagagtggagttcctgcccgtgaactggcacagccccctgcacagcaccggcgtggacgtggacctgcagagaatcaccctgcccagcatcaacagactgagacacttcaccaacgacaccatcctggacgtgttcttctacaacagccccacctactgccagaccatcgtggacaccgtggccagcgagatgaacagaatctacaccctgttcctgcagagaaaccccgacttcaagggcggcgtgagcatcgccggccacagcctgggcagcctgatcctgttcgacatcctgaccaaccagaaggacagcctgggcgacatcgacagcgagaaggacagcctgaacatcgtgatggaccagggcgacacccccaccctggaggaggacctgaagaagctgcagctgagcgagttcttcgacatcttcgagaaggagaaggtggacaaggaggccctggccctgtgcaccgacagagacctgcaggagatcggcatccccctgggccccagaaagaacctgagcagcgccgtggccgtgatcctggagatggtgaccatctggatgctggccctgggcagatgcctgtag

SEQ ID NO: 12330 - DNA, 1818 bp, Artificial Sequence; identical to SEQ ID NO: 11555
  Description of Artificial Sequence: Synthetic coding sequence

SEQ ID NO: 12331 - DNA, 294 bp, Artificial Sequence
  Description of Artificial Sequence: Synthetic coding sequence
atgcagaccagcagcagcagaagcgtgcacctgagcgagtggcagaagaactacttcgccatcaccagcggcatctgcaccggccccaaggccgacgcctacagagcccagatcctgagaatccagtacgcctgggccaacagcgagatcagccaggtgtgcgccaccaagctgttcaagaagtacgccgagaagtacagcgccatcatcgacagcgacaacgtggagagcggcctgaacaactacgccgagaacatcctgaccctggccggcagccagcagaccgacagctag

SEQ ID NO: 12332 - DNA, 333 bp, Artificial Sequence; identical to SEQ ID NO: 10461
  Description of Artificial Sequence: Synthetic coding sequence

SEQ ID NO: 12333 - DNA, 627 bp, Artificial Sequence
  Description of Artificial Sequence: Synthetic coding sequence
atggagccccccatggagcccagcggcggcgagcaggagcccggcgccgtgagattcctggacctgccctgggaggacgtgctgctgccccacgtgctgaacagagtgcccctgagacagctgctgagactgcagagagtgagcagagccttcagaagcctggtgcagctgcacctggccggcctgagaagattcgacgccgcccaggtgggcccccagatccccagagccgccctggccagactgctgagagacgccgagggcctgcaggagctggccctggccccctgccacgagtggctgagcgacgaggacctggtgcccgtgctggccagaaacccccagctgagaagcgtggccctgggcggctgcggccagctgagcagaagagccctgggcgccctggccgagggctgccccagactgcagagactgagcctggcccactgcgactgggtggacggcctggccctgagaggcctggccgacagatgccccgccctggaggagctggacctgaccgcctgcagacagctgaaggacgaggccatcgtgtacctggcccagagaagaggcgccggcctgagaagcctgagcctggccgtgaacgccaacgtgggcgactag

SEQ ID NO: 12334 - DNA, 1419 bp, Artificial Sequence
  Description of Artificial Sequence: Synthetic coding sequence
gtgacccactacaagcagtacccccccaacaccagcaaggtgtacagctacttcgagtgcagagagaagaagaccgagaacagcaagctgagaaaggtgaagtacgaggagaccgtgttctacggcctgcagtacatcctgaacaagtacctgaagggcaaggtggtgaccaaggagaagatccaggaggccaaggacgtgtacaaggagcacttccaggacgacgtggtgaacgagaagggctggaactacatcctggagaagtacgacggccacctgcccatcgagatcaaggccgtgcccgagggcttcgtgatccccagaggcaacgtgctgttcaccgtggagaacaccgaccccgagtgctactggctgaccaactggatcgagaccatcctggtgcagagctggtaccccatcaccgtggccaccaacagcagagagcagaagaagatcctggccaagtacctgctggagaccagcggcaacctggacggcctggagtacaagctgcacgacttcggctacagaggcgtgagcagccaggagaccgccggcatcggcgccagcgcccacctggtgaacttcaagggcaccgacaccgtggccggcctggccctgaacaagaagtactacggcaccaaggaccccgtgcccggctacagcgtgcccgccgccgagcacagcaccatcaccgcctggggcaaggaccacgagaaggacgccttcgagcacatcgtgacccagttcagcagcgtgcccgtgagcgtggtgagcaacagctacgacatctacaacgcctgcgagaagatctggggcgaggacctgagacacctgatcgtgagcagaagcacccaggcccccctgatcatcagacccgacagcggcaaccccctggacaccgtgctgaaggtgctggagatcctgggcaagaagttccccgtgaccgagaacagcaagggctacaagctgctgcccccctacctgagagtgatccagggcgacggcgtggacatcaacaccctgcaggagatcgtggagggcatgaagcagaagatgtggagcatcgagaacatcgccttcggcagcggcggcggcctgctgcagaagctgaccagagacctgctgaactgcagcttcaagtgcagctacgtggtgaccaacggcctgggcatcaacgtgttcaaggaccccgtggccgaccccaacaagagaagcaagaagggcagactgagcctgcacagaacccccgccggcaacttcgtgaccctggaggagggcaagggcgacctggaggagtacggccaggacctgctgcacaccgtgttcaagaacggcaaggtgaccaagagctacagcttcgacgagatcagaaagaacgcccagctgaacatcgagctggaggccgcccaccactag

SEQ ID NO: 12335 - DNA, 519 bp, Artificial Sequence
  Description of Artificial Sequence: Synthetic coding sequence
tgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccgaccagggcatcaacatctacagaaagccccccatctacaagcagcacgtgctgttcgaggtgatcctgctgctgctgatctag

SEQ ID NO: 12336 - DNA, 2445 bp, Artificial Sequence
  Description of Artificial Sequence: Synthetic coding sequence
atgagactgctggacggcaagcagaccagcagatacagcgagaacgcctgcgagaagaagatcttcagcatctacggccactaccccgtggtgagagccgccctgagaagaaagggctgggtggagaagaagttccacttcctgcccaaggtgatccccgacgtggaggacgagggcgccagagtgaacgacgacacctgcgccaaggtgaaggagaaccaggagatggccctggagaagaccgacaacatccacgacgtgatgagcagactggtgaagaacgagatgccctacctgctgtggaccatcaagagagacatcatcgactaccacagcctgacctacgaccagatgctgaaccactacgccaagaccgccagcttcaccaccaagatcggcctgtgcgtgaacatgagaagcctgccctggtacgtgcccgccaaccccgacagcttcttccccagatgctacagcctgtgcaccgagagcgagcagcaggagttcctggaggacttcagaagaaccatggccagcagcatcctgaagtgggtggtgagccaccagagctgcagcagaagcagcagaagcaagcccagagaccagagagaggaggccggcagcagcgacctgagcagcagacaggacgccgagaacgccgaggccaagctgagaggcctgcccggccagctggtggacatcgcctgcaaggtgtgccaggcctacctgggccagctggagcacgaggacatcgacaccagcgccgacgccgtggaggacctgaccgaggccgagtgggaggacctgacccagcagtactacagcctggtgcacggcgacgccttcatcagcaacagcagaaactacttcagccagtgccaggccctgctgaacagaatcaccagcgtgaacccccagaccgacatcgacggcctgagaaacatctggatcatcaagcccgccgccaagagcagaggcagagacatcgtgtgcatggacagagtggaggagatcctggagctggccgccgccgaccaccccctgagcagagacaacaagtgggtggtgcagaagtacatcgagacccccctgctgatctgcgacaccaagttcgacatcagacagtggttcctggtgaccgactggaaccccctgaccatctggttctacaaggagagctacctgagattcagcacccagagattcagcctggacaagctggacagcgccatccacctgtgcaacaacgccgtgcagaagtacctgaagaacgacgtgggcagaagccccctgctgcccgcccacaacatgtggaccagcaccagattccaggagtacctgcagagacagggcagaggcgccgtgtggggcagcgtgatctaccccagcatgaagaaggccatcgcccacgccatgaaggtggcccaggaccacgtggagcccagaaagaacagcttcgagctgtacggcgccgacttcgtgctgggcagagacttcagaccctggctgatcgagatcaacagcagccccaccatgcaccccagcacccccgtgaccgcccagctgtgcgcccaggtgcaggaggacaccatcaaggtggccgtggacagaagctgcgacatcggcaacttcgagctgctgtggagacagcccgtggtggagcccccccccttcagcggcagcgacctgtgcgtggccggcgtgagcgtgagaagagccagaagacaggtgctgcccgtgtgcaacctgaaggccagcgccagcctgctggacgcccagcccctgaaggccagaggccccagcgccatgcccgaccccgcccagggcccccccagccccgccctgcagagagacctgggcctgaaggaggagaagggcctgcccctggccctgctggcccccctgagaggcgccgccgagagcggcggcgccgcccagcccaccagaaccaaggccgccggcaaggtggagctgcccgcctgcccctgcagacacgtggacagccaggcccccaacaccggcgtgcccgtggcccagcccgccaagagctgggaccccaaccagctgaacgcccaccccctggagcccgtgctgagaggcctgaagaccgccgagggcgccctgagacccccccccggcggcaagggcgagggcaccgtgtgcagcagactgccccaccacggccaccacgtggccgcctgccagaccaccggcaccacctgggacggcggccccggcgtgtgcttcctgagacagctgctggccagcgagctgcccatgggccccggcctgcccagagaccccagagcccccccctgcctggtgtgcagaggcctgctgccccccgccggcccctgcaagagatgcagaagcttctgcgccgccgtgctgcagggcgccagcttcgtgagactgggcggcagaagctgcagccccagaaccccctag

SEQ ID NO: 12337 - DNA, 318 bp, Artificial Sequence
  Description of Artificial Sequence: Synthetic coding sequence
atggacaagaacatcggcgagcagctgaacaaggcctacgaggccttcagacaggcctgcatggacagagacagcgccgtgaaggagctgcagcagaagaccgagaactacgagcagagaatcagagagcagcaggagcagctgagcctgcagcagaccatcatcgacaagctgaagagccagctgctgctggtgaacagcacccaggacaacaactacggctgcgtgcccctgctggaggacagcgagaccagaaagaacaacctgaccctggaccagccccaggacaaggtgatcagcggcatcgccagagagtag

SEQ ID NO: 12338 - DNA, 816 bp, Artificial Sequence
  Description of Artificial Sequence: Synthetic coding sequence
atggcccccgtgggcgtggagaagaagctgctgctgggccccaacggccccgccgtggccgccgccggcgacctgaccagcgaggaggaggagggccagagcctgtggagcagcatcctgagcgaggtgagcaccagagccagaagcaagctgcccagcggcaagaacatcctggtgttcgaccacaccagatgcaacgtgtggatcctggacggcgacctgtaccacaagggcctgctgaagttcgccgtgagcgccgagagcctgcccgagaccctggtgatcttcgtggccgacatgagcagaccctggaccgtgatggagagcctgcagaagtgggccagcgtgctgagagagcacatcgacaagatgaagatcccccccgagaagatgagagagctggagagaaagttcgtgaaggacttccaggactacatggagcccgaggagggctgccagggcagcccccagagaagaggccccctgaccagcggcagcgacgaggagaacgtggccctgcccctgggcgacaacgtgctgacccacaacctgggcatccccgtgctggtggtgtgcaccaagtgcgacgccgtgagcgtgctggagaaggagcacgactacagagacgagcacctggacttcatccagagccacctgagaagattctgcctgcagtacggcgccgccctgatctacaccagcgtgaaggaggagaagaacctggacctgctgtacaagtacatcgtgcacaagacctacggcttccacttcaccacccccgccctggtggtggagaaggacgccgtgttcatgtag

SEQ ID NO: 12339 - DNA, 522 bp, Artificial Sequence
  Description of Artificial Sequence: Synthetic coding sequence
atggccgacagaatgcagatcgtggtgatcctgagcgagttcttcaacaccacctggcaggaggccaactgcgccaactgcctgaccaacaacagcgaggagctgagcaacagcaccgtgtacttcctgaacctgttcaaccacaccctgacctgcttcgagcacaacctgcagggcaacgcccacagcctgctgcagaccaagaactacagcgaggtgtgcaagaactgcagagaggcctacaagaccctgagcagcctgtacagcgagatgcagaagatgaacgagctggagaacaaggccgagcccggcacccacctgtgcatcgacgtggaggacgccatgaacatcaccagaaagctgtggagcagaaccttcaactgcagcgtgccctgcagcgacaccgtgcccgtgatcgccgtgagcgtgttcatcctgttcctgcccgtggtgttctacctgagcagcttcctgcacagcgagcagaagaagagaaagctgatcctgcccaagagactgtag

SEQ ID NO: 12340 - DNA, 435 bp, Artificial Sequence
  Description of Artificial Sequence: Synthetic coding sequence
tgattcatccactgcaccgacgacagccccgacccctgcatcgagtacgagctggtgctgagaaagtggtgcgagctgatccccggcgccgagttcagatgcttcgtgaaggagaacaagctgatcggcatcagccagagagactacacccagtactacgaccacatcagcaagcagaaggaggagatcagaagatgcatccaggacttcttcaagaagcacatccagtacaagttcctggacgaggacttcgtgttcgacatctacagagacagcagaggcaaggtgtggctgatcgacttcaaccccttcggcgaggtgaccgacagcctgctgttcacctgggaggagctgatcagcgagaacaacctgaacggcgacttcagcgaggtggacgcccaggagcagaagagaaaccagcaggaggacgactag

SEQ ID NO: 12341 - DNA, 978 bp, Artificial Sequence
  Description of Artificial Sequence: Synthetic coding sequence
tgaatccagggcgaggccagcagaagagccgccggcgagcccgaggccggcagcgactacgtgaagttcagcaaggagaagtacatcctggacagcagccccgagaagctgcacaaggagctggaggaggagctgaagctgagcagcaccgacctgagaagccacgcctggtaccacggcagaatccccagagaggtgagcgagaccctggtgcagagaaacggcgacttcctgatcagagacagcctgaccagcctgggcgactacgtgctgacctgcagatggagaaaccaggccctgcacttcaagatcaacaaggtggtggtgaaggccggcgagagctacacccacatccagtacctgttcgagcaggagagcttcgaccacgtgcccgccctggtgagataccacgtgggcagcagaaaggccgtgagcgagcagagcggcgccatcatctactgccccgtgaacagaaccttccccctgagatacctggaggccagctacggcctgggccagggcagcagcaagcccgccagccccgtgagccccagcggccccaagggcagccacatgaagagaagaagcgtgaccatgaccgacggcctgaccgccgacaaggtgaccagaagcgacggctgccccaccagcaccagcctgcccagacccagagacagcatcagaagctgcgccctgagcatggaccagatccccgacctgcacagccccatgagccccatcagcgagagccccagcagccccgcctacagcaccgtgaccagagtgcacgccgcccccgccgcccccagcgccaccgccctgcccgccagccccgtggccagaagaagcagcgagccccagctgtgccccggcagcgcccccaagacccacggcgagagcgacaagggcccccacaccagccccagccacaccctgggcaaggccagccccagccccagcctgagcagctacagctag

SEQ ID NO: 12342 - DNA, 330 bp, Artificial Sequence
  Description of Artificial Sequence: Synthetic coding sequence
atgagcagcaagggcagcagcaccgacggcagaaccgacctggccaacggcagcctgagcagcagccccgaggagatgagcggcgccgaggagggcagagagaccagcagcggcatcgaggtggaggccagcgacctgagcctgagcctgaccggcgacgacggcggccccaacagaaccagcaccgagagcagaggcaccgacaccgagagcagcggcgaggacaaggacagcgacagcatggaggacaccggccactacagcatcaacgacgagaacagagtgcacgacagaagcgaggaggaggaggaggaggaggaggaggagtag

SEQ ID NO: 12343 - DNA, 1638 bp, Artificial Sequence
  Description of Artificial Sequence: Synthetic coding sequence
gccgccggcgcccccagactgctgggccccggcgccgtgagaggccccgccggcgtgggcagagtggccgccggcgccatggagggcgtgctgtacaagtggaccaactacctgagcggctggcagcccagatggttcctgctgtgcggcggcatcctgagctactacgacagccccgaggacgcctggaagggctgcaagggcagcatccagatggccgtgtgcgagatccaggtgcacagcgtggacaacaccagaatggacctgatcatccccggcgagcagtacttctacctgaaggccagaagcgtggccgagagacagagatggctggtggccctgggcagcgccaaggcctgcctgaccgacagcagaacccagaaggagaaggagttcgccgagaacaccgagaacctgaagaccaagatgagcgagctgagactgtactgcgacctgctggtgcagcaggtggacaagaccaaggaggtgaccaccaccggcgtgagcaacagcgaggagggcatcgacgtgggcaccctgctgaagagcacctgcaacaccttcctgaagaccctggaggagtgcatgcagatcgccaacgccgccttcaccagcgagctgctgtacagaaccccccccggcagcccccagctggccatgctgaagagcagcaagatgaagcaccccatcatccccatccacaacagcctggagagacagatggagctgagcacctgcgagaacggcagcctgaacatggagatcaacggcgaggaggagatcctgatgaagaacaagaacagcctgtacctgaagagcgccgagatcgactgcagcatcagcagcgaggagaacaccgacgacaacatcaccgtgcagggcgagatcagaaaggaggacggcatggagaacctgaagaaccacgacaacaacctgacccagagcggcagcgacagcagctgcagccccgagtgcctgtgggaggagggcaaggaggtgatccccaccttcttcagcaccatgaacaccagcttcagcgacatcgagctgctggaggacagcggcatccccaccgaggccttcctggccagctgctacgccgtggtgcccgtgctggacaagctgggccccaccgtgttcgcccccgtgaagatggacctggtgggcaacatcaagaaggtgaaccagaagtacatcaccaacaaggaggagttcaccaccctgcagaagatcgtgctgcacgaggtggaggccgacgtggcccaggtgagaaacagcgccaccgaggccctgctgtggctgaagagaggcctgaagttcctgaagggcttcctgaccgaggtgaagaacggcgagaaggacatccagaccgccctgaacaacgcctacggcaagaccctgagacagcaccacggctgggtggtgagaggcgtgttcgccctggccctgagagccgcccccagctacgaggacttcgtggccgccctgaccgtgaaggagggcgaccaccagaaggaggccttcagcatcggcatgcagagagacctgagcctgtacctgcccgccatggagaagcagctggccatcctggacaccctgtacgaggtgcacggcctggagagcgacgaggtggtgtag

SEQ ID NO: 12344 - DNA, 522 bp, Artificial Sequence
  Description of Artificial Sequence: Synthetic coding sequence
atgtacaccctgctgagcggcctgtacaagtacatgttccagaaggacgagtactgcatcctgatcctgggcctggacaacgccggcaagaccaccttcctggagcagagcaagaccagattcaacaagaactacaagggcatgagcctgagcaagatcaccaccaccgtgggcctgaacatcggcaccgtggacgtgggcaaggccagactgatgttctgggacctgggcggccaggaggagctgcagagcctgtgggacaagtactacgccgagtgccacggcgtgatctacgtgatcgacagcaccgacgaggagagactggccgagagcaagcaggccttcgagaaggtggtgaccagcgaggccctgtgcggcgtgcccgtgctggtgctggccaacaagcaggacgtggagacctgcctgagcatccccgacatcaagaccgccttcagcgactgcaccagcaagatcggcagaagagactgcctgacccaggcctgcagcgccctgaccggctag

SEQ ID NO: 12345 - DNA, 729 bp, Artificial Sequence
  Description of Artificial Sequence: Synthetic coding sequence
atgggcctggtgtgcgtgctgggcgacggcaagaccgagcagaagggcggcgacaagaagagaggcgtgaagagacccagagaggaccacggcagaggctacttcgagtacatcgaggagaacaagtacagcagagccaagagcccccagccccccgtggaggaggaggacgagcacttcgacgacaccgtggtgtgcctggacacctacaactgcgacctgcacttcaagatcagcagagacagactgagcgccagcagcctgaccatggagagcttcgccttcctgtgggccggcggcagagccagctacggcgtgagcaagggcaaggtgtgcttcgagatgaaggtgaccgagaagatccccgtgagacacctgtacaccaaggacatcgacatccacgaggtgagaatcggctggagcctgaccaccagcggcatgctgctgggcgaggaggagttcagctacggctacagcctgaagggcatcaagacctgcaactgcgagaccgaggactacggcgagaagttcgacgagaacgacgtgatcacctgcttcgccaacttcgagagcgacgaggtggagctgagctacgccaagaacggccaggacctgggcgtggccttcaagatcagcaaggaggtgctggccggcagacccctgttcccccacgtgctgtgccacaactgcgccgtggagttcaacttcggccagaaggagaagccctag

SEQ ID NO: 12346 - DNA, 2922 bp, Artificial Sequence
  Description of Artificial Sequence: Synthetic coding sequence
agcagcagcgacaaggagagcatcctgaccatcctgaaggtgctgggcgacctgctgagcgtgggcaccgacagaagaatccactacatgatcagcaagggcggcagcgaggccctgctgcagaccctggtggacaccgccagaaccgccccccccgactacgacatcctgctgcccctgttcagactgctggccaaggtgggcctgagagacaagaagatcggcagaaaggccctggagctggaggccctggacgtgaccctgatcctggccagaaagaacctgagccacggccagaacctgctgcactgcctgtgggccctgagagtgttcgccagcagcgtgagcatgggcgccatgctgggcatcaacggcgccatggagctgctgttcaaggtgatcaccccctacaccagaaagagaacccaggccatcagagccgccaccgaggtgctggccgccctgctgaagagcaagagcaacggcagaagagccgtgaacagaggctacgtgaccagcctgctgggcctgcaccaggactggcacagccacgacaccgccaacgcctacgtgcagatcagaagaggcctgctgctgtgcctgagacacatcgccgccctgagaagcggcagagaggccttcctggccgcccagggcatggagatcctgttcagcaccacccagaactgcctggacgacaagagcatggagcccgtgatcagcgtggtgctgcagatcctgagacagtgctaccccaccagccccctgcccctggtgaccgccagcagcgcctacgccttccccgtgcccggctgcatcaccaccgagcccccccacgacctgcccgaggaggacttcgaggacgacggcgacgacgaggtggacaaggacagcgacaccgaggacggcaaggtggaggacgacgacctggagaccgacgtgaacaagctgagcagcaagcccggcctggacagacccgaggaggagctgatgcagtacgaggtgatgtgcctggagctgagctacagcttcgaggagctgcagagcaagctgggcgacgacctgaacagcgagaagacccagtacgccaaccaccaccacatccccgccgccgccagcagcaagcagcactgctacagcaaggaccagagcagctgcggccaggagagagagtacgccgtgcagaccagcctgctgtgcagagtgaagaccggcagaagcaccgtgcacctgggcagcaagaagaaccccggcgtgaacctgtaccagaacgtgcagagcaacagcctgagaagagacagcagcgagagcgagatccccgacatccaggccagccccaaggccgacgcctgggacgtggacgccatcttctgccccagaatgagcgccagcttcagcaacagcaccagaaccagagaggtggtgaaggtgatcgacaagctgctgcagacccacctgaagagagtgcccttccacgacccctacctgtacatggccaaggccagaagaaccagcagcgtggtggacttcaagatgatggccttccccgacgtgtggggccactgccccccccccaccacccagcccatgctggagagaaagtgcggcgtgcagagaatcagaatcttcgaggacatcagaagactgatccagcccagcgacgtgatcaacaaggtggtgttcagcctggacgagccctggcccctgcaggacaacgccagcaactgcctgagattcttcagcaagttcgagagcggcaacctgagaaaggccatccaggtgagagagttcgagtacgacctgctggtgaacgccgacgtgaacagcacccagcaccagcagtggttctacttcaaggtgagcggcatgcaggccgccatcccctaccacttcaacatcatcaactgcgagaagcccaacagccagttcaactacggcatgcagcccaccctgtacagcgtgaaggaggccctgctgggcaagcccacctggatcagaaccggccacgagatctgctactacaagaaccactacagacagagcaccgccgtggccggcggcgccagcggcaagtgctactacaccctgaccttcgccgtgaccttcccccacagcgaggacgtgtgctacctggcctaccactacccctacacctacaccgccctgatgacccacctggacatcctggagaagagcgtgaacctgaaggaggtgtacttcagacaggacgtgctgtgccagaccctgggcggcaacccctgccccctggtgaccatcaccgccatgcccgagagcaacagcgacgagcacctggagcagttcagacacagaccctaccaggtgatcaccgccagagtgcaccccggcgagagcaacgccagctgggtgatgaagggcaccctggagttcctggtgagcagcgaccccgtggccagactgctgagagagaacttcatcttcaagatcatccccatgctgaaccccgacggcgtgatcaacggcaaccacagatgcagcctgagcggcgaggacctgaacagacagtggctgagccccagcgcccacctgcagcccaccatctaccacgccaagggcctgctgtaccacctgagcagcatcggcagaagccccgtggtgagccacttcctgctggtgttctgcgacttccacggccacagccagaagaagaacgtgttcctgtacggctgcagcatcaaggagaccctgtggcaggccgcctgcaccgtgggcaccagcaccatcctggaggaggtgaactacagaaccctgcccaagatcctggacaagctggcccccgccttcaccatgagcagctgcagcttcctggtggagaagagcagagccagcaccgccagagtggtggtgtggagagagatgggcgtgagcagaagctacacctag

SEQ ID NO: 12347 - DNA, 7752 bp, Artificial Sequence
  Description of Artificial Sequence: Synthetic coding sequence
tgaagcagcatcaccttcagcgtgaaggtggagggcagacccgtgcccaccgtgcactggctgagagaggaggccgagagaggcgtgctgtggatcggccccgacacccccggctacaccgtggccagcagcgcccagcagcacagcctggtgctgctggacgtgggcagacagcaccagggcacctacacctgcatcgccagcaacgccgccggccaggccctgtgcagcgccagcctgcacgtgagcggcctgcccaaggtggaggagcaggagaaggtgaaggaggccctgatcagcaccttcctgcagggcaccacccaggccatcagcgcccagggcctggagaccgccagcttcgccgacctgggcggccagagaaaggaggagcccctggccgccaaggaggccctgggccacctgagcctggccgaggtgggcaccgaggagttcctgcagaagctgaccagccagatcaccgagatggtgagcgccaagatcacccaggccaagctgcaggtgcccggcggcgacagcgacgaggacagcaagacccccagcgccagccccagacacggcagaagcagacccagcagcagcatccaggagagcagcagcgagagcgaggacggcgacgccagaggcgagatcttcgacatctacgtggtgaccgccgactacctgcccctgggcgccgagcaggacgccatcaccctgagagagggccagtacgtggaggtgctggacgccgcccaccccctgagatggctggtgagaaccaagcccaccaagagcagccccagcagacagggctgggtgagccccgcctacctggacagaagactgaagctgagccccgagtggggcgccgccgaggcccccgagttccccggcgaggccgtgagcgaggacgagtacaaggccagactgagcagcgtgatccaggagctgctgagcagcgagcaggccttcgtggaggagctgcagttcctgcagagccaccacctgcagcacctggagagatgcccccacgtgcccatcgccgtggccggccagaaggccgtgatcttcagaaacgtgagagacatcggcagattccacagcagcagcttcctgcaggagctgcagcagtgcgacaccgacgacgacgtggccatgtgcttcatcaagaaccaggccgccttcgagcagtacctggagttcctggtgggcagagtgcaggccgagagcgtggtggtgagcaccgccatccaggagttctacaagaagtacgccgaggaggccctgctggccggcgaccccagccagcccccccccccccccctgcagcactacctggagcagcccgtggagagagtgcagagataccaggccctgctgaaggagctgatcagaaacaaggccagaaacagacagaactgcgccctgctggagcaggcctacgccgtggtgagcgccctgccccagagagccgagaacaagctgcacgtgagcctgatggagaactaccccggcaccctgcaggccctgggcgagcccatcagacagggccacttcatcgtgtgggagggcgcccccggcgccagaatgccctggaagggccacaacagacacgtgttcctgttcagaaaccacctggtgatctgcaagcccagaagagacagcagaaccgacaccgtgagctacgtgttcagaaacatgatgaagctgagcagcatcgacctgaacgaccaggtggagggcgacgacagagccttcgaggtgtggcaggagagagaggacagcgtgagaaagtacctgctgcaggccagaaccgccatcatcaagagcagctgggtgaaggagatctgcggcatccagcagagactggccctgcccgtgtggagaccccccgacttcgaggaggagctggccgactgcaccgccgagctgggcgagaccgtgaagctggcctgcagagtgaccggcacccccaagcccgtgatcagctggtacaaggacggcaaggccgtgcaggtggacccccaccacatcctgatcgaggaccccgacggcagctgcgccctgatcctggacagcctgaccggcgtggacagcggccagtacatgtgcttcgccgccagcgccgccggcaactgcagcaccctgggcaagatcctggtgcaggtgccccccagattcgtgaacaaggtgagagccagccccttcgtggagggcgaggacgcccagttcacctgcaccatcgagggcgccccctacccccagatcagatggtacaaggacggcgccctgctgaccaccggcaacaagttccagaccctgagcgagcccagaagcggcctgctggtgctggtgatcagagccgccagcaaggaggacctgggcctgtacgagtgcgagctggtgaacagactgggcagcgccagagccagcgccgagctgagaatccagagccccatgctgcaggcccaggagcagtgccacagagagcagctggtggccgccgtggaggacaccaccctggagagagccgaccaggaggtgaccagcgtgctgaagagactgctgggccccaaggcccccggccccagcaccggcgacctgaccggccccggcccctgccccagaggcgcccccgccctgcaggagaccggcagccagccccccgtgaccggcaccagcgaggcccccgccgtgccccccagagtgccccagcccctgctgcacgagggccccgagcaggagcccgaggccatcgccagagcccaggagtggaccgtgcccatcagaatggagggcgccgcctggcccggcgccggcaccggcgagctgctgtgggacgtgcacagccacgtggtgagagagaccacccagagaacctacacctaccaggccatcgacacccacaccgccagaccccccagcatgcaggtgaccatcgaggacgtgcaggcccagaccggcggcaccgcccagttcgaggccatcatcgagggcgacccccagcccagcgtgacctggtacaaggacagcgtgcagctggtggacagcaccagactgagccagcagcaggagggcaccacctacagcctggtgctgagacacgtggccagcaaggacgccggcgtgtacacctgcctggcccagaacaccggcggccaggtgctgtgcaaggccgagctgctggtgctgggcggcgacaacgagcccgacagcgagaagcagagccacagaagaaagctgcacagcttctacgaggtgaaggaggagatcggcagaggcgtgttcggcttcgtgaagagagtgcagcacaagggcaacaagatcctgtgcgccgccaagttcatccccctgagaagcagaaccagagcccaggcctacagagagagagacatcctggccgccctgagccaccccctggtgaccggcctgctggaccagttcgagaccagaaagaccctgatcctgatcctggagctgtgcagcagcgaggagctgctggacagactgtacagaaagggcgtggtgaccgaggccgaggtgaaggtgtacatccagcagctggtggagggcctgcactacctgcacagccacggcgtgctgcacctggacatcaagcccagcaacatcctgatggtgcaccccgccagagaggacatcaagatctgcgacttcggcttcgcccagaacatcacccccgccgagctgcagttcagccagtacggcagccccgagttcgtgagccccgagatcatccagcagaaccccgtgagcgaggccagcgacatctgggccatgggcgtgatcagctacctgagcctgacctgcagcagccccttcgccggcgagagcgacagagccaccctgctgaacgtgctggagggcagagtgagctggagcagccccatggccgcccacctgagcgaggacgccaaggacttcatcaaggccaccctgcagagagccccccaggccagacccagcgccgcccagtgcctgagccacccctggttcctgaagagcatgcccgccgaggaggcccacttcatcaacaccaagcagctgaagttcctgctggccagaagcagatggcagagaagcctgatgagctacaagagcatcctggtgatgagaagcatccccgagctgctgagaggcccccccgacagccccagcctgggcgtggccagacacctgtgcagagacaccggcggcagcagcagcagcagcagcagcagcgacaacgagctggcccccttcgccagagccaagagcctgccccccagccccgtgacccacagccccctgctgcaccccagaggcttcctgagacccagcgccagcctgcccgaggaggccgaggccagcgagagaagcaccgaggcccccgccccccccgccagccccgagggcgccggcccccccgccgcccagggctgcgtgcccagacacagcgtgatcagaagcctgttctaccaccaggccggcgagagccccgagcacggcgccctggcccccggcagcagaagacaccccgccagaagaagacacctgctgaagggcggctacatcgccggcgccctgcccggcctgagagagcccctgatggagcacagagtgctggaggaggaggccgccagagaggagcaggccaccctgctggccaaggcccccagcttcgagaccgccctgagactgcccgccagcggcacccacctggcccccggccacagccacagcctggagcacgacagccccagcacccccagacccagcagcgaggcctgcggcgaggcccagagactgcccagcgcccccagcggcggcgcccccatcagagacatgggccacccccagggcagcaagcagctgcccagcaccggcggccaccccggcaccgcccagcccgagagacccagccccgacagcccctggggccagcccgcccccttctgccaccccaagcagggcagcgccccccaggagggctgcagcccccaccccgccgtggccccctgcccccccggcagcttcccccccggcagctgcaaggaggcccccctggtgcccagcagccccttcctgggccagccccaggccccccccgcccccgccaaggccagcccccccctggacagcaagatgggccccggcgacatcagcctgcccggcagacccaagcccggcccctgcagcagccccggcagcgccagccaggccagcagcagccaggtgagcagcctgagagtgggcagcagccaggtgggcaccgagcccggccccagcctggacgccgagggctggacccaggaggccgaggacctgagcgacagcacccccaccctgcagagaccccaggagcaggccaccatgagaaagttcagcctgggcggcagaggcggctacgccggcgtggccggctacggcaccttcgccttcggcggcgacgccggcggcatgctgggccagggccccatgtgggccagaatcgcctgggccgtgagccagagcgaggaggaggagcaggaggaggccagagccgagagccagagcgaggagcagcaggaggccagagccgagagccccctgccccaggtgagcgccagacccgtgcccgaggtgggcagagcccccaccagaagcagccccgagcccaccccctgggaggacatcggccaggtgagcctggtgcagatcagagacctgagcggcgacgccgaggccgccgacaccatcagcctggacatcagcgaggtggaccccgcctacctgaacctgagcgacctgtacgacatcaagtacctgcccttcgagttcatgatcttcagaaaggtgcccaagagcgcccagcccgagccccccagccccatggccgaggaggagctggccgagttccccgagcccacctggccctggcccggcgagctgggcccccacgccggcctggagatcaccgaggagagcgaggacgtggacgccctgctggccgaggccgccgtgggcagaaagagaaagtggagcagccccagcagaagcctgttccacttccccggcagacacctgcccctggacgagcccgccgagctgggcctgagagagagagtgaaggccagcgtggagcacatcagcagaatcctgaagggcagacccgagggcctggagaaggagggcccccccagaaagaagcccggcctggccagcttcagactgagcggcctgaagagctgggacagagcccccaccttcctgagagagctgagcgacgagaccgtggtgctgggccagagcgtgaccctggcctgccaggtgagcgcccagcccgccgcccaggccacctggagcaaggacggcgcccccctggagagcagcagcagagtgctgatcagcgccaccctgaagaacttccagctgctgaccatcctggtggtggtggccgaggacctgggcgtgtacacctgcagcgtgagcaacgccctgggcaccgtgaccaccaccggcgtgctgagaaaggccgagagacccagcagcagcccctgccccgacatcggcgaggtgtacgccgacggcgtgctgctggtgtggaagcccgtggagagctacggccccgtgacctacatcgtgcagtgcagcctggagggcggcagctggaccaccctggccagcgacatcttcgactgctgctacctgaccagcaagctgagcagaggcggcacctacaccttcagaaccgcctgcgtgagcaaggccggcatgggcccctacagcagccccagcgagcaggtgctgctgggcggccccagccacctggccagcgaggaggagagccagggcagaagcgcccagcccctgcccagcaccaagaccttcgccttccagacccagatccagagaggcagattcagcgtggtgagacagtgctgggagaaggccagcggcagagccctggccgccaagatcatcccctaccaccccaaggacaagaccgccgtgctgagagagtacgaggccctgaagggcctgagacacccccacctggcccagctgcacgccgcctacctgagccccagacacctggtgctgatcctggagctgtgcagcggccccgagctgctgccctgcctggccgagagagccagctacagcgagagcgaggtgaaggactacctgtggcagatgctgagcgccacccagtacctgcacaaccagcacatcctgcacctggacctgagaagcgagaacatgatcatcaccgagtacaacctgctgaaggtggtggacctgggcaacgcccagagcctgagccaggagaaggtgctgcccagcgacaagttcaaggactacctggagaccatggagctgctggagggccagggcgccgtgccccagaccgacatctgggccatcggcgtgaccgccttcatcatgctgagcgccgagtaccccgtgagcagcgagggcgccagagacctgcagagaggcctgagaaagggcctggtgagactgagcagatgctacgccggcctgagcggcggcgccgtggccttcctgagaagcaccctgtgcgcccagccctggggcagaccctgcgccagcagctgcctgcagtgcccctggctgaccgaggagggccccgcctgcagcagacccgcccccgtgaccttccccaccgccagactgagagtgttcgtgagaaacagagagaagagaagagccctgctgtacaagagacacaacctggcccaggtgagatag

SEQ ID NO: 12348 - DNA, 1749 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagcgagaaggccaacaccctgaaggccaacagattcagccagagcgtgaaggtggtgcacgagagactgcagatccagatccacaagagagaggccgagaacgacaagctgaaggagtacgtgaagagcctggagaccaagatcgccaagtggaacctgcagagcagaatgaacaagaacgaggccatcgtgatgaaggaggccagcagacagaagaccgtggccctgaagaaggccagcaaggtgtacaagcagagactggaccacttcaccggcgccatcgagaagctgaccagccagatcagagaccaggaggccaagctgagcgagaccatcagcgccagcaacgcctggaagagccactacgagaagatcgtgatcgagaagaccgagctggaggtgcagatcgagaccatgaagaagcagatcatcaacctgctggaggacctgaagaagatggaggaccacggcaagaacagctgcgaggagatcctgagaaaggtgcacagcatcgagtacgagaacgagaccctgaacctggagaacaccaagctgaagaccaccctggccgccctgaaggacgaggtggtgagcgtggagaacgagctgagcgagctgcaggaggtggagaagaagcagaagaccctgatcgagatgtacaagacccaggtgcagaagctgcaggaggccgccgagatcgtgaagagcagatgcgagaacctgctgcacaagaacaaccagatcaccaagaccaagaacaagaacgtggagaagatgagaggccagatggagagccacctgaaggagctggagagagtgtgcgacagcctgaccgccgccgagagaagactgcacgagtgccaggtggacggcaaccacaacctgctgaccaagctgagcctggaggaggagaactgcctgatccagctgaagtgcgagaacctgcagcagaagctggagcagatggacgccgagaacaaggagctggagaagaagctggccaaccaggaggagtgcctgaagcacagcaacctgaagttcaaggagaagagcgccgagtacaccgccctggccagacagctggaggccgccctggaggagggcagacagaaggtggccgaggagatcgagaagatgagcagcagagagagcgccctgcagatcaagatcctggacctggagaccgagctgagaaagaagaacgaggagcagaaccagctggtgtgcaagatgaacagcaccaacggctag

SEQ ID NO: 12349 - DNA, 384 bp, Artificial Sequence
  Description of Artificial Sequence: Synthetic coding sequence
atggtgagcagcggcagaagatggctgagagagcagcagcacagaagatggagactgcactgcctgaagctgcagcccctgagccccgtgcccagcgacatcgagatcagcagaggccagacccccaaggccgtggacgtgctggccaaggagatcggcctgctggccgacgagatcgagatctacggcaagagcaaggccaaggtgagactgagcgtgctggagagactgaaggaccaggccgacggcaagtacgtgctggtggccggcatcacccccacccccctgggcgagggcaagagcaccgtgaccatcggcctggtgcaggccctgaccgcccacctgaacgtgaacagcttcgcctgcctgagacagcccagctag

SEQ ID NO: 12350 - DNA, 1929 bp, Artificial Sequence
  Description of Artificial Sequence: Synthetic coding sequence
atgaagatcttctgcagcagagccaaccccaccaccggcagcgtggagtggctggaggaggacgagcactacgactaccaccaggagatcgccagaagcagctacgccgacatgctgcacgacaaggacagagtgttcaagcccatggccgacgccgccgtgaagatcgtggagaagaacggcttcagcgacaagatcaaggtgatcaacaagcacagcaccgaggtgaccgtgggccccgagggcgacatgccctgcagagccaacatcctggtgaccgagctgttcgacaccgagctgatcggcgagggcgccctgcccagctacgagcacgcccacagacacctggtggaggagaactgcgaggccgtgccccacagagccaccgtgtacgcccagctggtggagagcggcagaatgtggagctggaacaagctgttccccatccacgtgcagaccagcctgggcgagcaggtgatcgtgccccccgtggacgtggagagctgccccggcgcccccagcgtgtgcgacatccagctgaaccaggtgagccccgccgacttcaccgtgctgagcgacgtgctgcccatgttcagcatcgacttcagcaagcaggtgagcagcagcgccgcctgccacagcagaagattcgagcccctgaccagcggcagagcccaggtggtgctgagctggtgggacatcgagatggaccccgagggcaagatcaagtgcaccatggcccccttctgggcccacagcgaccccgaggagatgcagtggagagaccactggatgcagtgcgtgtacttcctgccccaggaggagcccgtggtgcagggcagcgccctgtacctggtggcccaccacgacgactactgcgtgtggtacagcctgcagagaaccagccccgagaagaacgagagagtgagacagatgagacccgtgtgcgactgccaggcccacctgctgtggaacagacccagattcggcgagatcaacgaccaggacagaaccgacagatacgtgcaggccctgagaaccgtgctgaagcccgacagcgtgtgcctgtgcgtgagcgacggcagcctgctgagcgtgctggcccaccacctgggcgtggagcaggtgttcaccgtggagagcagcgccgccagccacaagctgctgagaaagatcttcaaggccaaccacctggaggacaagatcaacatcatcgagaagagacccgagctgctgaccaacgaggacctgcagggcagaaaggtgagcctgctgctgggcgagcccttcttcaccaccagcctgctgccctggcacaacctgtacttctggtacgtgagaaccgccgtggaccagcacctgggccccggcgccatggtgatgccccaggccgccagcctgcacgccgtggtggtggagttcagagacctgtggagaatcagaagcccctgcggcgactgcgagggcttcgacgtgcacatcatggacgacatgatcaagagagccctggacttcagagagagcagagaggccgagccccaccccctgtgggagtacccctgcagaagcctgagcgagccctggcagatcctgaccttcgacttccagcagcccgtgcccctgcagcccctgtgcgccgagggcaccgtggagctgagaagacccggccagagccacgccgccgtgctgtggatggagtaccacctgacccccgagtgcaccctgagcaccggcctgctggagcccgccgaccccgagggcggctgctgctggaacccccactgcaagcaggccgtgtacttcttcagccccgcccccgaccccagagccctgctgggcggccccagaaccgtgagctacgccgtggagttccaccccgacaccggcgacatcatcatggagttcagacacgccgacacccccgactag

SEQ ID NO: 12351 - DNA, 300 bp, Artificial Sequence
  Description of Artificial Sequence: Synthetic coding sequence
atggtggtgaagctgctgagcaacaagagaagccaggccgtgggcatcctgatgagcagcctgcacctggacatgaaggacatccagcacgccgtggtgaacctggacaacagcgtggtggacctggagaccctgcaggccctgtacgagaacagagcccagagcgacgagctggagaagatcgagaagcacggcagaagcagcaaggacaaggagaacgccaagagcctggacaagcccgagcagttcctgtacgagctgagcctgatccccaacttcagcgagagagtgttctgctag

SEQ ID NO: 12352 - DNA, 390 bp, Artificial Sequence
  Description of Artificial Sequence: Synthetic coding sequence
atgggcggctgcttcagcaagcccaagcccgtggagctgaagatcgaggtggtgctgcccgagaaggagagaggcaaggaggagctgagcgccagcggcaagggcagccccagagcctaccagggcaacggcaccgccagacacttccacaccgaggagagactgagcaccccccacccctaccccagcccccaggactgcgtggaggccgccgtgtgccacgtgaaggacctggagaacggccagatgagagaggtggagctgggctggggcaaggtgctgctggtgaaggacaacggcgagttccacgccctgggccacaagtgcccccactacggcgcccccctggtgaagggcgtgctgagcagaggcagagtgagatgcccctag

SEQ ID NO: 12353 - DNA, 453 bp, Artificial Sequence
  Description of Artificial Sequence: Synthetic coding sequence
atgaacctggccgagatctgcgacaacgccaagaagggcagagagtacgccctgctgggcaactacgacagcagcatggtgtactaccagggcgtgatgcagcagatccagagacactgccagagcgtgagagaccccgccatcaagggcaagtggcagcaggtgagacaggagctgctggaggagtacgagcaggtgaagagcatcgtgagcaccctggagagcttcaagatcgacaagccccccgacttccccgtgagctgccaggacgagcccttcagagaccccgccgtgtggcccccccccgtgcccgccgagcacagagcccccccccagatcagaagacccaacagagaggtgagacccctgagaaaggagatggccggcgtgggcgccagaggccccgtgggcagagcccaccccatcagcaagagcgagaagcccagcacctag

SEQ ID NO: 12354 - DNA, 498 bp, Artificial Sequence
  Description of Artificial Sequence: Synthetic coding sequence
atgggcgtgaaccagagcgtgggcttcccccccgtgaccggcccccacctggtgggctgcggcgacgtgatggagggccagaacctgcagggcagcttcttcagactgttctacccctgccagaaggccgaggagaccatggagcagcccctgtggatccccagatacgagtactgcaccggcctggccgagtacctgcagttcaacaagagatgcggcggcctgctgttcaacctggccgtgggcagctgcagactgcccgtgagctggaacggccccttcaagaccaaggacagcggctaccccctgatcatcttcagccacggcctgggcgccttcagaaccctgtacagcgccttctgcatggagctggccagcagaggcttcgtggtggccgtgcccgagcacagagacagaagcgccgccaccacctacttctgcaagcaggcccccgaggagaaccagcccaccaacgagagcctgcaggaggagtggtag

SEQ ID NO: 12355 - DNA, 270 bp, Artificial Sequence; identical to SEQ ID NO: 11466
  Description of Artificial Sequence: Synthetic coding sequence

SEQ ID NO: 12356 - DNA, 6009 bp, Artificial Sequence
  Description of Artificial Sequence: Synthetic coding sequence
atggaggagagaaagcacgagaccatgaaccccgcccacgtgctgttcgacagattcgtgcaggccaccacctgcaagggcaccctgaaggccttccaggagctgtgcgaccacctggagctgaagcccaaggactacagaagcttctaccacaagctgaagagcaagctgaactactggaaggccaaggccctgtgggccaagctggacaagagaggcagccacaaggactacaagaagggcaaggcctgcaccaacaccaagtgcctgatcatcggcgccggcccctgcggcctgagaaccgccatcgacctgagcctgctgggcgccaaggtggtggtgatcgagaagagagacgccttcagcagaaacaacgtgctgcacctgtggcccttcaccatccacgacctgagaggcctgggcgccaagaagttctacggcaagttctgcgccggcgccatcgaccacatcagcatcagacagctgcagctgatcctgctgaaggtggccctgatcctgggcatcgagatccacgtgaacgtggagttccagggcctgatccagccccccgaggaccaggagaacgagagaatcggctggagagccctggtgcaccccaagacccaccccgtgagcgagtacgagttcgaggtgatcatcggcggcgacggcagaagaaacaccctggagggcttcagaagaaaggagttcagaggcaagctggccatcgccatcaccgccaacttcatcaacagaaacaccaccgccgaggccaaggtggaggagatcagcggcgtggccttcatcttcaaccagaagttcttccaggagctgagagaggccaccggcatcgacctggagaacatcgtgtactacaaggacgacacccactacttcgtgatgaccgccaagaagcagagcctgctggacaagggcgtgatcctgcacgactacgccgacaccgagctgctgctgagcagagagaacgtggaccaggaggccctgctgagctacgccagagaggccgccgacttcagcacccagcagcagctgcccagcctggacttcgccatcaaccactacggccagcccgacgtggccatgttcgacttcacctgcatgtacgccagcgagaacgccgccctggtgagagagcagaacggccaccagctgctggtggccctggtgggcgacagcctgctggagcccttctggcccatgggcaccggcatcgccagaggcttcctggccgccatggacagcgcctggatggtgagaagctggagcctgggcaccagccccctggaggtgctggccgagagagagagcatctacagactgctgccccagaccacccccgagaacgtgagcaagaacttcagccagtacagcatcgaccccgtgaccagataccccaacatcaacgtgaacttcctgagacccagccaggtgagacacctgtacgacaccggcgagaccaaggacatccacctggagatggagagcctggtgaacagcagaaccacccccaagctgaccagaaacgagagcgtggccagaagcagcaagctgctgggctggtgccagagacagaccgacggctacgccggcgtgaacgtgaccgacctgaccatgagctggaagagcggcctggccctgtgcgccatcatccacagatacagacccgacctgatcgacttcgacagcctggacgagcagaacgtggagaagaacaaccagctggccttcgacatcgccgagaaggagctgggcatcagccccatcatgaccggcaaggagatggccagcgtgggcgagcccgacaagctgagcatggtgatgtacctgacccagttctacgagatgttcaaggacagcctgcccagcagcgacaccctggacctgaacgccgaggagaaggccgtgctgatcgccagcaccagaagccccatcagcttcctgagcaagctgggccagaccatcagcagaaagagaagccccaaggacaagaaggagaaggacctggacggcgccggcaagagaagaaagaccagccagagcgaggaggaggaggcccccagaggccacagaggcgagagacccaccctggtgagcaccctgaccgacagaagaatggacgtggccgtgggcaaccagaacaaggtgaagtacatggccacccagctgctggccaagttcgaggagaacgcccccgcccagagcatcggcatcagaagacagggcagcatgaagaaggagttcccccagaacctgggcggcagcgacacctgctacttctgccagaagagagtgtacgtgatggagagactgagcgccgagggcaagttcttccacagaagctgcttcaagtgcgagtactgcgccaccaccctgagactgagcgcctacgcctacgacatcgaggacggcaagttctactgcaagccccactactgctacagactgagcggctacgcccagagaaagagacccgccgtggcccccctgagcggcaaggaggccaagggccccctgcaggacggcgccaccaccgacgccaacggcagagccaacgccgtggccagcagcaccgagagaacccccggcagcggcgtgaacggcctggaggagcccagcatcgccaagagactgagaggcacccccgagagaatcgagctggagaactacagactgagcctgagacaggccgaggccctgcaggaggtgcccgaggagacccaggccgagcacaacctgagcagcgtgctggacaccggcgccgaggaggacgtggccagcagcagcagcgagagcgagatggaggaggagggcgaggaggaggaggaggagcccagactgccccccagcgacctgggcggcgtgccctggaaggaggccgtgagaatccacgccctgctgaagggcaagagcgaggaggagctggaggccagcaagagcttcggccccggcaacgaggaggaggaggaggaggaggaggagtacgaggaggaggaggaggaggactacgacgaggaggaggaggagagcagcgaggccggcaaccagagactgcagcaggtgatgcacgccgccgaccccctggagatccaggccgacgtgcactggacccacatcagagagagagaggaggaggagagaatggcccccgccagcgagagcagcgccagcggcgcccccctggacgagaacgacctggaggaggacgtggacagcgagcccgccgagatcgagggcgaggccgccgaggacggcgaccccggcgacaccggcgccgagctggacgacgaccagcactggagcgacagccccagcgacgccgacagagagctgagactgccctgccccgccgagggcgaggccgagctggagctgagagtgagcgaggacgaggagaagctgcccgccagccccaagcaccaggagagaggccccagccaggccaccagccccatcagaagcccccaggagagcgccctgctgttcatccccgtgcacagccccagcaccgagggcccccagctgccccccgtgcccgccgccacccaggagaagagccccgaggagagactgttccccgagcccctgctgcccaaggagaagcccaaggccgacgcccccagcgacctgaaggccgtgcacagccccatcagaagccagcccgtgaccctgcccgaggccagaacccccgtgagccccggcagcccccagccccagccccccgtggccgccagcacccccccccccagccccctgcccatctgcagccagccccagcccagcaccgaggccaccgtgcccagccccacccagagccccatcagattccagcccgcccccgccaagaccagcacccccctggcccccctgcccgtgcagagccagagcgacaccaaggacagactgggcagccccctggccgtggacgaggccctgagaagaagcgacctggtggaggagttctggatgaagagcgccgagatcagaagaagcctgggcctgacccccgtggacagaagcaagggccccgagcccagcttccccacccccgccttcagacccgtgagcctgaagagctacagcgtggagaagagcccccaggacgagggcctgcacctgctgaagcccctgagcatccccaagagactgggcctgcccaagcccgagggcgagcccctgagcctgcccacccccagaagccccagcgacagagagctgagaagcgcccaggaggagagaagagagctgagcagcagcagcggcctgggcctgcacggcagcagcagcaacatgaagaccctgggcagccagagcttcaacaccagcgacagcgccatgctgaccccccccagcagccccccccccccccccccccccggcgaggagcccgccaccctgagaagaaagctgagagaggccgagcccaacgccagcgtggtgcccccccccctgcccgccacctggatgagaccccccagagagcccgcccagccccccagagaggaggtgagaaagagcttcgtggagagcgtggaggagatccccttcgccgacgacgtggaggacacctacgacgacaagaccgaggacagcagcctgcaggagaagttcttcaccccccccagctgctggcccagacccgagaagcccagacacccccccctggccaaggagaacggcagactgcccgccctggagggcaccctgcagccccagaagagaggcctgcccctggtgagcgccgaggccaaggagctggccgaggagagaatgagagccagagagaagagcgtgaagagccaggccctgagagacgccatggccagacagctgagcagaatgcagcagatggagctggccagcggcgcccccagacccagaaaggccagcagcgcccccagccagggcaaggagagaagacccgacagccccaccagacccaccctgagaggcagcgaggagcccaccctgaagcacgaggccaccagcgaggaggtgctgagcccccccagcgacagcggcggccccgacggcagcttcaccagcagcgagggcagcagcggcaagagcaagaagagaagcagcctgttcagccccagaagaaacaagaaggagaagaagagcaagggcgagggcagaccccccgagaagcccagcagcaacctgctggaggaggccgccgccaagcccaagagcctgtggaagagcgtgttcagcggctacaagaaggacaagaagaagaaggccgacgacaagagctgccccagcacccccagcagcggcgccaccgtggacagcggcaagcacagagtgctgcccgtggtgagagccgagctgcagctgagaagacagctgagcttcagcgaggacagcgacctgagcagcgacgacgtgctggagaagagcagccagaagagcagaagagagcccagaacctacaccgaggaggagctgaacgccaagctgaccagaagagtgcagaaggccgccagaagacaggccaagcaggaggagctgaagagactgcacagagcccagatcatccagagacagctgcagcaggtggaggagagacagagaagactggaggagagaggcgtggccgtggagaaggccctgagaggcgaggccggcatgggcaagaaggacgaccccaagctgatgcaggagtggttcaagctggtgcaggagaagaacgccatggtgagatacgagagcgagctgatgatcttcgccagagagctggagctggaggacagacagagcagactgcagcaggagctgagagagagaatggccgtggaggaccacctgaagaccgaggaggagctgagcgaggagaagcagatcctgaacgagatgctggaggtggtggagcagagagacagcctggtggccctgctggaggagcagagactgagagagagagaggaggacaaggacctggaggccgccatgctgagcaagggcttcagcctgaactggagctag

SEQ ID NO: 12357 - DNA, 540 bp, Artificial Sequence
  Description of Artificial Sequence: Synthetic coding sequence
atgagcagcaacgagtgcttcaagtgcggcagaagcggccactgggccagagagtgccccaccggcggcggcagaggcagaggcatgagaagcagaggcagaggcggcttcaccagcgacagaggcttccagttcgtgagcagcagcctgcccgacatctgctacagatgcggcgagagcggccacctggccaaggactgcgacctgcaggaggacgtggaggcctgctacaactgcggcagaggcggccacatcgccaaggactgcaaggagcccaagagagagagagagcagtgctgctacaactgcggcaagcccggccacctggccagagactgcgaccacgccgacgagcagaagtgctacagctgcggcgagttcggccacatccagaaggactgcaccaaggtgaagtgctacagatgcggcgagaccggccacgtggccatcaactgcagcaagaccagcgaggtgaactgctacagatgcggcgagagcggccacctggccagagagtgcaccatcgaggccaccgcctag

SEQ ID NO: 12358 - DNA, 1140 bp, Artificial Sequence
  Description of Artificial Sequence: Synthetic coding sequence
gccagagccgtgcccgtgggcagcggcctgagaggcctgcagagaaccctgcccctggtggtgatcctgggcgccaccggcaccggcaagagcaccctggccctgcagctgggccagagactgggcggcgagatcgtgagcgccgacagcatgcagccccaggagatgggcaccgagaaggtgatcgacagaaaggtggagctggagaaggaggacggcctggtgctgcacaagagactgagccaggtggaccccgagatggccgccaagctgcacccccacgacaagagaaaggtggccagaagcctgcaggtgttcgaggagaccggcatcagccacagcgagttcctgcacagacagcacaccgaggagggcggcggccccctgggcggccccctgaagttcagcaacccctgcatcctgtggctgcacgccgaccaggccgacgagagactggacaagagagtggacgacatgctggccgccggcctgctggaggagctgagagacttccacagaagatacaaccagaagaacgtgagcgagaacagccaggactaccagcacggcatcttccagagcatcggcttcaaggagttccacgagtacctgatcaccgagggcaagtgcaccctggagaccagcaaccagctgctgaagaagggcatcgaggccctgaagcaggtgaccaagagatacgccagaaagcagaacagatgggtgaagaacagattcctgagcagacccggccccatcgtgccccccgtgtacggcctggaggtgagcgacgtgagcaagtgggaggagagcgtgctggagcccgccctggagatcgtgcagagcttcatccagggccacaagcccaccgccacccccatcaagatgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 12359 - DNA, 483 bp, Artificial Sequence; identical to SEQ ID NO: 10977
  Description of Artificial Sequence: Synthetic coding sequence

SEQ ID NO: 12360 - DNA, 816 bp, Artificial Sequence
  Description of Artificial Sequence: Synthetic coding sequence
atgaacctggagaagctgagcaagcccgagctgctgaccctgttcagcatcctggagggcgagctggaggccagagacctggtgatcgaggccctgaaggcccagcacagagacaccttcatcgaggagagatacggcaagtacaacatcagcgaccccctgatggccctgcagagagacttcgagaccctgaaggagaagaacgacggcgagaagcagcccgtgtgcaccaaccccctgagcatcctgaaggtggtgatgaagcagtgcaagaacatgcaggagagaatgctgagccagctggccgccgccgagagcagacacagaaaggtgatcctggacctggaggaggagagacagagacacgcccaggacaccgccgagggcgacgacgtgacctacatgctggagaaggagagagagagactgacccagcagctggagttcgagaagagccaggtgaagaagttcgagaaggagcagaagaagctgagcagccagctggaggaggagagaagcagacacaagcagctgagcagcatgctggtgctggagtgcaagaaggccaccaacaaggccgccgaggagggccagaaggccggcgagctgagcctgaagctggagaaggagaagagcagagtgagcaagctggaggaggagctggccgccgagagaaagagaggcctgcagaccgaggcccaggtggagaagcagctgagcgagttcgacatcgagagagagcagctgagagccaagctgaacagagaggagaacagaaccaagaccctgaaggaggagatggagagcctgaagtag

SEQ ID NO: 12361 - DNA, 1482 bp, Artificial Sequence
  Description of Artificial Sequence: Synthetic coding sequence
atggaccaggactacgagagaagactgctgagacagatcgtgatccagaacgagaacaccatgcccagagtgaccgagatgagaagaaccctgacccccgccagcagccccgtgagcagccccagcaagcacggcgacagattcatccccagcagagccggcgccaactggagcgtgaacttccacagaatcaacgagaacgagaagagccccagccagaacagaaaggccaaggacgccaccagcgacaacggcaaggacggcctggcctacagcgccctgctgaagaacgagctgctgggcgccggcatcgagaaggtgcaggacccccagaccgaggacagaagactgcagcccagcacccccgagaagaagggcctgttcacctacagcctgagcaccaagagaagcagccccgacgacggcaacgacgtgagcccctacagcctgagccccgtgagcaacaagagccagaagctgctgagaagccccagaaagcccaccagaaagatcagcaagatccccttcaaggtgctggacgcccccgagctgcaggacgacttctacctgaacctggtggactggagcagcctgaacgtgctgagcgtgggcctgggcacctgcgtgtacctgtggagcgcctgcaccagccaggtgaccagactgtgcgacctgagcgtggagggcgacagcgtgaccagcgtgggctggagcgagagaggcaacctggtggccgtgggcacccacaagggcttcgtgcagatctgggacgccgccgccggcaagaagctgagcatgctggagggccacaccgccagagtgggcgccctggcctggaacgccgagcagctgagcagcggcagcagagacagaatgatcctgcagagagacatcagaaccccccccctgcagagcgagagaagactgcagggccacagacaggaggtgtgcggcctgaagtggagcaccgaccaccagctgctggccagcggcggcaacgacaacaagctgctggtgtggaaccacagcagcctgagccccgtgcagcagtacaccgagcacctggccgccgtgaaggccatcgcctggagcccccaccagcacggcctgctggccagcggcggcggcaccgccgacagatgcatcagattctggaacaccctgaccggccagcccctgcagtgcatcgacaccggcagccaggtgtgcaacctggcctggagcaagcacgccaacgagctggtgagcacccacggctacagccagaaccagatcctggtgtggaagtaccccagcctgacccaggtggccaagctgaccggccacagctacagagtgctgtacctggccatgagccccgacggcgaggccatcgtgaccggcgccggcgacgagaccctgagattctggaacgtgttcagcaagaccagaagcaccaaggagagcgtgagcgtgctgaacctgttcaccagaatcagatag

SEQ ID NO: 12362 - DNA, 552 bp, Artificial Sequence
  Description of Artificial Sequence: Synthetic coding sequence
atgaagaaggagcacgtgctgcactgccagttcagcgcctggtaccccttcttcagaggcgtgaccatcaagagcgtgatcctgcccctgccccagaacgtgaaggactacctgctggacgacggcaccctggtggtgagcggcagagacgacccccccacccacagccagcccgacagcgacgacgaggccgaggagatccagtggagcgacgacgagaacaccgccaccctgaccgacgcctactggatcgccatgaacagcagcctgaagtgcaagaccctgagcgacatcttcctgctgttcaagagcagcgacttcatcaccagagacttcacccagcccttcatccactgcaccgacgacagccccgacccctgcatcgagtacgagctggtgctgagaaagtggtgcgagctgatccccggcgccgagttcagatgcttcgtgaaggagaacaagctgatcggcatcagccagagagactacacccagtactacgaccacatcagcaagcagaaggaggagatcagaagatgcatccaggactag

SEQ ID NO: 12363 - DNA, 672 bp, Artificial Sequence; identical to SEQ ID NO: 10373
  Description of Artificial Sequence: Synthetic coding sequence

SEQ ID NO: 12364 - DNA, 348 bp, Artificial Sequence
  Description of Artificial Sequence: Synthetic coding sequence
atgcccatcctgctgttcctgatcgacaccagcgccagcatgaaccagagaagccacctgggcaccacctacctggacaccgccaagggcgccgtggagaccttcatgaagctgagagccagagaccccgccagcagaggcgacagatacatgctggtgaccttcgaggagcccccctacgccatcaaggccggctggaaggagaaccacgccaccttcatgaacgagctgaagaacctgcaggccgagggcctgaccaccctgggccagagcctgagaaccgccttcgacctgctgaacctgaacagactggtgaccggcatcgacaactacggccaggtgggctag

SEQ ID NO: 12365 - DNA, 390 bp, Artificial Sequence; identical to SEQ ID NO: 10956
  Description of Artificial Sequence: Synthetic coding sequence

SEQ ID NO: 12366 - DNA, 2676 bp, Artificial Sequence
  Description of Artificial Sequence: Synthetic coding sequence
atggtggcccccgtgctggagaccagccacgtgttctgctgccccaacagagtgagaggcgtgctgaactggagcagcggccccagaggcctgctggccttcggcaccagctgcagcgtggtgctgtacgaccccctgaagagagtggtggtgaccaacctgaacggccacaccgccagagtgaactgcatccagtggatctgcaagcaggacggcagccccagcaccgagctggtgagcggcggcagcgacaaccaggtgatccactgggagatcgaggacaaccagctgctgaaggccgtgcacctgcagggccacgagggccccgtgtacgccgtgcacgccgtgtaccagagaagaaccagcgaccccgccctgtgcaccctgatcgtgagcgccgccgccgacagcgccgtgagactgtggagcaagaagggccccgaggtgatgtgcctgcagaccctgaacttcggcaacggcttcgccctggccctgtgcctgagcttcctgcccaacaccgacgtgacctggaagaccggccaggtggagagaggcagagcctggaagccccccgccagcctggccctgtgcagcagaagctgcgacagcatggtgagctgctacgccagcatcctgtgcaaggccctgtggaaggagaagctgcacaccttctggcaccacaacagaatcagcttcctgcccagcgccttcagacccatccccatcctggcctgcggcaacgacgactgcagaatccacatcttcgcccagcagaacgaccagttccagaaggtgctgagcctgtgcggccacgaggactggatcagaggcgtggagtgggccgccttcggcagagacctgttcctggccagctgcagccaggactgcctgatcagaatctggaagctgtacatcaagagcaccagcctggagacccaggacgacgacaacatcagactgaaggagaacaccttcaccatcgagaacgagagcgtgaagatcgccttcgccgtgaccctggagaccgtgctggccggccacgagaactgggtgaacgccgtgcactggcagcccgtgttctacaaggacggcgtgctgcagcagcccgtgagactgctgagcgccagcatggacaagaccatgatcctgtgggcccccgacgaggagagcggcgtgtggctggagcaggtgagagtgggcgaggtgggcggcaacaccctgggcttctacgactgccagttcaacgaggacggcagcatgatcatcgcccacgccttccacggcgccctgcacctgtggaagcagaacaccgtgaaccccagagagtggacccccgagatcgtgatcagcggccacttcgacggcgtgcaggacctggtgtgggaccccgagggcgagttcatcatcaccgtgggcaccgaccagaccaccagactgttcgccccctggaagagaaaggaccagagccaggtgacctggcacgagatcgccagaccccagatccacggctacgacctgaagtgcctggccatgatcaacagattccagttcgtgagcggcgccgacgagaaggtgctgagagtgttcagcgcccccagaaacttcgtggagaacttctgcgccatcaccggccagagcctgaaccacgtgctgtgcaaccaggacagcgacctgcccgagggcgccaccgtgcccgccctgggcctgagcaacaaggccgtgttccagggcgacatcgccagccagcccagcgacgaggaggagctgctgaccagcaccggcttcgagtaccagcaggtggccttccagcccagcatcctgaccgagccccccaccgaggaccacctgctgcagaacaccctgtggcccgaggtgcagaagctgtacggccacggctacgagatcttctgcgtgacctgcaacagcagcaagaccctgctggccagcgcctgcaaggccgccaagaaggagcacgccgccatcatcctgtggaacaccaccagctggaagcaggtgcagaacctggtgttccacagcctgaccgtgacccagatggccttcagccccaacgagaagttcctgctggccgtgagcagagacagaacctggagcctgtggaagaagcaggacaccatcagccccgagttcgagcccgtgttcagcctgttcgccttcaccaacaagatcaccagcgtgcacagcagaatcatctggagctgcgactggagccccgacagcaagtacttcttcaccggcagcagagacaagaaggtggtggtgtggggcgagtgcgacagcaccgacgactgcatcgagcacaacatcggcccctgcagcagcgtgctggacgtgggcggcgccgtgaccgccgtgagcgtgtgccccgtgctgcaccccagccagagatacgtggtggccgtgggcctggagtgcggcaagatctgcctgtacacctggaagaagaccgaccaggtgcccgagatcaacgactggacccactgcgtggagaccagccagagccagagccacaccctggccatcagaaagctgtgctggaagaactgcagcggcaagaccgagcagaaggaggccgagggcgccgagtggctgcacttcgccagctgcggcgaggaccacaccgtgaagatccacagagtgaacaagtgcgccctgtag

SEQ ID NO: 12367 - DNA, 573 bp, Artificial Sequence
  Description of Artificial Sequence: Synthetic coding sequence
atgggccccctgcccagaaccgtggagctgttctacgacgtgctgagcccctacagctggctgggcttcgagatcctgtgcagataccagaacatctggaacatcaacctgcagctgagacccagcctgatcaccggcatcatgaaggacagcggcaacaagccccccggcctgctgcccagaaagggcctgtacatggccaacgacctgaagctgctgagacaccacctgcagatccccatccacttccccaaggacttcctgagcgtgatgctggagaagggcagcctgagcgccatgagattcctgaccgccgtgaacctggagcaccccgagatgctggagaaggccagcagagagctgtggatgagagtgtggagcagaaacgaggacatcaccgagccccagagcatcctggccgccgccgagaaggccggcatgagcgccgagcaggcccagggcctgctggagaagatcgccacccccaaggtgaagaaccagctgaaggagaccaccgaggccgcctgcagatacggcgagagaagcggctgggccctgtacctgcagccctag

SEQ ID NO: 12368 - DNA, 1482 bp, Artificial Sequence
  Description of Artificial Sequence: Synthetic coding sequence
atgatgaagagacagctgcacagaatgagacagctggcccagaccggcagcctgggcagaacccccgagaccgccgagttcctgggcgaggacctgctgcaggtggagcagagactggagcccgccaagagagccgcccacaacatccacaagagactgcaggcctgcctgcagggccagagcggcgccgacatggacaagagagtgaagaagctgcccctgatggccctgagcaccaccatggccgagagcttcaaggagctggaccccgacagcagcatgggcaaggccctggagatgagctgcgccatccagaaccagctggccagaatcctggccgagttcgagatgaccctggagagagacgtgctgcagcccctgagcagactgagcgaggaggagctgcccgccatcctgaagcacaagaagagcctgcagaagctggtgagcgactggaacaccctgaagagcagactgagccaggccaccaagaacagcggcagcagccagggcctgggcggcagccccggcagccacagccacaccaccatggccaacaaggtggagaccctgaaggaggaggaggaggagctgaagagaaaggtggagcagtgcagagacgagtacctggccgacctgtaccacttcgtgaccaaggaggacagctacgccaactacttcatcagactgctggagatccaggccgactaccacagaagaagcctgagcagcctggacaccgccctggccgagctgagagagaaccacggccaggccgaccacagccccagcatgaccgccacccacttccccagagtgtacggcgtgagcctggccacccacctgcaggagctgggcagagagatcgccctgcccatcgaggcctgcgtgatgatgctgctgagcgagggcatgaaggaggagggcctgttcagactggccgccggcgccagcgtgctgaagagactgaagcagaccatggccagcgacccccacagcctggaggagttctgcagcgacccccacgccgtggccggcgccctgaagagctacctgagagagctgcccgagcccctgatgaccttcgacctgtacgacgactggatgagagccgccagcctgaaggagcccggcgccagactgcaggccctgcaggaggtgtgcagcagactgccccccgagaacctgagcaacctgagatacctgatgaagttcctggccagactggccgaggagcaggaggtgaacaagatgacccccagcaacatcgccatcgtgctgggccccaacctgctgtggccccccgagaaggagggcctggagtacagcggcgccatcagcgcccactgcaacctgagactgcccggcagcagcgacagcagcgccagcgcctgccaggtggccggcaccaccggcaccagacccagctggatgcagcccccctgcctgcccagcagatggtgggccagcagcagaagatag

SEQ ID NO: 12369 - DNA, 45 bp, Artificial Sequence
  Description of Artificial Sequence: Synthetic coding sequence
atggccatggcccccagccccagcctggtgcaggtgtacacctag

SEQ ID NO: 12370 - DNA, 828 bp, Artificial Sequence
  Description of Artificial Sequence: Synthetic coding sequence
atgagcgccgaggtgaaggtgaccggccagaaccaggagcagttcctgctgctggccaagagcgccaagggcgccgccctggccaccctgatccaccaggtgctggaggcccccggcgtgtacgtgttcggcgagctgctggacatgcccaacgtgagagagctggccgagagcgacttcgccagcaccttcagactgctgaccgtgttcgcctacggcacctacgccgactacctggccgaggccagaaacctgccccccctgaccgaggcccagaagaacaagctgagacacctgagcgtggtgaccctggccgccaaggtgaagtgcatcccctacgccgtgctgctggaggccctggccctgagaaacgtgagacagctggaggacctggtgatcgaggccgtgtacgccgacgtgctgagaggcagcctggaccagagaaaccagagactggaggtggactacagcatcggcagagacatccagagacaggacctgagcgccatcgccagaaccctgcaggagtggtgcgtgggctgcgaggtggtgctgagcggcatcgaggagcaggtgagcagagccaaccagcacaaggagcagcagctgggcctgaagcagcagatcgagagcgaggtggccaacctgaagaagaccatcaaggtgaccaccgccgccgccgccgccgccaccagccaggaccccgagcagcacctgaccgagctgagagagcccgcccccggcaccaaccagagacagcccagcaagaaggccagcaagggcaagggcctgagaggcagcgccaagatctggagcaagagcaactag

SEQ ID NO: 12371 - DNA, 1506 bp, Artificial Sequence
  Description of Artificial Sequence: Synthetic coding sequence
atggccgcccccgagcccgcccccagaagagccagagagagagagagagagagagaggacgagagcgaggacgagagcgacatcctggaggagagcccctgcggcagatggcagaagagaagagagcaggtgaaccagggcaacatgcccggcctgcagagcaccttcctggccatggacaccgaggagggcgtggaggtggtgtggaacgagctgcacttcggcgacagaaaggccttcgccgcccacgaggagaagatccagaccgtgttcgagcagctggtgctggtggaccaccccaacatcgtgaagctgcacaagtactggctggacaccagcgaggcctgcgccagagtgatcttcatcaccgagtacgtgagcagcggcagcctgaagcagttcctgaagaagaccaagaagaaccacaaggccatgaacgccagagcctggaagagatggtgcacccagatcctgagcgccctgagcttcctgcacgcctgcagcccccccatcatccacggcaacctgaccagcgacaccatcttcatccagcacaacggcctgatcaagatcggcagcgtgtggcacagaatcttcagcaacgccctgcccgacgacctgagaagccccatcagagccgagagagaggagctgagaaacctgcacttcttcccccccgagtacggcgaggtggccgacggcaccgccgtggacatcttcagcttcggcatgtgcgccctggagatggccgtgctggagatccagaccaacggcgacaccagagtgaccgaggaggccatcgccagagccagacacagcctgagcgaccccaacatgagagagttcatcctgtgctgcctggccagagaccccgccagaagacccagcgcccacagcctgctgttccacagagtgctgttcgaggtgcacagcctgaagctgctggccgcccactgcttcatccagcaccagtacctgatgcccgagaacgtggtggaggagaagaccaaggccatggacctgcacgccgtgctggccgagctgcccagacccagaagaccccccctgcagtggagatacagcgaggtgagcttcatggagctggacaagttcctggaggacgtgagaaacggcatctaccccctgatgaacttcgccgccaccagacccctgggcctgcccagagtgctggcccccccccccgaggaggtgcagaaggccaagacccccacccccgagcccttcgacagcgagaccagaaaggtgatccagatgcagtgcaacctggagagaagcgaggacaaggccagatggcacctgaccctgctgctggtgctggaggacagactgcacagacagctgacctacgacctgctgcccaccgacagcgcccaggacctggccagcgagctggtgcactacggcttcctgcacgaggacgacagaatgaagctggccgccttcctggagagcaccttcctgaagtacagaggcacccaggcctag

SEQ ID NO: 12372 - DNA, 36 bp, Artificial Sequence
  Description of Artificial Sequence: Synthetic coding sequence
atgaccgcccccagctgcgccttccccgtgcagtag

SEQ ID NO: 12373 - DNA, 534 bp, Artificial Sequence
  Description of Artificial Sequence: Synthetic coding sequence
atgctgctggacaagaacgtgcccaaccccagaatcaagctgatcgacttcggcatcgcccacaagatcgaggccggcaacgagttcaagaacatcttcggcacccccgagttcgtggcccccgagatcgtgaactacgagcccctgggcctggaggccgacatgtggagcatcggcgtgatcacctacatcctgctgagcggcgccagccccttcctgggcgagaccaagcaggagaccctgaccaacatcagcgccgtgaactacgacttcgacgaggagtacttcagcaacaccagcgagctggccaaggacttcatcagaagactgctggtgaaggaccccaagagaagaatgaccatcgcccagagcctggagcacagctggatcaaggccatcagaagaagaaacgtgagaggcgaggacagcggcagaaagcccgagagaagaagactgaagaccaccagactgaaggagtacaccatcaagagccacagcagcgccagccccatcgtggcccccgtggacgcctag

SEQ ID NO: 12374 - DNA, 615 bp, Artificial Sequence
  Description of Artificial Sequence: Synthetic coding sequence
atgggcgacaagaagagccccaccagacccaagagacagcccaagcccagcagcgacgagggctactgggactgcagcgtgtgcaccttcagaaacagcgccgaggccttcaagtgcatgatgtgcgacgtgagaaagggcaccagcaccagaagcaccctgttcgaggtgatcgtgagcgccagcagaaccaaggagcccctgaagttccccatcagcggcagaaagcccagacccgtgagccagctggtggcccagcaggtgacccagcagttcgtgccccccacccagagcaagaaggagaagaaggacaaggtggagaaggagaagagcgagaaggagaccaccagcaagaagaacagccacaagaagaccagacccagactgaagaacgtggacagaagcagcgcccagcacctggaggtgaccgtgggcgacctgaccgtgatcatcaccgacttcaaggagaagaccaagagcccccccgccagcagcgccgccagcgccgaccagcacagccagagcggcagcagcagcgacaacaccgagagaggcatgagcagaagcagcagccccagaggcgaggccagcagcctgaacggcgagagccactag

SEQ ID NO: 12375 - DNA, 1350 bp, Artificial Sequence; identical to SEQ ID NO: 10423
  Description of Artificial Sequence: Synthetic coding sequence

SEQ ID NO: 12376 - DNA, 153 bp, Artificial Sequence
  Description of Artificial Sequence: Synthetic coding sequence
aagaccggcctgaccggcagccccagcagcctgtgggacctgctgagagagatgttcgtggtgtgcagcaaggagcagctgcagagcggcggcaagtacagccaccaggtgtgggcccccttcagccccctggccagcggcgccgccttctag

SEQ ID NO: 12377 - DNA, 4386 bp, Artificial Sequence
  Description of Artificial Sequence: Synthetic coding sequence
atgcagagagagctggtgtacgccagaggcgacggccccggcgcccccagacccggcagcaccgcccaccccccccacgccatccccaacagcccccccagcacccccgtgccccacagcatgccccccagccccagcagaatcccctacggcggcaccagaagcatggtggtgcccggcaacgccaccatccccagagacagaatcagcagcctgcccgtgagcagacccatcagccccagccccagcgccatcctggagagaagagacgtgaagcccgacgaggacatgagcggcaagaacatcgccatgtacagaaacgagggcttctacgccgacccctacctgtaccacgagggcagaatgagcatcgccagcagccacggcggccaccccctggacgtgcccgaccacatcatcgcctaccacagaaccgccatcagaagcgccagcgcctactgcaaccccagcatgcaggccgagatgcacatggagcagagcctgtacagacagaagagcagaaagtaccccgacagccacctgcccaccctgggcagcaagaccccccccgccagcccccacagagtgagcgacctgagaatgatcgacatgcacgcccactacaacgcccacggccccccccacaccatgcagcccgacagagccagccccagcagacaggccttcaagaaggagcccggcaccctggtgtacatcgagaagcccagaagcgccgccggcctgagcagcctggtggacctgggcccccccctgatggagaagcaggtgttcgcctacagcaccgccaccatccccaaggacagagagaccagcgagaagatgatgaagaccaccgccaacagaaaccacaccgacagcgccggcaccccccacgtgagcggcggcaagatgctgagcgccctggagagcaccgtgccccccagccagcccccccccgtgggcaccagcgccatccacatgagcctgctggagatgagaagaagcgtggccgagctgagactgcagctgcagcagatgagacagctgcagctgcagaaccaggagctgctgagagccatgatgaagaaggccgagctggagatcagcggcaaggtgatggagaccatgaagagactggaggaccccgtgcagagacagagagtgctggtggagcaggagagacagaagtacctgcacgaggaggagaagatcgtgaagaagctgtgcgagctggaggacttcgtggaggacctgaagaaggacagcaccgccgccagcagactggtgaccctgaaggacgtggaggacggcgccttcctgctgagacaggtgggcgaggccgtggccaccctgaagggcgagttccccaccctgcagaacaagatgagagccatcctgagaatcgaggtggaggccgtgagattcctgaaggaggagccccacaagctggacagcctgctgaagagagtgagaagcatgaccgacgtgctgaccatgctgagaagacacgtgaccgacggcctgctgaagggcaccgacgccgcccaggccgcccagtacatggccatggagaaggccaccgccgccgaggtgctgaagagccaggaggaggccgcccacaccagcggccagcccttccacagcaccggcgcccccggcgacgccaagagcgaggtggtgcccctgagcggcatgatggtgagacacgcccagagcagccccgtggtgatccagcccagccagcacagcgtggccctgctgaaccccgcccagaacctgccccacgtggccagcagccccgccgtgccccaggaggccaccagcaccctgcagatgagccaggccccccagagcccccagatccccatgaacggcagcgccatgcagagcctgttcatcgaggagatccacagcgtgagcgccaagaacagagccgtgagcatcgagaaggccgagaagaagtgggaggagaagagacagaacctggaccactacaacggcaaggagttcgagaagctgctggaggaggcccaggccaacatcatgaagagcatccccaacctggagatgccccccgccaccggccccctgcccagaggcgacgcccccgtggacaaggtggagctgagcgaggacagccccaacagcgagcaggacctggagaagctgggcggcaagagcccccccccccccccccccccccccagaagaagctacctgcccggcagcggcctgaccaccaccagaagcggcgacgtggtgtacaccggcagaaaggagaacatcaccgccaaggccagcagcgaggacgccggccccagcccccagaccagagccaccaagtaccccgccgaggagcccgccagcgcctggacccccagccccccccccgtgaccaccagcagcagcaaggacgaggaggaggaggaggaggagggcgacaagatcatggccgagctgcaggccttccagaagtgcagcttcatggacgtgaacagcaacagccacgccgagcccagcagagccgacagccacgtgaaggacaccagaagcggcgccaccgtgccccccaaggagaagaagaacctggagttcttccacgaggacgtgagaaagagcgacgtggagtacgagaacggcccccagatggagttccagaaggtgaccaccggcgccgtgagacccagcgacccccccaagtgggagagaggcatggagaacagcatcagcgacgccagcagaaccagcgagtacaagaccgagatcatcatgaaggagaacagcatcagcaacatgagcctgctgagagacagcagaaactacagccaggagaccgtgcccaaggccagcttcggcttcagcggcatcagccccctggaggacgagatcaacaagggcagcaagatcagcggcctgcagtacagcatccccgacaccgagaaccagaccctgaactacggcaagaccaaggagatggagaagcagaacaccgacaagtgccacgtgagcagccacaccagactgaccgagagcagcgtgcacgacttcaagaccgaggaccaggaggtgatcaccaccgacttcggccaggtggtgctgagacccaaggaggccagacacgccaacgtgaaccccaacgaggacggcgagagcagcagcagcagccccaccgaggagaacgccgccaccgacaacatcgccttcatgatcaccgagaccaccgtgcaggtgctgagcagcggcgaggtgcacgacatcgtgagccagaagggcgaggacatccagaccgtgaacatcgacgccagaaaggagatgacccccagacaggagggcaccgacaacgaggaccccgtggtgtgcctggacaagaagcccgtgatcatcatcttcgacgagcccatggacatcagaagcgcctacaagagactgagcaccatcttcgaggagtgcgacgaggagctggagagaatgatgatggaggagaagatcgaggaggaggaggaggaggagaacggcgacagcgtggtgcagaacaacaacaccagccagatgagccacaagaaggtggcccccggcaacctgagaaccggccagcaggtggagaccaagagccagccccacagcctggccaccgagaccagaaaccccggcggccaggagatgaacagaaccgagctgaacaagttcagccacgtggacagccccaacagcgagtgcaagggcgaggacgccaccgacgaccagttcgagagccccaagaagaagttcaagttcaagttccccaagaagcagctggccgccctgacccaggccatcagaaccggcaccaagaccggcaagaagaccctgcaggtggtggtgtacgaggaggaggaggaggacggcaccctgaagcagcacaaggaggccaagagattcgagatcgccagaagccagcccgaggacacccccgagaacaccgtgagaagacaggagcagcccagcatcgagagcaccagccccatcagcagaaccgacgagatcagaaagaacacctacagaaccctggacagcctggagcagaccatcaagcagctggagaacaccatcagcgagatgagccccaaggccctggtggacaccagctgcagcagcaacagagacagcgtggccagcagcagccacatcgcccaggaggccagccccagacccctgctggtgcccgacgagggccccaccgccctggagccccccaccagcatccccagcgccagcagaaagggcagcagcggcgccccccagaccagcagaatgcccgtgcccatgagcgccaagaacagacccggcaccctggacaagcccggcaagcagagcaagctgcaggaccccagacagtacagacagtag

SEQ ID NO: 12378 - DNA, 2118 bp, Artificial Sequence
  Description of Artificial Sequence: Synthetic coding sequence
atgctgaccctgctggccgaggacagagccgtgcccagcgcccccaccggccccggccccctgctggagttcgccctgcacgaggacctgctgaccagagtgctgacctggcagctgcagtgggacgagctgggcgacggcgtggaggagagaagagccgagcagctgaagctgttcgagatgctggtgagcgaggccagacagcccctgctgagacacggccccgtgagagaggccctgctgaccctgctggacgcctgcggcagacccgtgcccagcagccccgccctggacgagggcctggtgctgctgctgagccagctgtgcgtgtgcgtggcccaggagcccagcctgctggagttcttcctgcagcccccccccgagcccggcgccgcccccagactgctgctgttcagcagactggtgcccttcgtgcacagagagggcaccctgggccagcaggccagagacgccctgctgctgctgatggccctgagcgccggcagccccaccgtgggcagatacatcgccgaccacagctacttctgccccgtgctggccaccggcctgagcgccctgtacagcagcctgcccagaaagatcgaggtgcccggcgacgactggcactgcctgagaagagaggactggctgggcgtgcccgccctggccctgttcatgagcagcctggagttctgcaacgccgtgatccaggtggcccaccccctggtgcagaagcagctggtggactacatccacaacggcttcctggtgcccgtgatgggccccgccctgcacaagaccagcgtggaggagatgatcgccagcaccgcctacctggagctgttcctgagaagcatcagcgagcccgccctgctgagaaccttcctgagattcctgctgctgcacagacacgacacccacaccatcctggacaccctggtggccagaatcggcagcaacagcagactgtgcatggtgagcctgagcctgttcagaaccctgctgaacctgagctgcgaggacgtgctgctgcagctggtgctgagatacctggtgccctgcaaccacgtgatgctgagccagaagcccgccgtgagagacgtggacctgtacggcagagccgccgacaagttcctgagcctgatccccagatgctgcagacaccacgcccccagcccccccagacccgagcacgccagctgggccagaggccccggcagccccagcgtggacagcagcagcgtgaccaccgtgcccagacccagcacccccagcagactggccctgttcctgagacagcagagcctgggcggcagcgagagccccggccccgccccctgcagccccggcctgagcgccagccccgccagcagccccggcagaagacccacccccgccgaggagcccggcgagctggaggacaactacctggagtacctgagagaggccagaagaggcgtggacagatgcgtgagagcctgcagaacctggagcgccccctacgacggcgagagacccagccccgagcccagccccttcggcagcagaaccaagaagagaagcctgctgcccgaggaggacagaaacaacgtgggcgagggcgaggaggaggagctgggcagaagaggcagagccggcggcgccggcgagggccccggccacctgccccccccccagctgaacggcgtgcccggcagctggcccgagggcgccaagaaggtgagactggtgcccaaggagggcgccggcgagctgctggagggcatcagcgagggcatggccggcctggagggcttcggccaggagctgagagagctggaggtggccctgagcaacggcggcaccggcagcgagagccccctggagccccccctgcccctggaggaggaggaggcctacgagagcttcacctgcccccccgagccccccggccccttcctgagcagccccctgagaaccctgaaccagctgcccagccagcccttcaccggccccttcatggccgtgctgttcgccaagctggagaacatgctgcagaacagcgccctgagctgcagcacccccacctggagcagcagccccgtgagcagcccctgctgcagatgctgggccctgtag

SEQ ID NO: 12379 - DNA, 804 bp, Artificial Sequence
  Description of Artificial Sequence: Synthetic coding sequence
atgatgagaggctacatcaagaaggtgctgaagaacaccagctaccacgtgaaccagtacctgttcatccagcacggctggagcggcagcggcgaccagagcgtgctgtacagctgcaacctgatgagaatggtgaccagaaccaagaagatcttcgtgggcggcctgagcgccaacaccgtggtggaggacgtgaagcagtacttcgagcagttcggcaaggtggaggacgccatgctgatgttcgacaagaccaccaacagacacagaggcttcggcttcgtgaccttcgagaacgaggacgtggtggagaaggtgtgcgagatccacttccacgagatcaacaacaagatggtggagtgcaagaaggcccagcccaaggaggtgatgttcccccccggcaccagaggcagagccagaggcctgccctacaccatggacgccttcatgctgggcatgggcatgctgggctaccccaacttcgtggccacctacggcagaggctaccccggcttcgcccccagctacggctaccagttccccggcttccccgccgccgcctacggccccgtggccgccgccgccgtggccgccgccagaggcagcggcagcaaccccgccagacccggcggcttccccggcgccaacagccccggccccgtggccgacctgtacggccccgccagccaggacagcggcgtgggcaactacatcagcgccgccagcccccagcccggcagcggcttcggccacggcatcgccggccccctgatcgccaccgccttcaccaacggctaccactag

SEQ ID NO: 12380 - DNA, 483 bp, Artificial Sequence
  Description of Artificial Sequence: Synthetic coding sequence
atgagcagccccctggccagcctgagcaagaccagaaaggtgcccctgcccagcgagcccatgaaccccggcagaagaggcatcagaatctacggcgacgtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagcccggcggcctgatcggcgccccctag

SEQ ID NO: 12381 - DNA, 462 bp, Artificial Sequence
  Description of Artificial Sequence: Synthetic coding sequence
tgaagcgtgcagagccccgcccagcagcaggtgcccgccagacccggcgcccccagcgtgcaggtgcccagccccttcctgctgcagaaccagtacgagcccgtgcagccccactggttctactgcaaggaggtggagtacaagcagctgtggatgcccttcagcgtgttcgacagcctgaacctggaggagatctacaacagcgtgcagcccgaccccgagagcgtggtgctgggcaccgacggcggcagatacgacgtgtacctgtacgacagaatcagaaaggccgcctactgggaggaggagcccgccgaggtgagaagatgcacctggttctacaagggcgacaccgacagcagattcatcccctacaccgaggagttcagcgagaagctggaggtgagagtgctgtacttcttcatgagcttcttcaagaagtgcagaagctacatccactggtag

SEQ ID NO: 12382 - DNA, 1062 bp, Artificial Sequence
  Description of Artificial Sequence: Synthetic coding sequence
atggagcaggagctggagcagctggcccagctgcccagcagcaagaacagcctgctgaaggacgccatggcccccggcacccccaagagcctgctgctgagcgccagcatcaagagagagggcgagagccccaccgccagcccccacagcagcgccaccgacgacctgcaccacagcgacagataccagaccttcctgagagtgagagccaacagacagaccagactgaacgccagaatcggcaagatgaagagaagaaagcaggacgagggccaggtgtgccccctgtgcaacagacccctggccggcagcgagcaggagatgagcagacacgtggagcactgcctgagcaagagagagggcagctgcatggccgaggacgacgccgtggacatcgagcacgagaacaacaacagattcgaggagtacgagtggtgcggccagaagagaatcagagccaccaccctgctggagggcggcttcagaggcagcggcttcatcatgtgcagcggcaaggagaaccccgacagcgacgccgacctggacgtggacggcgacgacaccctggagtacggcaagccccagtacaccgaggccgacgtgatcccctgcaccggcgaggagcccggcgaggccaaggagagagaggccctgagaggcgccgtgctgaacggcggcccccccagcaccagaatcacccccgagttcagcaagtgggccagcgacgagatgcccagcaccagcaacggcgagagcagcaagcaggaggccatgcagaagacctgcaagaacagcgacatcgagaagatcaccgaggacagcgccgtgaccaccttcgaggccctgaaggccagagtgagagagctggagagacagctgagcagaggcgacagatacaagtgcctgatctgcatggacagctacagcatgcccctgaccagcatccagtgctggcacgtgcactgcgaggagtgctggctgagaaccctgggcgccaagaagctgtgcccccagtgcaacaccatcaccgcccccggcgacctgagaagaatctacctgtag

SEQ ID NO: 12383 - DNA, 1782 bp, Artificial Sequence; identical to SEQ ID NO: 10388
  Description of Artificial Sequence: Synthetic coding sequence

SEQ ID NO: 12384 - DNA, 363 bp, Artificial Sequence
  Description of Artificial Sequence: Synthetic coding sequence
ctggccctgcagatcagcgagaacctgttcagcaacaaggtgctgaacgccctgaagcccgagaaggacgtggacggcgtgaccgacatcaacctgggcaagctggtgagaggcgacgcccacgagtgcttcgtgagccccgtggccaaggccgtgatcgagctgctggagaagagcggcgtgaacctggacggcaagaagatcctggtggtgggcgcccacggcagcctggaggccgccctgcagtgcctgttccagagaaagggcagcatgaccatgagcatccagtggaagaccagacagctgcagagcaagaccgagagcagaagcgtgaccagactggagtgcagaagagtgatctag

SEQ ID NO: 12385 - DNA, 1167 bp, Artificial Sequence
  Description of Artificial Sequence: Synthetic coding sequence
atgagcggcaccttcctgatcagaaagccccagctgctgcagggcgtgtacgccatgggcttcaacagacccagcaagatccaggagaacgccctgcccatgatgctggccgagcccccccagaacctgatcgcccagagccagagcggcaccggcaagaccgccgccttcgtgctggccatgctgagcagagtggagcccagcgacagatacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 12386 - DNA, 1821 bp, Artificial Sequence
  Description of Artificial Sequence: Synthetic coding sequence
ctgagacagtgctacaactacaactgccccagcttcctggccgccgccctggccagagccaccagcgacgaggtgctgcagagcgacctgagcgcccactacatccccaaggagaccgacggcaccgagggcaccgtggagatcgagaccgtgaagctggccagaagcgtgttcagcaagctgcacgagatctgctgcagctgggtgaaggacttccccctgagaagaagaccccagctgtactacgagaccagcatccacgccatcaagaacatgagaaagctgttctacaagcacatcagcaagaagaagaagaagagaaagaagagagactgggaccaggaggagcaggcctacttcgccgtgttcgacggccacggcggcgtggacgccgccatctacgccagcatccacctgcacgtgaacctggtgagacaggagatgttcccccacgaccccgccgaggccctgtgcagagccttcagagtgaccgacgagagattcgtgcagaaggccgccagagagagcctgagatgcggcaccaccggcgtggtgaccttcatcagaggcaacatgctgcacgtggcctgggtgggcgacagccaggtgatgctggtgagaaagggccaggccgtggagctgatgaagccccacaagcccgacagagaggacgagaagcagagaatcgaggccctgggcggctgcgtggtgtggttcggcgcctggagagtgaacggcagcctgagcgtgagcagagccatcggcgacgccgagcacaagccctacatctgcggcgacgccgacagcgccagcaccgtgctggacggcaccgaggactacctgatcctggcctgcgacggcttctacgacaccgtgaaccccgacgaggccgtgaaggtggtgagcgaccacctgaaggagaacaacggcgacagcagcatggtggcccacaagctggtggccagcgccagagacgccggcagcagcgacaacatcaccgtgatcgtggtgttcctgagagacatgaacaaggccgtgaacgtgagcgaggagagcgactggaccgagaacagcttccagggcggccaggaggacggcggcgacgacaaggagaaccacggcgagtgcaagagaccctggccccagcaccagtgcagcgcccccgccgacctgggctacgacggcagagtggacagcttcaccgacagaaccagcctgagccccggcagccagatcaacgtgctggaggaccccggctacctggacctgacccagatcgaggccagcaagccccacagcgcccagttcctgctgcccgtggagatgttcggccccggcgcccccaagaaggccaacctgatcaacgagctgatgatggagaagaagagcgtgcagagcagcctgcccgagtggagcggcgccggcgagttccccaccgccttcaacctgggcagcaccggcgagcagatctacagaatgcagagcctgagccccgtgtgcagcggcctggagaacgagcagttcaagagccccggcaacagagtgagcagactgagccacctgagacaccactacagcaagaagtggcacagattcagattcaaccccaagttctacagcttcctgagcgcccaggagcccagccacaagatcggcaccagcctgagcagcctgaccggcagcggcaagagaaacagaatcagaagcagcctgccctggagacagaacagctggaagggctacagcgagaacatgagaaagctgagaaagacccacgacatcccctgccccgacctgccctggagctacaagatcgagtag

SEQ ID NO: 12387 - DNA, 678 bp, Artificial Sequence
  Description of Artificial Sequence: Synthetic coding sequence
atggagaacctgctgcaggccaccaagagccacgtggacaaggtgatcatgaagctgggcaagaccaacgccaaggccgtgagcgagatgagacagaagatctggaacaacatgcccaaggaccaccccgaccacgagctgatcgaccccttccccgtgcccctggtgatcatcggcagcaagtacgacgtgttccaggacttcgagagcgagaagagaaaggtgatctgcaagaccctgagattcgtggcccactactacggcgccagcctgatgttcaccagcaagagcgaggccctgctgctgaagatcagaggcgtgatcaaccagctggccttcggcatcgacaagagcaagagcatctgcgtggaccagaacaagcccctgttcatcaccgccggcctggacagcttcggccagatcggcagcccccccgtgcccgagaacgacatcggcaagctgcacgcccacagccccatggagctgtggaagaaggtgtacgagaagctgttcccccccaagagcatcaacaccctgaaggacatcaaggaccccgccagagacccccagtacgccgagaacgaggtggacgagatgagaatccagaaggacctggagctggagcagtacaagagaagcagcagcaagagctggaagcagatcgagctggacagctag

SEQ ID NO: 12388 - DNA, 621 bp, Artificial Sequence
  Description of Artificial Sequence: Synthetic coding sequence
atgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtactag

SEQ ID NO: 12389 - DNA, 468 bp, Artificial Sequence
  Description of Artificial Sequence: Synthetic coding sequence
atgggcaaggactactacaagatcctgggcatccccagcggcgccaacgaggacgagatcaagaaggcctacagaaagatggccctgaagtaccaccccgacaagaacaaggagcccaacgccgaggagaagttcaaggagatcgccgaggcctacgacgtgctgagcgaccccaagaagagaggcctgtacgaccagtacggcgaggagggcctgaagaccggcggcggcaccagcggcggcagcagcggcagcttccactacaccttccacggcgacccccacgccaccttcgccagcttcttcggcggcagcaaccccttcgacatcttcttcgccagcagcagaagcaccagacccttcagcggcttcgaccccgacgacatggacgtggacgaggacgaggaccccttcggcgccttcggcagattcggcttcaacggcctgagcagaggccccagaagatag

SEQ ID NO: 12390 - DNA, 246 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggccgaggtgagcatcaacgaggacggcaccctgttcgacggcagacccatcgagagcctgtag

SEQ ID NO: 12391 - DNA, 1248 bp, Artificial Sequence
  Description of Artificial Sequence: Synthetic coding sequence
atggcccccgtgggcgtggagaagaagctgctgctgggccccaacggccccgccgtggccgccgccggcgacctgaccagcgaggaggaggagggccagagcctgtggagcagcatcctgagcgaggtgagcaccagagccagaagcaagctgcccagcggcaagaacatcctggtgttcggcgaggacggcagcggcaagaccaccctgatgaccaagctgcagggcgccgagcacggcaagaagggcagaggcctggagtacctgtacctgagcgtgcacgacgaggacagagacgtggtgaaggacttccaggactacatggagcccgaggagggctgccagggcagcccccagagaagaggccccctgaccagcggcagcgacgaggagaacgtggccctgcccctgggcgacaacgtgctgacccacaacctgggcatccccgtgctggtggtgtgcaccaagtgcgacgccgtgagcgtgctggagaaggagcacgactacagagacgagcacctggacttcatccagagccacctgagaagattctgcctgcagtacggcgccgccctgatctacaccagcgtgaaggaggagaagaacctggacctgctgtacaagtacatcgtgcacaagacctacggcttccacttcaccacccccgccctggtggtggagaaggacgccgtgttcatccccgccggctgggacaacgagaagaagatcgccatcctgcacgagaacttcaccaccgtgaagcccgaggacgcctacgaggacttcatcgtgaagccccccgtgagaaagctggtgcacgacaaggagctggccgccgaggacgagcaggtgttcctgatgaagcagcagagcctgctggccaagcagcccgccacccccaccagagccagcgagagccccgccagaggccccagcggcagccccagaacccagggcagaggcggccccgccagcgtgcccagcagcagccccggcaccagcgtgaagaagcccgaccccaacatcaagaacaacgccgccagcgagggcgtgctggccagcttcttcaacagcctgctgagcaagaagaccggcagccccggcagccccggcgccggcggcgtgcagagcaccgccaagaagagcggccagaagaccgtgctgagcaacgtgcaggaggagctggacagaatgaccagaaagcccgacagcatggtgaccaacagcagcaccgagaacgaggcctag

SEQ ID NO: 12392 - DNA, 1929 bp, Artificial Sequence
  Description of Artificial Sequence: Synthetic coding sequence
atgagaagcatcacccagggcgcctgcagattcatctgggaggacaagggctacatcagcggcgaccacatcaacctggtgagcagcagcctgagcagcttccccatcctgcagagaagcagcgaggagaagatcctgtacagcgacagactgagcctggagagacagaagctgaccgtgtgccccatcatcaacggcgaggaccacctgagactgctgaacttccagcacaacttcatcaccagaatccagaacatcagcaacctgcagaagctgatcagcctggacctgtacgacaaccagatcgaggagatcagcggcctgagcaccctgagatgcctgagagtgctgctgctgggcaagaacagaatcaagaagatcagcaacctggagaacctgaagagcctggacgtgctggacctgcacggcaaccagatcaccaagatcgagaacatcaaccacctgtgcgagctgagagtgctgaacctggccagaaacttcctgagccacgtggacaacctgaacggcctggacagcctgaccgagctgaacctgagacacaaccagatcaccttcgtgagagacgtggacaacctgccctgcctgcagcacctgttcctgagcttcaacaacatcagcagcttcgacagcgtgagctgcctggccgacagcagcagcctgagcgacatcaccttcgacggcaaccccatcgcccaggagagctggtacaagcacaccgtgctgcagaacatgatgcagctgagacagctggacatgaagagaatcaccgaggaggagagaagaatggccagcgtgctggccaagaaggaggaggagaagaagagagagagccacaagcagagcctgctgaaggagaagaagagactgaccatcaacaacgtggccagacagtgggacctgcagcagcagagagtggccaacatcgccaccaacgaggacagaaaggacagcgacagcccccaggacccctgccagatcgacggcagcaccctgagcgccttccccgaggagaccggccccctggacagcggcctgaacaacgccctgcagggcctgagcgtgatcgacacctacctggtggaggtggacggcgacaccctgagcctgtacggcagcggcgccctggagagcctggacagaaactggagcgtgcagaccgccggcatgatcaccaccgtgagcttcaccttcatcgagttcgacgagatcgtgcaggtgctgcccaagctgaagatcaagttccccaacagcctgcacctgaagttcaaggagaccaacctggtgatgctgcagcagttcaacgccctggcccagctgagaagaatcgaccagctgaccatcgacccccagggcaaccccgtggtgaacttcaccctgtggaagtactacgtgctgttcagactgagccacttcagcatgcagaagatcaacggcaccgaggtgacccagaacgacatgatcatggccgagagactgttcggcatcctggcccacgtggccagcagcgagctgccccagtacagactgatcagcatcctgggcgacgccagaaagaagcagttcagatacctgctggagagcaagggcaagaagcccggcatcatcaacgaggagaacaacgacagcaagagactggtgggcgagaacaccaacagagccaccctgaactacaccaccagagacttctacaacgagaagctggaggagatcaaggagaagaagaagttctgcaagacctacatcgaggacctggtgaaggaggccaccgagatcaacatgaagaacgaggccctgcagaagctgtggccccagatgttcatcgagctggtgagagacgccgtgatcgagatcagaaacaagaacagctacatgaagctgtgcctgcagcagatcaccgaccagaagtag

SEQ ID NO: 12393 - DNA, 432 bp, Artificial Sequence
  Description of Artificial Sequence: Synthetic coding sequence
agactgggcagatacgaggtggagaagagatgcgccgtggagaaggaggactacgacctggccaaggagaagaagcagcagatggagcagtacagagccgaggtgtacgagcagctggagctgcacagcctgctggacgccgagctgcacagcgccgtggaccccctgctgcccgccaccgacccccaccccaagatcaacgccgagagcctgccctacgacgagagacccctgcccgccatcagaaagcactacggcgaggccgtggtggagcccgagatgagcaacgccgacatcagcgacgccagaagaggcggcatgctgggcgagcccgagcccctgaccgagaaggccctgagagaggccagcagcgccatcgacgtgctgggcgagaccctggtggccgaggcctactgcaagacctggagctag

SEQ ID NO: 12394 - DNA, 1842 bp, Artificial Sequence; identical to SEQ ID NO: 9548
  Description of Artificial Sequence: Synthetic coding sequence

SEQ ID NO: 12395 - DNA, 552 bp, Artificial Sequence
  Description of Artificial Sequence: Synthetic coding sequence
atgggccccctgcccagaaccgtggagctgttctacgacgtgctgagcccctacagctggctgggcttcgagatcctgtgcagataccagaacatctggaacatcaacctgcagctgagacccagcctgatcaccggcatcatgaaggacagcggcagcctgagcgccatgagattcctgaccgccgtgaacctggagcaccccgagatgctggagaaggccagcagagagctgtggatgagagtgtggagcagaaacgaggacatcaccgagccccagagcatcctggccgccgccgagaaggccggcatgagcgccgagcaggcccagggcctgctggagaagatcgccacccccaaggtgaagaaccagctgaaggagaccaccgaggccgcctgcagatacggcgccttcggcctgcccatcaccgtggcccacgtggacggccagacccacatgctgttcggcagcgacagaatggagctgctggcccacctgctgggcgagaagtggatgggccccatcccccccgccgtgaacgccagactgtag

SEQ ID NO: 12396 - DNA, 306 bp, Artificial Sequence
  Description of Artificial Sequence: Synthetic coding sequence
gagggcaccagcggcaagaccgccctgcacctggccgtggagacccaggagagaggcctggtgcagttcctgctgcaggccggcgcccaggtggacgccagaatgctgaacggctgcacccccctgcacctggccgccggcagaggcctgatgggcatcagcagcaccctgtgcaaggccggcgccgacagcctgctgagaaacgtggaggacgagaccccccaggacctgaccgaggagagcctggtgctgctgcccttcgacgacctgaagatcagcggcaagctgctgctgtgcaccgactag

SEQ ID NO: 12397 - DNA, 14586 bp, Artificial Sequence
  Description of Artificial Sequence: Synthetic coding sequence
atggccaccatgatcccccccgtgaagctgaagtggctggagcacctgaacagcagctggatcaccgaggacagcgagagcatcgccaccagagagggcgtggccgtgctgtacagcaagctggtgagcaacaaggaggtggtgcccctgccccagcaggtgctgtgcctgaagggcccccagctgcccgacttcgagagagagagcctgagcagcgacgagcaggaccactacctggacgccctgctgagcagccagctggccctggccaagatggtgtgcagcgacagccccttcgccggcgccctgagaaagagactgctggtgctgcagagagtgttctacgccctgagcaacaagtaccacgacaagggcaaggtgaagcagcagcagcacagccccgagagcagcagcggcagcgccgacgtgcacagcgtgagcgagagacccagaagcagcaccgacgccctgatcgagatgggcgtgagaaccggcctgagcctgctgttcgccctgctgagacagagctggatgatgcccgtgagcggccccggcctgagcctgtgcaacgacgtgatccacaccgccatcgaggtggtgagcagcctgccccccctgagcctggccaacgagagcaagatcccccccatgggcctggactgcctgagccaggtgaccaccttcctgaagggcgtgaccatccccaacagcggcgccgacaccctgggcagaagactggccagcgagctgctgctgggcctggccgcccagagaggcagcctgagatacctgctggagtggatcgagatggccctgggcgccagcgccgtggtgcacaccatggagaagggcaagctgctgagcagccaggagggcatgatcagcttcgactgcttcatgaccatcctgatgcagatgagaagaagcctgggcagcagcgccgacagaagccagtggagagagcccaccagaaccagcgacggcctgtgcagcctgtacgaggccgccctgtgcctgttcgaggaggtgtgcagaatggccagcgactacagcagaacctgcgccagccccgacagcatccagaccggcgacgcccccatcgtgagcgagacctgcgaggtgtacgtgtggggcagcaacagcagccaccagctggtggagggcacccaggagaagatcctgcagcccaagctggcccccagcttcagcgacgcccagaccatcgaggccggccagtactgcaccttcgtgatcagcaccgacggcagcgtgagagcctgcggcaagggcagctacggcagactgggcctgggcgacagcaacaaccagagcaccctgaagaagctgaccttcgagccccacagaagcatcaagaaggtgagcagcagcaagggcagcgacggccacaccctggccttcaccaccgagggcgaggtgttcagctggggcgacggcgactacggcaagctgggccacggcaacagcagcacccagaagtaccccaagctgatccagggccccctgcagggcaaggtggtggtgtgcgtgagcgccggctacagacacagcgccgccgtgaccgaggacggcgagctgtacacctggggcgagggcgacttcggcagactgggccacggcgacagcaacagcagaaacatccccaccctggtgaaggacatcagcaacgtgggcgaggtgagctgcggcagcagccacaccatcgccctgagcaaggacggcagaaccgtgtggagcttcggcggcggcgacaacggcaagctgggccacggcgacaccaacagagtgtacaagcccaaggtgatcgaggccctgcagggcatgttcatcagaaaggtgtgcgccggcagccagagcagcctggccctgaccagcaccggccaggtgtacgcctggggctgcggcgcctgcctgggctgcggcagcagcgaggccaccgccctgagacccaagctgatcgaggagctggccgccaccagaatcgtggacgtgagcatcggcgacagccactgcctggccctgagccacgacaacgaggtgtacgcctggggcaacaacagcatgggccagtgcggccagggcaacagcaccggccccatcaccaagcccaagaaggtgagcggcctggacggcatcgccatccagcagatcagcgccggcaccagccacagcctggcctggaccgccctgcccagagacagacaggtggtggcctggcacagaccctactgcgtggacctggaggagagcaccttcagccacctgagaagcttcctggagagatactgcgacaagatcaacagcgagatcccccccctgcccttccccagcagcagagagcaccacagcttcctgaagctgtgcctgaagctgctgagcaaccacctggccctggccctggccggcggcgtggccaccagcatcctgggcagacaggccggccccctgagaaacctgctgttcagactgatggacagcaccgtgcccgacgagatccaggaggtggtgatcgagaccctgagcgtgggcgccaccatgctgctgccccccctgagagagagaatggagctgctgcacagcctgctgccccagggccccgacagatgggagagcctgagcaagggccagagaatgcagctggacatcatcctgaccagcctgcaggaccacacccacgtggccagcctgctgggctacagcagccccagcgacgccgccgacctgagcagcgtgtgcaccggctacggcaacctgagcgaccagccctacggcacccagagctgccaccccgacacccacctggccgagatcctgatgaagaccctgctgagaaacctgggcttctacaccgaccaggccttcggcgagctggagaagaacagcgacaagttcctgctgggcaccagcagcagcgagaacagccagcccgcccacctgcacgagctgctgtgcagcctgcagaagcagctgctggccttctgccacatcaacaacatcagcgagaacagcagcagcgtggccctgctgcacaagcacctgcagctgctgctgccccacgccaccgacatctacagcagaagcgccaacctgctgaaggagagcccctggaacggcagcgtgggcgagaagctgagagacgtgatctacgtgagcgccgccggcagcatgctgtgccagatcgtgaacagcctgctgctgctgcccgtgagcgtggccagacccctgctgagctacctgctggacctgctgccccccctggactgcctgaacagactgctgcccgccgccgacctgctggaggaccaggagctgcagtggcccctgcacggcggccccgagctgatcgaccccgccggcctgcccctgccccagcccgcccagagctgggtgtggctggtggacctggagagaaccatcgccctgctgatcggcagatgcctgggcggcatgctgcagggcagccccgtgagccccgaggagcaggacaccgcctactggatgaagacccccctgttcagcgacggcgtggagatggacaccccccagctggacaagtgcatgagctgcctgctggaggtggccctgagcggcaacgaggagcagaagcccttcgactacaagctgagacccgagatcgccgtgtacgtggacctggccctgggctgcagcaaggagcccgccagaagcctgtggatcagcatgcaggactacgccgtgagcaaggactgggacagcgccaccctgagcaacgagagcctgctggacaccgtgagcagattcgtgctggccgccctgctgaagcacaccaacctgctgagccaggcctgcggcgagagcagataccagcccggcaagcacctgagcgaggtgtacagatgcgtgtacaaggtgagaagcagactgctggcctgcaagaacctggagctgatccagaccagaagcagcagcagagacagatggatcagcgagaaccaggacagcgccgacgtggacccccaggagcacagcttcaccagaaccatcgacgaggaggccgagatggaggagcaggccgagagagacagagaggagggccaccccgagcccgaggacgaggaggaggagagagagcacgaggtgatgaccgccggcaagatcttccagtgcttcctgagcgccagagaggtggccagaagcagagacagagacagaatgaacagcggcgccggcagcggcgccagagccgacgacccccccccccagagccagcaggagagaagagtgagcaccgacctgcccgagggccaggacgtgtacaccgccgcctgcaacagcgtgatccacagatgcgccctgctgatcctgggcgtgagccccgtgatcgacgagctgcagaagagaagagaggagggccagctgcagcagcccagcaccagcgccagcgagggcggcggcctgatgaccagaagcgagagcctgaccgccgagagcagactggtgcacaccagccccaactacagactgatcaagagcagaagcgagagcgacctgagccagcccgagagcgacgaggagggctacgccctgagcggcagaagaaacgtggacctggacctggccgccagccacagaaagagaggccccatgcacagccagctggagagcctgagcgacagctgggccagactgaagcacagcagagactggctgtgcaacagcagctacagcttcgagagcgacttcgacctgaccaagagcctgggcgtgcacaccctgatcgagaacgtggtgagcttcgtgagcggcgacgtgggcaacgcccccggcttcaaggagcccgaggagagcatgagcaccagcccccaggccagcatcatcgccatggagcagcagcagctgagagccgagctgagactggaggccctgcaccagatcctggtgctgctgagcggcatggaggagaagggcagcatcagcctggccggcagcagactgagcagcggcttccagagcagcaccctgctgaccagcgtgagactgcagttcctggccggctgcttcggcctgggcaccgtgggccacaccggcggcaagggcgagagcggcagactgcaccactaccaggacggcatcagagccgccaagagaaacatccagatcgagatccaggtggccgtgcacaagatctaccagcagctgagcgccaccctggagagagccctgcaggccaacaagcaccacatcgaggcccagcagagactgctgctggtgaccgtgttcgccctgagcgtgcactaccagcccgtggacgtgagcctggccatcagcaccggcctgctgaacgtgctgagccagctgtgcggcaccgacaccatgctgggccagcccctgcagctgctgcccaagaccggcgtgagccagctgagcaccgccctgaaggtggccagcaccagactgctgcagatcctggccatcaccaccggcacctacgccgacaagctgagccccaaggtggtgcagagcctgctggacctgctgtgcagccagctgaagaacctgctgagccagaccggcgtgctgcacatggccagcttcggcgagggcgagcaggaggacggcgaggaggaggagaagaaggtggacagcagcggcgagaccgagaagaaggacttcagagccgccctgagaaagcagcacgccgccgagctgcacctgggcgacttcctggtgttcctgagaagagtggtgagcagcaaggccatccagagcaagatggccagccccaagtggaccgaggtgctgctgaacatcgccagccagaagtgcagcagcggcatccccctggtgggcaacctgagaaccagactgctggccctgcacgtgctggaggccgtgctgcccgcctgcgagagcggcgtggaggacgaccagatggcccagatcgtggagagactgttcagcctgctgagcgactgcatgtgggagacccccatcgcccaggccaagcacgccatccagatcaaggagaaggagcaggagatcaagctgcagaagcagggcgagctggaggaggaggacgagaacctgcccatccaggaggtgagcttcgaccccgagaaggcccagtgctgcctggtggagaacggccagatcctgacccacggcagcggcggcaagggctacggcctggccagcaccggcgtgaccagcggctgctaccagtggaagttctacatcgtgaaggagaacagaggcaacgagggcacctgcgtgggcgtgagcagatggcccgtgcacgacttcaaccacagaaccaccagcgacatgtggctgtacagagcctacagcggcaacctgtaccacaacggcgagcagaccctgaccctgagcagcttcacccagggcgacttcatcacctgcgtgctggacatggaggccagaaccatcagcttcggcaagaacggcgaggagcccaagctggccttcgaggacgtggacgccgccgagctgtacccctgcgtgatgttctacagcagcaaccccggcgagaaggtgaagatctgcgacatgcagatgagaggcacccccagagacctgctgcccggcgaccccatctgcagccccgtggccgccgtgctggccgaggccaccatccagctgatcagaatcctgcacagaaccgacagatggacctactgcatcaacaagaagatgatggagagactgcacaagatcaagatctgcatcaaggagagcggccagaagctgaagaagagcagaagcgtgcagagcagagaggagaacgagatgagagaggagaaggagagcaaggaggaggagaagggcaagcacaccagacacggcctggccgacctgagcgagctgcagctgagaaccctgtgcatcgaggtgtggcccgtgctggccgtgatcggcggcgtggacgccggcctgagagtgggcggcagatgcgtgcacaagcagaccggcagacacgccaccctgctgggcgtggtgaaggagggcagcaccagcgccaaggtgcagtgggacgaggccgagatcaccatcagcttccccaccttctggagccccagcgacacccccctgtacaacctggagccctgcgagcccctgcccttcgacgtggccagattcagaggcctgaccgccagcgtgctgctggacctgacctacctgaccggcgtgcacgaggacatgggcaagcagagcaccaagagacacgagaagaagcacagacacgagagcgaggagaagggcgacgtggagcagaagcccgagagcgagagcgccctggacatgagaaccggcctgaccagcgacgacgtgaagagccagagcaccaccagcagcaagagcgagaacgagatcgccagcttcagcctggaccccaccctgcccagcgtggagagccagcaccagatcaccgagggcaagagaaagaaccacgagcacatgagcaagaaccacgacgtggcccagagcgagatcagagccgtgcagctgagctacctgtacctgggcgccatgaagagcctgagcgccctgctgggctgcagcaagtacgccgagctgctgctgatccccaaggtgctggccgagaacggccacaacagcgactgcgccagcagccccgtggtgcacgaggacgtggagatgagagccgccctgcagttcctgatgagacacatggtgaagagagccgtgatgagaagccccatcaagagagccctgggcctggccgacctggagagagcccaggccatgatctacaagctggtggtgcacggcctgctggaggaccagttcggcggcaagatcaagcaggagatcgaccagcaggccgaggagagcgaccccgcccagcaggcccagacccccgtgaccaccagccccagcgccagcagcaccaccagcttcatgagcagcagcctggaggacaccaccaccgccaccacccccgtgaccgacaccgagaccgtgcccgccagcgagagccccggcgtgatgcccctgagcctgctgagacagatgttcagcagctaccccaccaccaccgtgctgcccaccagaagagcccagaccccccccatcagcagcctgcccaccagccccagcgacgaggtgggcagaagacagagcctgaccagccccgacagccagagcgccagacccgccaacagaaccgccctgagcgaccccagcagcagactgagcaccagcccccccccccccgccatcgccgtgcccctgctggagatgggcttcagcctgagacagatcgccaaggccatggaggccaccggcgccagaggcgaggccgacgcccagaacatcaccgtgctggccatgtggatgatcgagcaccccggccacgaggacgaggaggagccccagagcggcagcaccgccgacagcagacccggcgccgccgtgctgggcagcggcggcaagagcaacgacccctgctacctgcagagccccggcgacatccccagcgccgacgccgccgagatggaggagggcttcagcgagagccccgacaacctggaccacaccgagaacgccgccagcggcagcggccccagcgccagaggcagaagcgccgtgaccagaagacacaagttcgacctggccgccagaaccctgctggccagagccgccggcctgtacagaagcgtgcaggcccacagaaaccagagcagaagagagggcatcagcctgcagcaggaccccggcgccctgtacgacttcaacctggacgaggagctggagatcgacctggacgacgaggccatggaggccatgttcggccaggacctgaccagcgacaacgacatcctgggcatgtggatccccgaggtgctggactggcccacctggcacgtgtgcgagagcgaggacagagaggaggtggtggtgtgcgagctgtgcgagtgcagcgtggtgagcttcaaccagcacatgaagagaaaccaccccggctgcggcagaagcgccaacagacagggctacagaagcaacggcagctacgtggacggctggttcggcggcgagtgcggcagcggcaacccctactacctgctgtgcggcacctgcagagagaagtacctggccatgaagaccaagagcaagagcaccagcagcgagagatacaagggccaggcccccgacctgatcggcaagcaggacagcgtgtacgaggaggactgggacatgctggacgtggacgaggacgagaagctgaccggcgaggaggagttcgagctgctggccggccccctgggcctgaacgacagaagaatcgtgcccgagcccgtgcagttccccgacagcgaccccctgggcgccagcgtggccatggtgaccgccaccaacagcatggaggagaccctgatgcagatcggctgccacggcagcgtggagaagagcagcagcggcagaatcaccctgggcgagcaggccgccgccctggccaacccccacgacagagtggtggccctgagaagagtgaccgccgccgcccaggtgctgctggccagaaccatggtgatgagagccctgagcctgctgagcgtgagcggcagcagctgcagcctggccgccggcctggagagcctgggcctgaccgacatcagaaccctggtgagactgatgtgcctggccgccgccggcagagccggcctgagcaccagccccagcgccatggccagcaccagcgagagaagcagaggcggccacagcaaggccaacaagcccatcagctgcctggcctacctgagcaccgccgtgggctgcctggccagcaacgcccccagcgccgccaagctgctggtgcagctgtgcacccagaacctgatcagcgccgccaccggcgtgaacctgaccaccgtggacgacagcatccagagaaagttcctgcccagcttcctgagaggcatcgccgaggagaacaagctggtgaccagccccaacttcgtggtgacccaggccctggtggccctgctggccgacaagggcgccaagctgagacccaactacgacaagagcgaggtggagaagaagggccccctggagctggccaacgccctggccgcctgctgcctgagcagcagactgagcagccagcacagacagtgggccgcccagcagctggtgagaaccctggccgcccacgacagagacaaccagaccaccctgcagaccctggccgacatgggcggcgacctgagaaagtgcagcttcatcaagctggaggcccaccagaacagagtgatgacctgcgtgtggtgcaacaagaagggcctgctggccaccagcggcaacgacggcaccatcagagtgtggaacgtgaccaagaagcagtacagcctgcagcagacctgcgtgttcaacagactggagggcgacgccgaggagagcctgggcagccccagcgaccccagcttcagccccgtgagctggagcatcagcggcaagtacctggccggcgccctggagaagatggtgaacatctggcaggtgaacggcggcaagggcctggtggacatccagccccactgggtgagcgccctggcctggcccgaggagggccccgccaccgcctggagcggcgagagccccgagctgctgctggtgggcagaatggacggcagcctgggcctgatcgaggtggtggacgtgagcaccatgcacagaagagagctggagcactgctacagaaaggacgtgagcgtgacctgcatcgcctggttcagcgaggacagacccttcgccgtgggctacttcgacggcaagctgctgctgggcaccaaggagcccctggagaagggcggcatcgtgctgatcgacgcccacaaggacaccctgatcagcatgaagtgggaccccaccggccacatcctgatgacctgcgccaaggaggacagcgtgaagctgtggggcagcatcagcggctgctggtgctgcctgcacagcctgtgccaccccagcatcgtgaacggcatcgcctggtgcagactgcccggcaagggcagcaagctgcagctgctgatggccaccggctgccagagcggcctggtgtgcgtgtggagaatcccccaggacaccacccagaccaacgtgaccagcgccgagggctggtgggagcaggagagcaactgccaggacggctacagaaagagcagcggcgccaagtgcgtgtaccagctgagaggccacatcacccccgtgagaaccgtggccttcagcagcgacggcctggccctggtgagcggcggcctgggcggcctgatgaacatctggagcctgagagacggcagcgtgctgcagaccgtggtgatcggcagcggcgccatccagaccaccgtgtggatccccgaggtgggcgtggccgcctgcagcaacagaagcaaggacgtgctggtggtgaactgcaccgccgagtgggccgccgccaaccacgtgctggccacctgcagaaccgccctgaagcagcagggcgtgctgggcctgaacatggccccctgcatgagagccttcctggagagactgcccatgatgctgcaggagcagtacgcctacgagaagccccacgtggtgtgcggcgaccagctggtgcacagcccctacatgcagtgcctggccagcctggccgtgggcctgcacctggaccagctgctgtgcaacccccccgtgcccccccaccaccagaactgcctgcccgaccccgccagctggaaccccaacgagtgggcctggctggagtgcttcagcaccaccatcaaggccgccgaggccctgaccaacggcgcccagttccccgagagcttcaccgtgcccgacctggagcccgtgcccgaggacgagctggtgttcctgatggacaacagcaagtggatcaacggcatggacgagcagatcatgagctgggccaccagcagacccgaggactggcacctgggcggcaagtgcgacgtgtacctgtggggcgccggcagacacggccagctggccgaggccggcagaaacgtgatggtgcccgccgccgcccccagcttcagccaggcccagcaggtgatctgcggccagaactgcaccttcgtgatccaggccaacggcaccgtgctggcctgcggcgagggcagctacggcagactgggccagggcaacagcgacgacctgcacgtgctgaccgtgatcagcgccctgcagggcttcgtggtgacccagctggtgaccagctgcggcagcgacggccacagcatggccctgaccgagagcggcgaggtgttcagctggggcgacggcgactacggcaagctgggccacggcaacagcgacagacagagaagacccagacagatcgaggccctgcagggcgaggaggtggtgcagatgagctgcggcttcaagcacagcgccgtggtgaccagcgacggcaagctgttcaccttcggcaacggcgactacggcagactgggcctgggcaacaccagcaacaagaagctgcccgagagagtgaccgccctggagggctaccagatcggccaggtggcctgcggcctgaaccacaccctggccgtgagcgccgacggcagcatggtgtgggccttcggcgacggcgactacggcaagctgggcctgggcaacagcaccgccaagagcagcccccagaagatcgacgtgctgtgcggcatcggcatcaagaaggtggcctgcggcacccagttcagcgtggccctgaccaaggacggccacgtgtacaccttcggccaggacagactgatcggcctgcccgagggcagagccagaaaccacaacagaccccagcagatccccgtgctggccggcgtgatcatcgaggacgtggccgtgggcgccgagcacaccctggccctggccagcaacggcgacgtgtacgcctggggcagcaacagcgagggccagctgggcctgggccacaccaaccacgtgagagagcccaccctggtgaccggcctgcagggcaagaacgtgagacagatcagcgccggcagatgccacagcgccgcctggaccgccccccccgtgccccccagagcccccggcgtgagcgtgcccctgcagctgggcctgcccgacaccgtgcccccccagtacggcgccctgagagaggtgagcatccacaccgtgagagccagactgagactgctgtaccacttcagcgacctgatgtacagcagctggagactgctgaacctgagccccaacaaccagaacagcaccagccactacaacgccggcacctggggcatcgtgcagggccagctgagacccctgctggcccccagagtgtacaccctgcccatggtgagaagcatcggcaagaccatggtgcagggcaagaactacggcccccagatcaccgtgaagagaatcagcaccagaggcagaaagtgcaagcccatcttcgtgcagatcgccagacaggtggtgaagctgaacgccagcgacctgagactgcccagcagagcctggaaggtgaagctggtgggcgagggcgccgacgacgccggcggcgtgttcgacgacaccatcaccgagatgtgccaggagctggagaccggcatcgtggacctgctgatccccagccccaacgccaccgccgaggtgggctacaacagagacagattcctgttcaaccccagcgcctgcctggacgagcacctgatgcagttcaagttcctgggcatcctgatgggcgtggccatcagaaccaagaagcccctggacctgcacctggcccccctggtgtggaagcagctgtgctgcgtgcccctgaccctggaggacctggaggaggtggacctgctgtacgtgcagaccctgaacagcatcctgcacatcgaggacagcggcatcaccgaggagagcttccacgagatgatccccctggacagcttcgtgggccagagcgccgacggcaagatggtgcccatcatccccggcggcaacagcatccccctgaccttcagcaacagaaaggagtacgtggagagagccatcgagtacagactgcacgagatggacagacaggtggccgccgtgagagagggcatgagctggatcgtgcccgtgcccctgctgagcctgctgaccgccaagcagctggagcagatggtgtgcggcatgcccgagatcagcgtggaggtgctgaagaaggtggtgagatacagagaggtggacgagcagcaccagctggtgcagtggttctggcacaccctggaggagttcagcaacgaggagagagtgctgttcatgagattcgtgagcggcagaagcagactgcccgccaacaccgccgacatcagccagagattccagatcatgaaggtggacagaccctacgacagcctgcccaccagccagacctgcttcttccagctgagactgcccccctacagcagccagctggtgatggccgagagactgagatacgccatcaacaactgcagaagcatcgacatggacaactacatgctgagcagaaacgtggacaacgccgagggcagcgacaccgactactag

SEQ ID NO: 12398 - DNA, 3633 bp, Artificial Sequence; identical to SEQ ID NO: 10739
  Description of Artificial Sequence: Synthetic coding sequence

SEQ ID NO: 12399 - DNA, 579 bp, Artificial Sequence; identical to SEQ ID NO: 11225
  Description of Artificial Sequence: Synthetic coding sequence

SEQ ID NO: 12400 - DNA, 1803 bp, Artificial Sequence; identical to SEQ ID NO: 11130
  Description of Artificial Sequence: Synthetic coding sequence

SEQ ID NO: 12401 - DNA, 1197 bp, Artificial Sequence
  Description of Artificial Sequence: Synthetic coding sequence
atgctgagaagaaagcccagcaacgccagcgagaaggagttcaacctggacgacaacatccccgaggacgacagcggcgtgcccacccccgaggacgccggcaagagcggcaagaagctgggcaagaagtggagagccgtgatcagcagaaccatgaacagaaagatgggcaagatgatggtgaaggccctgagcgaggagatggccgacaccctggaggagggcagcgccagccccaccagccccgactacagcctggacagccccggccccgagaagatggccctggccttcagcgagcaggaggagcacgagctgcccgtgctgagcagacaggccagcaccggcagcgagctgtgcagccccagccccggcagcggcagcttcggcgaggagccccccgccccccagtacaccggccccttctgcggcagagccagagtgcacaccgacttcacccccagcccctacgaccacgacagcctgaagctgcaggtgagaagcgccagcggcctgctgtggagcctggccggctgcgcccagaagggcagctggaccgagcccggctacgacagcgtgagcggcggccagggccccccctaccccctgagcctggcccccttcagcagccccctgccccagcagaagggcgacgtgatccagatcatcgagaagccccccgtgggcacctggctgggcctgctgaacggcaaggtgggcagcttcaagttcatctacgtggacgtgctgcccgaggaggccgtgggccacgccagacccagcagaagacagagcaagggcaagagacccaagcccaagaccctgcacgagctgctggagagaatcggcctggaggagcacaccagcaccctgctgctgaacggctaccagaccctggaggacttcaaggagctgagagagacccacctgaacgagctgaacatcatggacccccagcacagagccaagctgctgaccgccgccgagctgctgctggactacgacaccggcagcgaggaggccgaggagggcgccgagagcagccaggagcccgtggcccacaccgtgagcgagcccaaggtggacatccccagagacagcggctgcttcgagggcagcgagagcggcagagacgacgccgagctggccggcaccgaggagcagctgcagggcctgagcctggccggcgccccctag

SEQ ID NO: 12402 - DNA, 1002 bp, Artificial Sequence
  Description of Artificial Sequence: Synthetic coding sequence
atgggcaccagaaagaaggtgcacgccttcgtgagagtgaagcccaccgacgacttcgcccacgagatgatcagatacggcgacgacaagagaagcatcgacatccacctgaagaaggacatcagaagaggcgtggtgaacaaccagcagaccgactggagcttcaagctggacggcgtgctgcacgacgccagccaggacctggtgtacgagaccgtggccaaggacgtggtgagccaggccctggacggctacaacggcaccatcatgtgctacggccagaccggcgccggcaagacctacaccatgatgggcgccaccgagaactacaagcacagaggcatcctgcccagagccctgcagcaggtgttcagaatgatcgaggagagacccacccacgccatcaccgtgagagtgagctacctggagatctacaacgagagcctgttcgacctgctgagcaccctgccctacgtgggccccagcgtgacccccatgaccatcgtggagaacccccagggcgtgttcatcaagggcctgagcgtgcacctgaccagccaggaggaggacgccttcagcctgctgttcgagggcgagaccaacagaatcatcgccagccacaccatgaacaagaacagcagcagaagccactgcatcttcaccatctacctggaggcccacagcagaaccctgagcgaggagaagtacatcaccagcaagatcaacctggtggacctggccggcagcgagagactgggcaagagcggcagcgagggccaggtgctgaaggaggccacctacatcaacaagagcctgagcttcctggagcaggccatcatcgccctgggcgaccagaagagagaccacatccccttcagacagtgcaagctgacccacgccctgaaggacagcctgggcggcaactgcaacatggtgctggtgaccaacatctacggcgaggccgcccagctggaggagaccggcagcagactgtggctgtag

SEQ ID NO: 12403 - DNA, 1248 bp, Artificial Sequence; identical to SEQ ID NO: 10184
  Description of Artificial Sequence: Synthetic coding sequence

SEQ ID NO: 12404 - DNA, 3108 bp, Artificial Sequence
  Description of Artificial Sequence: Synthetic coding sequence
atgagcgagcaggagagaatccaggagtgcctgagaaaggagatcagaagcctgctgatcagcaccaaggacggcctgagcccccaggagctggagaaggagtacctgctgatggtgggcaaccacctgcccctgagaatcctgggctacagaagcaccatggagctggtgctggacatgcccgacgtggtgagagtgtgccccggcgccggcggcaccgtgatcctgaaggccatccccgacgagagcaccaagggcatcgccagcctggtggccaagcagagaagcagccacaagctgagaaacagcatgcacaagggcagacccagcatctacagcggccccagaagccacagaagagtgccctacagaggcagagtggcccccatcctgcccgccgtggtgaagagcgagctgaaggacctgctggccctgagccccgtgctgctgagcgacttcgagaaggccttcgccaagagattcggcagaagcttccagtacatgcagtacggcttcctgagcatgttcgaggtgctgaacgccgccagcgacgtgatcagcgtggagcagaccagagccggcagcctgctgatgctgaagaagagcgtgaccgaggagaagcccagaggctgccccgccggcaagatcttcacccagcccttcagaatgaagcagggcagctacagcaccggcttccccgtggccaagccctgcttcagccagcccaccagcaacatggagccccccaagcagatcatgagcatggagaagaccagcaagctgaacgtggtggagaccagcagactgaaccacaccgagaagctgaaccagctggagaacaccttcaagagcgtgatcgcccagatcggccccggcggcaccatcagcagcgagctgaagcacaagatcaagttcgtggtgagcaagttccccgagggcctgttcatcagcaagctgctgggcgagtacgaggtgatcttcaaggagcagctgagccccaagaagctgggcttcctgaacgtgaccgagctggtgggcgccctgagcgacatcctgcacgtggagttcagaaagggccaccaggacctgctggtgttcgacgccgacaagaagcccctgccccccgtgcagagcgacaagaagatcgaggccaaggcctgcgtgagcagcccccccagaaacagcctgagcaccgccgccgtgaaggagaccgtgtggaactgccccagcaagaagcagaaggagccccagcagaagatctgcaagaagcccaacctggtggtgaagcccctgcagctgcaggtggagaccaacaagagcgagctgaacctggccatggccaaccacgacatcccccccgacgccgtgcccaacaagaagctgtgcagactgccccccctggacaccagcagcctgatcggcgtgttcgtggagtacatcatcagccccagccagttctacatcagaatctacagcagagacagcagcgagctgctggaggacatgatgatcgagatgagaagatgctacagcaaccagctggtgagcgacagatacgtgatgcccgagtgcttcatccagcccggccacctgtgctgcgtgagaatcagcgaggacaagtggtggtacagagtgatcatccacagagtgctggagaagcaggaggtggaggtgttctaccccgacttcggcaacatcggcatcgtgcagaagagcagcctgagattcctgaagtgctgctacaccaagctgcccgcccaggccatcccctgcagcctggcctgggtgagacccgtggaggagcactggaccagcaaggccatcctgcagttccagaagctgtgcggcctgaagcccctggtgggcgtggtggacgagtacgtggacggcatcctgaacatcttcctgtgcgacaccagcagcaacgaggacgtgtacttccaccacgtgctgagaaccgagggccacgccatcgtgtgcagagagaacatcagcagcaagggcttcagcgagctgaaccccctggccctgtacaccaccagcagcggcggccccgaggacatcgtgctgaccgagctgggctaccccagccagcagcactacttcaacgaggacagaaagatcagcccccagagcaaggagagcgagctgagaatcctgcaggacatcaacgacgagaagagcctgagccacctgaagagcgagagcaaggagcccctgaaggacagcgagttcgagagcctgaagacctgcaacaagagcttcgaggaggaccccaagtggagcaaccccgagcccaacgacctgaaggaggagaacgaggacgagatccccaccggcatgccctgcctggagagcgtgaccatcggcgacgacatctgggacgagaactggctgcccctgcaggccaagatgggcaagggcggcgacgccgccagccacctgttcaccgccagcctgggcggcaagaaccagtacagcagctgcaaggagatgccccagaaggactggtgcttcagcacccccaaggacacctgggacgacagctggcagcccagcggcctggtgaacggcaccaaggtggaggtgcacaagcccgaggtgctgggcgcccaggagaagaacaccggcaccaacagaacccagaagcagctggacatcaacggcagcagcgacagcagcaccctgcccaagctggaggagttctgcaccagcctgacccagagcgagcagagcgccgacggcagccagagcgagcccaacaacagccagacccagcccaagcagatccagctgagcaccgccgccccctgcagcaccaccgccgtggacgacagcgccgagaagcccagcggcagcgtggagagcagccccgagatcctgaagaacgaggacttcagcagcagcagagccatcaccctgtacaaggacaagagacaggagagcgtggaccagctgagcctgatcctgagctacgagtgccagatcagccagaagctgtacatccccagaagcaccgccaccgccgccctgggcgccgccgccagactggccaccagcagaagcctgctgcactggtaccccagcgtgaagagaatggaggcctag

SEQ ID NO: 12405 - DNA, 660 bp, Artificial Sequence
  Description of Artificial Sequence: Synthetic coding sequence
atgggcggcgcccagctggagctgcccagcggcgccagacccggcgtgtgcgtgagaagaagcttcagagcccacgccggcgaccagcccagaagaccccccggccccatccccgtgcccggcaccatgaagcaggagagcgccgcccccaacaccccccccaccagccagagccccacccccagcgcccagttccccagaaacgacggcgacccccaggccctgtggatcttcggctacggcagcctggtgtggagacccgacttcgcctacagcgacagcagagtgggcttcgtgagaggctacagcagaagattctggcagggcgacaccttccacagaggcagcgacaagatgcccggcagagtggtgaccctgctggaggaccacgagggctgcacctggggcgtggcctaccaggtgcagggcgagcagaaccccggctacctgggccccgcccccgaggaggccatcgccacccagatcctggcctgcagaggcttcagcggccacaacctggagtacctgctgagactggccgacttcatgcagctgtgcggcccccaggcccaggacgagcacctggccgccatcgtggacgccgtgggcaccatgctgccctgcttctgccccaccgagcaggccctggccctggtgtag

SEQ ID NO: 12406 - DNA, 2382 bp, Artificial Sequence; identical to SEQ ID NO: 10175
  Description of Artificial Sequence: Synthetic coding sequence

SEQ ID NO: 12407 - DNA, 1842 bp, Artificial Sequence; identical to SEQ ID NO: 9548
  Description of Artificial Sequence: Synthetic coding sequence

SEQ ID NO: 12408 - DNA, 582 bp, Artificial Sequence
  Description of Artificial Sequence: Synthetic coding sequence
atggccagagccggccccagactggtgctgagcgaggaggccgtgagagccaagagcggcctgggcccccacagagacctggccgagctgcagagcctgagcatccccggcacctaccaggagaagatcacccacctgggccacagcctgatgagcctgaccggcctgaagagcctggacctgagcagaaacagcctggtgagcctggagggcatccagtacctgaccgccctggagagcctgaacctgtactacaactgcatcagcagcctggccgaggtgttcagactgcacgccctgaccgagctggtggacgtggacttcagactgaaccccgtggtgaaggtggagcccgactacagactgttcgtggtgcacctgctgcccaagctgcagcagctggacgacagacccgtgagagccagcgagagaaaggccagcagactgcacttcgccagcgaggacagcctggacagcaaggagagcgtgcccgccagcctgaaggagggcagaatccagaccagcgtggagcccgccgtgggcaccgtgcccgtgtggggcctgtgggaggccggcccctag

SEQ ID NO: 12409 - DNA, 177 bp, Artificial Sequence
  Description of Artificial Sequence: Synthetic coding sequence
atgtacttcaactacaagagcgtgtgcggcagctgcggcttcggcagctgctacggctgcggctacggctgcatccacagcacccactgcggctgcaacggctactacggctgctacgagaacaagtacagcgtgatcgacgacctgatcttcttcgccagcaagaagtgccactag

SEQ ID NO: 12410 - DNA, 585 bp, Artificial Sequence
  Description of Artificial Sequence: Synthetic coding sequence
atgaacggcagagccgacttcagagagcccaacgccgaggtgcccagacccatcccccacatcggccccgactacatccccaccgaggaggagagaagagtgttcgccgagtgcaacgacgagagcttctggttcagaagcgtgcccctggccgccaccagcatgctgatcacccagggcctgatcagcaagggcatcctgagcagccaccccaagtacggcagcatccccaagctgatcctggcctgcatcatgggctacttcgccggcaagctgagctacgtgaagacctgccaggagaagttcaagaagctggagaacagccccctgggcgaggccctgagaagcggccaggccagaagaagcagcccccccggccactactaccagaagagcaagtacgacagcagcgtgagcggccagagcagcttcgtgaccagccccgccgccgacaacatcgagatgctgccccactacgagcccatccccttcagcagcagcatgaacgagagcgcccccaccggcatcaccgaccacatcgtgcaggtgaaggtgaacaagtacggcgacacctgggacgagtag

SEQ ID NO: 12411 - DNA, 2421 bp, Artificial Sequence
  Description of Artificial Sequence: Synthetic coding sequence
atgagcagcagccccgtgaacgtgaagaagctgaaggtgagcgagctgaaggaggagctgaagaagagaagactgagcgacaagggcctgaaggccgagctgatggagagactgcaggccgccctggacgacgaggaggccggcggcagacccgccatggagcccggcaacggcagcctggacctgggcggcgacagcgccggcagaagcggcgccggcctggagcaggaggccgccgccggcggcgacgaggaggaggaggaggaggaggaggaggaggagggcatcagcgccctggacggcgaccagatggagctgggcgaggagaacggcgccgccggcgccgccgacagcggccccatggaggaggaggaggccgccagcgaggacgagaacggcgacgaccagggcttccaggagggcgaggacgagctgggcgacgaggaggagggcgccggcgacgagaacggccacggcgagcagcagccccagccccccgccacccagcagcagcagccccagcagcagagaggcgccgccaaggaggccgccggcaagagcagcggccccaccagcctgttcgccgtgaccgtggccccccccggcgccagacagggccagcagcaggccggcggcgacggcaagaccgagcagaagggcggcgacaagaagagaggcgtgaagagacccagagaggaccacggcagaggctacttcgagtacatcgaggagaacaagtacagcagagccaagagcccccagccccccgtggaggaggaggacgagcacttcgacgacaccgtggtgtgcctggacacctacaactgcgacctgcacttcaagatcagcagagacagactgagcgccagcagcctgaccatggagagcttcgccttcctgtgggccggcggcagagccagctacggcgtgagcaagggcaaggtgtgcttcgagatgaaggtgaccgagaagatccccgtgagacacctgtacaccaaggacatcgacatccacgaggtgagaatcggctggagcctgaccaccagcggcatgctgctgggcgaggaggagttcagctacggctacagcctgaagggcatcaagacctgcaactgcgagaccgaggactacggcgagaagttcgacgagaacgacgtgatcacctgcttcgccaacttcgagagcgacgaggtggagctgagctacgccaagaacggccaggacctgggcgtggccttcaagatcagcaaggaggtgctggccggcagacccctgttcccccacgtgctgtgccacaactgcgccgtggagttcaacttcggccagaaggagaagccctacttccccatccccgaggagtacaccttcatccagaacgtgcccctggaggacagagtgagaggccccaagggccccgaggagaagaaggactgcgaggtggtgatgatgatcggcctgcccggcgccggcaagaccacctgggtgaccaagcacgccgccgagaaccccggcaagtacaacatcctgggcaccaacaccatcatggacaagatgatggtggccggcttcaagaagcagatggccgacaccggcaagctgaacaccctgctgcagagagccccccagtgcctgggcaagttcatcgagatcgccgccagaaagaagagaaacttcatcctggaccagaccaacgtgagcgccgccgcccagagaagaaagatgtgcctgttcgccggcttccagagaaaggccgtggtggtgtgccccaaggacgaggactacaagcagagaacccagaagaaggccgaggtggagggcaaggacctgcccgagcacgccgtgctgaagatgaagggcaacttcaccctgcccgaggtggccgagtgcttcgacgagatcacctacgtggagctgcagaaggaggaggcccagaagctgctggagcagtacaaggaggagagcaagaaggccctgccccccgagaagaagcagaacaccggcagcaagaagagcaacaagaacaagagcggcaagaaccagttcaacagaggcggcggccacagaggcagaggcggcttcaacatgagaggcggcaacttcagaggcggcgcccccggcaacagaggcggctacaacagaagaggcaacatgccccagagaggcggcggcggcggcggcagcggcggcatcggctacccctaccccagagcccccgtgttccccggcagaggcagctacagcaacagaggcaactacaacagaggcggcatgcccaacagaggcaactacaaccagaacttcagaggcagaggcaacaacagaggctacaagaaccagagccagggctacaaccagtggcagcagggccagttctggggccagaagccctggagccagcactaccaccagggctactactag

SEQ ID NO: 12412 - DNA, 651 bp, Artificial Sequence
  Description of Artificial Sequence: Synthetic coding sequence
atgagcaccgtggacctggccagagtgggcgcctgcatcctgaagcacgccgtgaccggcgaggccgtggagctgagaagcctgtggagagagcacgcctgcgtggtggccggcctgagaagattcggctgcgtggtgtgcagatggatcgcccaggacctgagcagcctggccggcctgctggaccagcacggcgtgagactggtgggcgtgggccccgaggccctgggcctgcaggagttcctggacggcgactacttcgccggcgagctgtacctggacgagagcaagcagctgtacaaggagctgggcttcaagagactgtggacccaggccagccccgagttcggccaggccacctggtgcctgagaagatacaacagcctgagcatcctgcccgccgccctgggcaagcccgtgagagacgtggccgccaaggccaaggccgtgggcatccagggcaacctgagcggcgacctgctgcagagcggcggcctgctggtggtgagcaagggcggcgacaaggtgctgctgcacttcgtgcagaagagccccggcgactacgtgcccaaggagcacatcctgcaggtgctgggcatcagcgccgaggtgtgcgccagcgaccccccccagtgcgacagagaggtgtag

SEQ ID NO: 12413 - DNA, 1191 bp, Artificial Sequence
  Description of Artificial Sequence: Synthetic coding sequence
atgttctggaagttcgacctgcacaccagcagccacctggacaccctgctggagagagaggacctgagcctgcccgagctgctggacgaggaggacgtgctgcaggagtgcaaggtggtgaacagaaagctgctggacttcctgctgcagcccccccacctgcaggccatggtggcctgggtgacccaggagccccccgacagcggcgaggagagactgagatacaagtaccccagcgtggcctgcgagatcctgaccagcgacgtgccccagatcaacgacgccctgggcgccgacgagagcctgctgaacagactgtacggcttcctgcagagcaccggcagcctgaaccccctgctggccagcttcttcagcaaggtgatgggcatcctgatcaacagaaagaccgaccagctggtgagcttcctgagaaagaaggacgacttcgtggacctgctgctgcagcacatcggcaccagcgccatcatggacctgctgctgagactgctgacctgcgtggagagaccccagctgagacaggacgtggtgaactggctgaacgaggagaagatcgtgcagagactgatcgagcagatccaccccagcaaggacgagaaccagcacagcaacgccagccagagcctgtgcgacatcatcagactgagcagagagcagatgatccaggtgcaggacagccccgtgcccaccgacgcccccaccagccccagagtgagcggcgaggaggagctgcacaccggcccccccgccccccagggccccctgagcgtgccccagggcctgcccacccagagcctggccagcccccccgccagagacgccctgcagctgagaagccaggaccccaccccccccagcgccccccaggaggccaccgagggcagcaaggtgaccgagcccagcgccccctgccaggccctggtgagcatcggcgacctgcaggccaccttccacggcatcagaagcgcccccagcagcagcgacagcgccaccagagaccccagcaccagcgtgcccgccagcggcgcccaccagcccccccagaccaccgagggcgagaagagccccgagcccctgggcctgccccagagccagagcgcccaggccctgacccccccccccatccccaacggcagcgcccccgagggccccgccagccccggcagccagtag

SEQ ID NO: 12414 - DNA, 2178 bp, Artificial Sequence
  Description of Artificial Sequence: Synthetic coding sequence
atgggcaccagaaagaaggtgcacgccttcgtgagagtgaagcccaccgacgacttcgcccacgagatgatcagatacggcgacgacaagagaagcatcgacatccacctgaagaaggacatcagaagaggcgtggtgaacaaccagcagaccgactggagcttcaagctggacggcgtgctgcacgacgccagccaggacctggtgtacgagaccgtggccaaggacgtggtgagccaggccctggacggctacaacggcaccatcatgtgctacggccagaccggcgccggcaagacctacaccatgatgggcgccaccgagaactacaagcacagaggcatcctgcccagagccctgcagcaggtgttcagaatgatcgaggagagacccacccacgccatcaccgtgagagtgagctacctggagatctacaacgagagcctgttcgacctgctgagcaccctgccctacgtgggccccagcgtgacccccatgaccatcgtggagaacccccagggcgtgttcatcaagggcctgagcgtgcacctgaccagccaggaggaggacgccttcagcctgctgttcgagggcgagaccaacagaatcatcgccagccacaccatgaacaagaacagcagcagaagccactgcatcttcaccatctacctggaggcccacagcagaaccctgagcgaggagaagtacatcaccagcaagatcaacctggtggacctggccggcagcgagagactgggcaagagcggcagcgagggccaggtgctgaaggaggccacctacatcaacaagagcctgagcttcctggagcaggccatcatcgccctgggcgaccagaagagagaccacatccccttcagacagtgcaagctgacccacgccctgaaggacagcctgggcggcaactgcaacatggtgctggtgaccaacatctacggcgaggccgcccagctggaggagaccctgagcagcctgagattcgccagcagaatgaagctggtgaccaccgagcccgccatcaacgagaagtacgacgccgagagaatggtgaagaacctggagaaggagctggccctgctgaagcaggagctggccatccacgacagcctgaccaacagaaccttcgtgacctacgaccccatggacgagatccagatcgccgagatcaacagccaggtgagaagatacctggagggcaccctggacgagatcgacatcatcagcctgagacagatcaaggaggtgttcaaccagttcagagtggtgctgagccagcaggagcaggaggtggagagcaccctgagaagaaagtacaccctgatcgacagaaacgacttcgccgccatcagcgccatccagaaggccggcctggtggacgtggacggccacctggtgggcgagcccgagggccagaacttcggcctgggcgtggcccccttcagcaccaagcccggcaagaaggccaagagcaagaagaccttcaaggagcccctgagacccgacaccccccccagcaagcccgtggccttcgaggagttcaagaacgagcagggcagcgagatcaacagaatcttcaaggagaacaagagcatcctgaacgagagaagaaagagagccagcgagaccacccagcacatcaacgccatcaagagagagatcgacgtgaccaaggaggccctgaacttccagaagagcctgagagagaagcagggcaagtacgagaacaagggcctgatgatcatcgacgaggaggagttcctgctgatcctgaagctgaaggacctgaagaagcagtacagaagcgagtaccaggacctgagagacctgagagccgagatccagtactgccagcacctggtggaccagtgcagacacagactgctgatggagttcgacatctggtacaacgagagcttcgtgatccccgaggacatgcagatggccctgaagcccggcggcagcatcagacccggcatggtgcccgtgaacagaatcgtgagcctgggcgaggacgaccaggacaagttcagccagctgcagcagagagtgctgcccgagggccccgacagcatcagcttctacaacgccaaggtgaagatcgagcagaagcacaactacctgaagaccatgatgggcctgcagcaggcccacagaaagtag

SEQ ID NO: 12415 - DNA, 282 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagttcagcgccttcgacatgagcgcccccacccccgccagatgctgccccgccatcggcaccctgtacaacaccaacaccctgtag

SEQ ID NO: 12416 - DNA, 333 bp, Artificial Sequence
  Description of Artificial Sequence: Synthetic coding sequence
atgggcaagaagcagaacaagaagaaggtggaggaggtgctggaggaggaggaggaggagtacgtggtggagaaggtgctggacagaagagtggtgaagggcaaggtggagtacctgctgaagtggaagggcttcagcgacgaggacaacacctgggagcccgaggagaacctggactgccccgacctgatcgccgagttcctgcagagccagaagaccgcccacgagaccgacaagagcgagggcggcaagagaaaggccgacagcgacagcgaggacaagggcgaggagagcaagcccaagaagaagaaggaggagagcgagaagccctag

SEQ ID NO: 12417 - DNA, 270 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaacctag

SEQ ID NO: 12418 - DNA, 1269 bp, Artificial Sequence
  Description of Artificial Sequence: Synthetic coding sequence
atggagagaaaggacttcgagacctggctggacaacatcagcgtgaccttcctgagcctgaccgacctgcagaagaacgagaccctggaccacctgatcagcctgagcggcgccgtgcagctgagacacctgagcaacaacctggagaccctgctgaagagagacttcctgaagctgctgcccctggagctgagcttctacctgctgaagtggctggacccccagaccctgctgacctgctgcctggtgagcaagcagtggaacaaggtgatcagcgcctgcaccgaggtgtggcagaccgcctgcaagaacctgggctggcagatcgacgacagcgtgcaggacgccctgcactggaagaaggtgtacctgaaggccatcctgagaatgaagcagctggaggaccacgaggccttcgagaccagcagcctgatcggccacagcgccagagtgtacgccctgtactacaaggacggcctgctgtgcaccggcagcgacgacctgagcgccaagctgtgggacgtgagcaccggccagtgcgtgtacggcatccagacccacacctgcgccgccgtgaagttcgacgagcagaagctggtgaccggcagcttcgacaacaccgtggcctgctgggagtggagcagcggcgccagaacccagcacttcagaggccacaccggcgccgtgttcagcgtggactacaacgacgagctggacatcctggtgagcggcagcgccgacttcaccgtgaaggtgtgggccctgagcgccggcacctgcctgaacaccctgaccggccacaccgagtgggtgaccaaggtggtgctgcagaagtgcaaggtgaagagcctgctgcacagccccggcgactacatcctgctgagcgccgacaagtacgagatcaagatctggcccatcggcagagagatcaactgcaagtgcctgaagaccctgagcgtgagcgaggacagaagcatctgcctgcagcccagactgcacttcgacggcaagtacatcgtgtgcagcagcgccctgggcctgtaccagtgggacttcgccagctacgacatcctgagagtgatcaagacccccgagatcgccaacctggccctgctgggcttcggcgacatcttcgccctgctgttcgacaacagatacctgtacatcatggacctgagaaccgagagcctgatcagcagatggcccctgcccgagtacagaaagagcaagagaggcagcagcttcctggccggcgagcaccccggctag

SEQ ID NO: 12419 - DNA, 1179 bp, Artificial Sequence
  Description of Artificial Sequence: Synthetic coding sequence
atgagcgccctggccggcgaggacgtgtggagatgccccggctgcggcgaccacatcgcccccagccagatctggtacagaaccgtgaacgagacctggcacggcagctgcttcagaagaagcaacagcatcagcaagagccccggccccagcagccccaaggagcccctgctgttcagcagagacatcagcagaagcgagagcctgagatgcagcagcagctacagccagcagatcttcagaccctgcgacctgatccacggcgaggtgctgggcaagggcttcttcggccaggccatcaaggtgacccacaaggccaccggcaaggtgatggtgatgaaggagctgatcagatgcgacgaggagacccagaagaccttcctgaccgaggtgaaggtgatgagaagcctggaccaccccaacgtgctgaagttcatcggcgtgctgtacaaggacaagaagctgaacctgctgaccgagtacatcgagggcggcaccctgaaggacttcctgagaagcatggaccccttcccctggcagcagaaggtgagattcgccaagggcatcgccagcggcatggcctacctgcacagcatgtgcatcatccacagagacctgaacagccacaactgcctgatcaagctggacaagaccgtggtggtggccgacttcggcctgagcagactgatcgtggaggagagaaagagagcccccatggagaaggccaccaccaagaagagaaccctgagaaagaacgacagaaagaagagatacaccgtggtgggcaacccctactggatggcccccgagatgctgaacggcaagagctacgacgagaccgtggacatcttcagcttcggcatcgtgctgtgcgagatcatcggccaggtgtacgccgaccccgactgcctgcccagaaccctggacttcggcctgaacgtgaagctgttctgggagaagttcgtgcccaccgactgcccccccgccttcttccccctggccgccatctgctgcagactggagcccgagagcagacccgccttcagcaagctggaggacagcttcgaggccctgagcctgtacctgggcgagctgggcatccccctgcccgccgagctggaggagctggaccacaccgtgagcatgcagtacggcctgaccagagacagccccccctag

SEQ ID NO: 12420 - DNA, 480 bp, Artificial Sequence; identical to SEQ ID NO: 11816
  Description of Artificial Sequence: Synthetic coding sequence

SEQ ID NO: 12421 - DNA, 3585 bp, Artificial Sequence
  Description of Artificial Sequence: Synthetic coding sequence
atgttcagcctggacagcttcagaaaggacagagcccagcacagacagagacagtgcaagctgcccccccccagactgccccccatgtgcgtgaaccccacccccggcggcaccatcagcagagccagcagagacctgctgaaggagttcccccagcccaagaacctgctgaacagcgtgatcggcagagccctgggcatcagccacgccaaggacaagctggtgtacgtgcacaccaacggccccaagaagaagaaggtgaccctgcacatcaagtggcccaagagcgtggaggtggagggctacggcagcaagaagatcgacgccgagagacaggccgccgccgccgcctgccagctgttcaagggctggggcctgctgggccccagaaacgagctgttcgacgccgccaagtacagagtgctggccgacagattcggcagccccgccgacagctggtggagacccgagcccaccatgccccccaccagctggagacagctgaaccccgagagcatcagacccggcggccccggcggcctgagcagaagcctgggcagagaggaggaggaggacgaggaggaggagctggaggagggcaccatcgacgtgaccgacttcctgagcatgacccagcaggacagccacgcccccctgagagacagcagaggcagcagcttcgagatgaccgacgacgacagcgccatcagagccctgacccagttccccctgcccaagaacctgctggccaaggtgatccagatcgccaccagcagcagcaccgccaagaacctgatgcagttccacaccgtgggcaccaagaccaagctgagcaccctgaccctgctgtggccctgccccatgaccttcgtggccaagggcagaagaaaggccgaggccgagaacaaggccgccgccctggcctgcaagaagctgaagagcctgggcctggtggacagaaacaacgagcccctgacccacgccatgtacaacctggccagcctgagagagctgggcgagacccagagaagaccctgcaccatccaggtgcccgagcccatcctgagaaagatcgagaccttcctgaaccactaccccgtggagagcagctggatcgcccccgagctgagactgcagagcgacgacatcctgcccctgggcaaggacagcggccccctgagcgaccccatcaccggcaagccctacgtgcccctgctggaggccgaggaggtgagactgagccagagcctgctggagctgtggagaagaagaggccccgtgtggcaggaggccccccagctgcccgtggacccccacagagacaccatcctgaacgccatcgagcagcaccccgtggtggtgatcagcggcgacaccggctgcggcaagaccaccagaatcccccagctgctgctggagagatacgtgaccgagggcagaggcgccagatgcaacgtgatcatcacccagcccagaagaatcagcgccgtgagcgtggcccagagagtgagccacgagctgggccccagcctgagaagaaacgtgggcttccaggtgagactggagagcaagccccccagcagaggcggcgccctgctgttctgcaccgtgggcatcctgctgagaaagctgcagagcaaccccagcctggagggcgtgagccacgtgatcgtggacgaggtgcacgagagagacgtgaacaccgacttcctgctgatcctgctgaagggcctgcagagactgaaccccgccctgagactggtgctgatgagcgccaccggcgacaacgagagattcagcagatacttcggcggctgccccgtgatcaaggtgcccggcttcatgtaccccgtgaaggagcactacctggaggacatcctggccaagctgggcaagcaccagtacctgcacagacacagacaccacgagagcgaggacgagtgcgccctggacctggacctggtgaccgacctggtgctgcacatcgacgccagaggcgagcccggcggcatcctgtgcttcctgcccggctggcaggagatcaagggcgtgcagcagagactgcaggaggccctgggcatgcacgagagcaagtacctgatcctgcccgtgcacagcaacatccccatgatggaccagaaggccatcttccagcagccccccgtgggcgtgagaaagatcgtgctggccaccaacatcgccgagaccagcatcaccatcaacgacatcgtgcacgtggtggacagcggcctgcacaaggaggagagatacgacctgaagaccaaggtgagctgcctggagaccgtgtgggtgagcagagccaacgtgatccagagaagaggcagagccggcagatgccagagcggcttcgcctaccacctgttccccagaagcagactggagaagatggtgcccttccaggtgcccgagatcctgagaacccccctggagaacctggtgctgcaggccaagatccacatgcccgagaagaccgccgtggagttcctgagcaaggccgtggacagccccaacatcaaggccgtggacgaggccgtgatcctgctgcaggagatcggcgtgctggaccagagagagtacctgaccaccctgggccagagactggcccacatcagcaccgaccccagactggccaaggccatcgtgctggccgccatcttcagatgcctgcaccccctgctggtggtggtgagctgcctgaccagagaccccttcagcagcagcctgcagaacagagccgaggtggacaaggtgaaggccctgctgagccacgacagcggcagcgaccacctggccttcgtgagagccgtggccggctgggaggaggtgctgagatggcaggacagaagcagcagagagaactacctggaggagaacctgctgtacgcccccagcctgagattcatccacggcctgatcaagcagttcagcgagaacatctacgaggccttcctggtgggcaagcccagcgactgcaccctggccagcgcccagtgcaacgagtacagcgaggaggaggagctggtgaagggcgtgctgatggccggcctgtaccccaacctgatccaggtgagacagggcaaggtgaccagacagggcaagttcaagcccaacagcgtgacctacagaaccaagagcggcaacatcctgctgcacaagagcaccatcaacagagaggccaccagactgagaagcagatggctgacctacttcatggccgtgaagagcaacggcagcgtgttcgtgagagacagcagccaggtgcaccccctggccgtgctgctgctgaccgacggcgacgtgcacatcagagacgacggcagaagagccaccatcagcctgagcgacagcgacctgctgagactggagggcgacagcagaaccgtgagactgctgaaggagctgagaagagccctgggcagaatggtggagagaagcctgagaagcgagctggccgccctgccccccagcgtgcaggaggagcacggccagctgctggccctgctggccgagctgctgagaggcccctgcggcagcttcgacgtgagaaagaccgccgacgactag

SEQ ID NO: 12422 - DNA, 207 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaagtag

SEQ ID NO: 12423 - DNA, 1419 bp, Artificial Sequence
  Description of Artificial Sequence: Synthetic coding sequence
atgagcagaagagtggtgagacagagcaagttcagacacgtgttcggccaggccgccaaggccgaccaggcctacgaggacatcagagtgagcaaggtgacctgggacagcagcttctgcgccgtgaaccccaagttcctggccatcatcgtggaggccggcggcggcggcgccttcatcgtgctgcccctggccaagaccggcagagtggacaagaactaccccctggtgaccggccacaccgcccccgtgctggacatcgactggtgcccccacaacgacaacgtgatcgccagcgccagcgacgacaccaccatcatggtgtggcagatccccgactacacccccatgagaaacatcaccgagcccatcatcaccctggagggccacagcaagagagtgggcatcctgagctggcaccccaccgccagaaacgtgctgctgagcgccggcggcgacaacgtgatcatcatctggaacgtgggcaccggcgaggtgctgctgagcctggacgacatgcaccccgacgtgatccacagcgtgtgctggaacagcaacggcagcctgctggccaccacctgcaaggacaagaccctgagaatcatcgaccccagaaagggccaggtggtggccgagcaggccagaccccacgagggcgccagacccctgagagccgtgttcaccgccgacggcaagctgctgagcaccggcttcagcagaatgagcgagagacagctggccctgtgggaccccaacaacttcgaggagcccgtggccctgcaggagatggacaccagcaacggcgtgctgctgcccttctacgaccccgacagcagcatcgtgtacctgtgcggcaagggcgacagcagcatcagatacttcgagatcaccgacgagccccccttcgtgcactacctgaacaccttcagcagcaaggagccccagagaggcatgggcttcatgcccaagagaggcctggacgtgagcaagtgcgagatcgccagattctacaagctgcacgagagaaagtgcgagcccatcatcatgaccgtgcccagaaagagcgacctgttccaggacgacctgtaccccgacacccccggccccgagcccgccctggaggccgacgagtggctgagcggccaggacgccgagcccgtgctgatcagcctgagagacggctacgtgccccccaagcacagagagctgagagtgaccaagagaaacatcctggacgtgagaccccccagcggccccagaagaagccagagcgccagcgacgcccccctgagccagcagcacaccctggagaccctgctggaggagatcaaggccctgagagagagagtgcaggcccaggagcagagaatcaccgccctggagaacatgctgtgcgagctggtggacggcaccgactag

SEQ ID NO: 12424 - DNA, 390 bp, Artificial Sequence
  Description of Artificial Sequence: Synthetic coding sequence
atcctgcacagcctggtgcagaccggcatctgcgtgatcaccctggccgagagccaccccgtgctgcagagcggcaagaccatcaagagcatcagctaccagatcagcaccaactgcagcagactgcagaacaaggtgagcggcaagttcaagagaggcgcccagttcctgaccgagctggcccccctgtgcaagatctactgcagcgacggcgaggagtacaccgtgagcagctgcgtgagaggcagactgatggaggtgaacgagaacatcctgcacaagcccagcatcctgcaggagaagcccagcaccgagggctacatcgccgtggtgctgcccaagttcgaggagagcaagagcatcaccgagggcctgctgacccagaagtag

SEQ ID NO: 12425 - DNA, 735 bp, Artificial Sequence
  Description of Artificial Sequence: Synthetic coding sequence
atggtgcaccaggacaactgcagctaccaggcccagaagaacgagagagagagcatcagacagaagctggccctgggcagcttcttcgacgacggccccggcatctacaccagctgcagcaagagcggcaagcccagcctgagcagcagactgcagagcggcatgaacctgcagatctgcttcgtgaacgacagcggcagcgacaaggacagcgacgccgacgacagcaagaccgagaccagcctggacacccccctgagccccatgagcaagcagagcagcagctacagcgacagagacaccaccgaggaggagagcgagagcctggacgacatggacttcctgaccagacagaagaagctgcaggccgaggccaagatggccctggccatggccaagcccatggccaagatgcaggtggaggtggagaagcagaacagaaagaagagccccgtggccgacctgctgccccacatgccccacatcagcgagtgcctgatgaagagaagcctgaagcccaccgacctgagagacatgaccatcggccagctgcaggtgatcgtgaacgacctgcacagccagatcgagagcctgaacgaggagctggtgcagctgctgctgatcagagacgagctgcacaccgagcaggacgccatgctggtggacatcgaggacctgaccagacacgccgagagccagcagaagcacatggccgagaagatgcccgccaagtag

SEQ ID NO: 12426 - DNA, 1620 bp, Artificial Sequence; identical to SEQ ID NO: 10018
  Description of Artificial Sequence: Synthetic coding sequence

SEQ ID NO: 12427 - DNA, 441 bp, Artificial Sequence
  Description of Artificial Sequence: Synthetic coding sequence
atgttcgagatcctgaccagcgagttcagctaccagcacagcctgagcatcctggtggaggagttcctgcagagcaaggagctgagagccaccgtgacccagatggagcaccaccacctgttcagcaacatcctggacgtgctgggcgccagccagagattcttcgaggacctggagcagagacacaaggcccaggtgctggtggaggacatcagcgacatcctggaggagcacgccgagaagcacttccacccctacatcgcctactgcagcaacgaggtgtaccagcagagaaccctgcagaagctgatcagcagcaacgccgccttcagagaggccctgagagagatcgagagaagacccgcctgcggcggcctgcccatgctgagcttcctgatcctgcccatgcagagagtgaccagactgcccctgctgatgtag

SEQ ID NO: 12428 - DNA, 483 bp, Artificial Sequence; identical to SEQ ID NO: 10977
  Description of Artificial Sequence: Synthetic coding sequence

SEQ ID NO: 12429 - DNA, 303 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagacctag

SEQ ID NO: 12430 - DNA, 369 bp, Artificial Sequence; identical to SEQ ID NO: 12080
  Description of Artificial Sequence: Synthetic coding sequence

SEQ ID NO: 12431 - DNA, 633 bp, Artificial Sequence
  Description of Artificial Sequence: Synthetic coding sequence
atggtgagcatgagcgtgcccgactgcctgagcatcatgacctacgtgagccagtactacaaccacttctgcagccccggccaggccggcgtgagcccccccagaaagggcctggccccctgcagcccccccagcgtggcccccacccccgtggagcccgaggacgtggcccagggcgaggagctgagcagcggcagcctgagcgagcagggcaccggccagacccccagcagcacctgcgccgcctgccagcagcacgtgcacctggtgcagagatacctggccgacggcagactgtaccacagacactgcttcagatgcagaagatgcagcagcaccctgctgcccggcgcctacgagaacggccccgaggagggcaccttcgtgtgcgccgagcactgcgccagactgggccccggcaccagaagcggcaccagacccggccccttcagccagcccaagcagcagcaccagcagcagctggccgaggacgccaaggacgtgcccggcggcggccccagcagcagcgcccccgccggcgccgaggccgacggccccaaggccagccccgaggccagaccccagatccccaccaagcccagagtgcccggcaagctgcaggagctggcctag

SEQ ID NO: 12432 - DNA, 390 bp, Artificial Sequence; identical to SEQ ID NO: 10956
  Description of Artificial Sequence: Synthetic coding sequence

SEQ ID NO: 12433 - DNA, 621 bp, Artificial Sequence
  Description of Artificial Sequence: Synthetic coding sequence
atggccctgaacgtggcccccgtgagagacaccaagtggctgaccctggaggtgtgcagacagttccagagaggcacctgcagcagaagcgacgaggagtgcaagttcgcccacccccccaagagctgccaggtggagaacggcagagtgatcgcctgcttcgacagcctgaagggcagatgcagcagagagaactgcaagtacctgcacccccccacccacctgaagacccagctggagatcaacggcagaaacaacctgatccagcagaagaccgccgccgccatgctggcccagcagatgcagttcatgttccccggcacccccctgcaccccgtggccttcccccccggcgccctgcaccccctgcccaagagacaggccctggagaagagcaacggcaccagcgccgtgttcaaccccagcgtgctgcactaccagcaggccctgaccagcgcccagctgcagcagcacgccgccttcatccccaccgacaacagcgagatcatcagcagaaacggcatggagtgccaggagagcgccctgagaatcaccaagcactgctactgcacctactaccccgtgagcagcagcatcgagctgccccagaccgcctgctag

SEQ ID NO: 12434 - DNA, 978 bp, Artificial Sequence
  Description of Artificial Sequence: Synthetic coding sequence
atgcagcagcccgtgagagccggcgacatcggcgtgagcagagtgcagacccaccacaacgccagccccttcagcgtgcccaagaagcaggacgagagccccatgatcggcgacggcgaggactacttcctgagcctgttcggcgacagcaagaagctgaccgcccacagcaactacacccagaagaccctgaagtacttcagcatgatcctggaggaggtgggccagttcaccagcagcagcctgggcgacgtggagatcgccgaggtgaacgtgaagggcctgttcgtgaagctgatcaacagcagcctggacaaggagatggccatcggcgaccacatcctgcagcagaacgtgaacggccagaccatcagcctgtacagattcctgcccaacatcgtgatgcaggccaacagcaccgtgaccgtgtgggccgccgccagcgaggccaagcaccagccccccagcgacttcctgtggaaggagcaggacaagttcagagccagccccgactgcatcaccatcctgtgcaagcccaacggccaggccatcgcctggtacacccccatccactggaagcaggcctgggagaagctggacgccgacgtggagttcaacagatgcagcgtggtgagccccaccttcagaaagagagtgttccagtggaccgccagcaccgccaccatcaccaaggagaagcaggaccagcccaagaaggacatcagcaactaccaggtggagcaggcccaggtgctgctgaagagagagaaggagatcccccccaccgtgttccccaacagaagcccctggtgccagaacccctacgtgagcgcccacccctactgccccctgatcgagccccacaacaccagcaccgccggcggcagactggacagacagcccagaaccagaagcaccagacccaacagagccagcggcagcaagaagaagaagaccagcgagagccagaagcagtag

SEQ ID NO: 12435 - DNA, 1257 bp, Artificial Sequence
  Description of Artificial Sequence: Synthetic coding sequence
atgagagagatcgtgcacatccaggccggccagtgcggcaaccagatcggcaccaagttctgggaggtgatcagcgacgagcacggcatcgaccccgccggcggctacgtgggcgacagcgccctgcagctggagagaatcaacgtgtactacaacgagagcagcagccagaagtacgtgcccagagccgccctggtggacctggagcccggcaccatggacagcgtgagaagcggccccttcggccagctgttcagacccgacaacttcatcttcggccagaccggcgccggcaacaactgcctgcagggcttccagctgacccacagcctgggcggcggcaccggcagcggcatgggcaccctgctgatcagcaagatcagagaggagttccccgacagaatcatgaacaccttcagcgtgatgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacgccagaaacatgatggccgcctgcgaccccagacacggcagatacctgaccgtggccaccgtgttcagaggccccatgagcatgaaggaggtggacgagcagatgctggccatccagagcaagaacagcagctacttcgtggagtggatccccaacaacgtgaaggtggccgtgtgcgacatcccccccagaggcctgaagatggccagcaccttcatcggcaacagcaccgccatccaggagctgttcaagagaatcagcgagcagttcagcgccatgttcagaagaaaggccttcctgcactggttcaccggcgagggcatggacgagatggagttcaccgaggccgagagcaacatgaacgacctggtgagcgagtaccagcagtaccaggacgccaccgccaacgacggcgaggaggccttcgaggacgaggaggaggagatcgacggctag

SEQ ID NO: 12436 - DNA, 270 bp, Artificial Sequence
  Description of Artificial Sequence: Synthetic coding sequence
atggacgtgctgagccccctgagcttcatcaaggtgagccacgtgagaatgcagggcatcctgctgctggtgttcgccaagtaccagcacctgccctacatccagatcctgagcaccaagagcacccccaccggcctgttcggctactggggcaacaagggcggcgtgaacatctgcctgaagctgtacggctactacgtgagcatcatcaactgccacctgcccccccacatcagcaacaactaccagagactggagcacttcgactag

SEQ ID NO: 12437 - DNA, 180 bp, Artificial Sequence; identical to SEQ ID NO: 9329
  Description of Artificial Sequence: Synthetic coding sequence

SEQ ID NO: 12438 - DNA, 864 bp, Artificial Sequence
  Description of Artificial Sequence: Synthetic coding sequence
atggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccagaagttcccctag

SEQ ID NO: 12439 - DNA, 1344 bp, Artificial Sequence; identical to SEQ ID NO: 9705
  Description of Artificial Sequence: Synthetic coding sequence

SEQ ID NO: 12440 - DNA, 474 bp, Artificial Sequence
  Description of Artificial Sequence: Synthetic coding sequence
atggccaacatcgccgtgcagagaatcaagagagagttcaaggaggtgctgaagagcgaggagaccagcaagaaccagatcaaggtggacctggtggacgagaacttcaccgagctgagaggcgagatcgccggcccccccgacaccccctacgagggcggcagataccagctggagatcaagatccccgagacctaccccttcaacccccccaaggtgagattcatcaccaagatctggcaccccaacatcagcagcgtgaccggcgccatctgcctggacatcctgaaggaccagtgggccgccgccatgaccctgagaaccgtgctgctgagcctgcaggccctgctggccgccgccgagcccgacgacccccaggacgccgtggtggccaaccagaacgccgtgatcgtggccctgagcagcaagagctgggacgtggagaccgccaccgagctgctgctgagcaactag

SEQ ID NO: 12441 - DNA, 582 bp, Artificial Sequence; identical to SEQ ID NO: 9313
  Description of Artificial Sequence: Synthetic coding sequence

SEQ ID NO: 12442 - DNA, 1188 bp, Artificial Sequence; identical to SEQ ID NO: 11022
  Description of Artificial Sequence: Synthetic coding sequence

SEQ ID NO: 12443 - DNA, 624 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagagagtgtgggacaaggtggtgagcggcagctgcaagatctag

SEQ ID NO: 12444 - DNA, 1404 bp, Artificial Sequence
  Description of Artificial Sequence: Synthetic coding sequence
atggccagcctgctgcagagcgacagagtgctgtacctggtgcagggcgagaagaaggtgagagcccccctgagccagctgtacttctgcagatactgcagcgagctgagaagcctggagtgcgtgagccacgaggtggacagccactactgccccagctgcctggagaacatgcccagcgccgaggccaagctgaagaagaacagatgcgccaactgcttcgactgccccggctgcatgcacaccctgagcaccagagccaccagcatcagcacccagctgcccgacgaccccgccaagaccaccatgaagaaggcctactacctggcctgcggcttctgcagatggaccagcagagacgtgggcatggccgacaagagcgtggccagcggcggctggcaggagcccgagaacccccacacccagagaatgaacaagctgatcgagtactaccagcagctggcccagaaggagaaggtggagagagacagaaagaagctggccagaagaagaaactacatgcccctggccttcagccagcacaccatccacgtggtggacaagtacggcctgggcaccagactgcagagacccagagccggcgccagcatcagcaccctggccggcctgagcctgaaggagggcgaggaccagaaggagatcaagatcgagcccgcccaggccgtggacgaggtggagcccctgcccgaggactactacaccagacccgtgaacctgaccgaggtgaccaccctgcagcagagactgctgcagcccgacttccagcccgtgtgcgccagccagctgtaccccagacacaagcacctgctgatcaagagaagcctgagatgcagaaagtgcgagcacaacctgagcaagcccgagttcaaccccaccagcatcaagttcaagatccagctggtggccgtgaactacatccccgaggtgagaatcatgagcatccccaacctgagatacatgaaggagagccaggtgctgctgaccctgaccaaccccgtggagaacctgacccacgtgaccctgttcgagtgcgaggagggcgaccccgacgacatcaacagcaccgccaaggtggtggtgccccccaaggagctggtgctggccggcaaggacgccgccgccgagtacgacgagctggccgagccccaggacttccaggacgaccccgacatcatcgccttcagaaaggccaacaaggtgggcatcttcatcaaggtgaccccccagagagaggagggcgaggtgaccgtgtgcttcaagatgaagcacgacttcaagaacctggccgcccccatcagacccatcgaggagagcgaccagggcaccgaggtgatctggctgacccagcacgtggagctgagcctgggccccctgctgccctag

SEQ ID NO: 12445 - DNA, 435 bp, Artificial Sequence
  Description of Artificial Sequence: Synthetic coding sequence
gtgagagagctggaggccgagctggacgccgagcagaagaagcacgccgaggccctgaagggcgtgagaaagcacgagagaagagtgaaggagctggcctaccaggccgaggaggacagaaagaacctggccagaatgcaggacctggtggacaagctgcagagcaaggtgaagagctacaagagacagttcgaggaggccgtgagcgccctgggccccggccacctggacagagccccccagctgtgccccagagtgtgcggccaggagcagcaggccaacaccaacctggccaagtacagaaaggcccagcacgagctggacgacgccgaggagagagccgacatggccgagacccaggccaacaagctgagagccagaaccagagacgccctgggccccaagctgagcctgagcccccagcacaaggagtag

SEQ ID NO: 12446 - DNA, 747 bp, Artificial Sequence; identical to SEQ ID NO: 11765
  Description of Artificial Sequence: Synthetic coding sequence

SEQ ID NO: 12447 - DNA, 3468 bp, Artificial Sequence
  Description of Artificial Sequence: Synthetic coding sequence
atggccgccagcagagacctgctgaaggagttcccccagcccaagaacctgctgaacagcgtgatcggcagagccctgggcatcagccacgccaaggacaagctggtgtacgtgcacaccaacggccccaagaagaagaaggtgaccctgcacatcaagtggcccaagagcgtggaggtggagggctacggcagcaagaagatcgacgccgagagacaggccgccgccgccgcctgccagctgttcaagggctggggcctgctgggccccagaaacgagctgttcgacgccgccaagtacagagtgctggccgacagattcggcagccccgccgacagctggtggagacccgagcccaccatgccccccaccagctggagacagctgaaccccgagagcatcagacccggcggccccggcggcctgagcagaagcctgggcagagaggaggaggaggacgaggaggaggagctggaggagggcaccatcgacgtgaccgacttcctgagcatgacccagcaggacagccacgcccccctgagagacagcagaggcagcagcttcgagatgaccgacgacgacagcgccatcagagccctgacccagttccccctgcccaagaacctgctggccaaggtgatccagatcgccaccagcagcagcaccgccaagaacctgatgcagttccacaccgtgggcaccaagaccaagctgagcaccctgaccctgctgtggccctgccccatgaccttcgtggccaagggcagaagaaaggccgaggccgagaacaaggccgccgccctggcctgcaagaagctgaagagcctgggcctggtggacagaaacaacgagcccctgacccacgccatgtacaacctggccagcctgagagagctgggcgagacccagagaagaccctgcaccatccaggtgcccgagcccatcctgagaaagatcgagaccttcctgaaccactaccccgtggagagcagctggatcgcccccgagctgagactgcagagcgacgacatcctgcccctgggcaaggacagcggccccctgagcgaccccatcaccggcaagccctacgtgcccctgctggaggccgaggaggtgagactgagccagagcctgctggagctgtggagaagaagaggccccgtgtggcaggaggccccccagctgcccgtggacccccacagagacaccatcctgaacgccatcgagcagcaccccgtggtggtgatcagcggcgacaccggctgcggcaagaccaccagaatcccccagctgctgctggagagatacgtgaccgagggcagaggcgccagatgcaacgtgatcatcacccagcccagaagaatcagcgccgtgagcgtggcccagagagtgagccacgagctgggccccagcctgagaagaaacgtgggcttccaggtgagactggagagcaagccccccagcagaggcggcgccctgctgttctgcaccgtgggcatcctgctgagaaagctgcagagcaaccccagcctggagggcgtgagccacgtgatcgtggacgaggtgcacgagagagacgtgaacaccgacttcctgctgatcctgctgaagggcctgcagagactgaaccccgccctgagactggtgctgatgagcgccaccggcgacaacgagagattcagcagatacttcggcggctgccccgtgatcaaggtgcccggcttcatgtaccccgtgaaggagcactacctggaggacatcctggccaagctgggcaagcaccagtacctgcacagacacagacaccacgagagcgaggacgagtgcgccctggacctggacctggtgaccgacctggtgctgcacatcgacgccagaggcgagcccggcggcatcctgtgcttcctgcccggctggcaggagatcaagggcgtgcagcagagactgcaggaggccctgggcatgcacgagagcaagtacctgatcctgcccgtgcacagcaacatccccatgatggaccagaaggccatcttccagcagccccccgtgggcgtgagaaagatcgtgctggccaccaacatcgccgagaccagcatcaccatcaacgacatcgtgcacgtggtggacagcggcctgcacaaggaggagagatacgacctgaagaccaaggtgagctgcctggagaccgtgtgggtgagcagagccaacgtgatccagagaagaggcagagccggcagatgccagagcggcttcgcctaccacctgttccccagaagcagactggagaagatggtgcccttccaggtgcccgagatcctgagaacccccctggagaacctggtgctgcaggccaagatccacatgcccgagaagaccgccgtggagttcctgagcaaggccgtggacagccccaacatcaaggccgtggacgaggccgtgatcctgctgcaggagatcggcgtgctggaccagagagagtacctgaccaccctgggccagagactggcccacatcagcaccgaccccagactggccaaggccatcgtgctggccgccatcttcagatgcctgcaccccctgctggtggtggtgagctgcctgaccagagaccccttcagcagcagcctgcagaacagagccgaggtggacaaggtgaaggccctgctgagccacgacagcggcagcgaccacctggccttcgtgagagccgtggccggctgggaggaggtgctgagatggcaggacagaagcagcagagagaactacctggaggagaacctgctgtacgcccccagcctgagattcatccacggcctgatcaagcagttcagcgagaacatctacgaggccttcctggtgggcaagcccagcgactgcaccctggccagcgcccagtgcaacgagtacagcgaggaggaggagctggtgaagggcgtgctgatggccggcctgtaccccaacctgatccaggtgagacagggcaaggtgaccagacagggcaagttcaagcccaacagcgtgacctacagaaccaagagcggcaacatcctgctgcacaagagcaccatcaacagagaggccaccagactgagaagcagatggctgacctacttcatggccgtgaagagcaacggcagcgtgttcgtgagagacagcagccaggtgcaccccctggccgtgctgctgctgaccgacggcgacgtgcacatcagagacgacggcagaagagccaccatcagcctgagcgacagcgacctgctgagactggagggcgacagcagaaccgtgagactgctgaaggagctgagaagagccctgggcagaatggtggagagaagcctgagaagcgagctggccgccctgccccccagcgtgcaggaggagcacggccagctgctggccctgctggccgagctgctgagaggcccctgcggcagcttcgacgtgagaaagaccgccgacgactag

SEQ ID NO: 12448 - DNA, 762 bp, Artificial Sequence
  Description of Artificial Sequence: Synthetic coding sequence
tgagtgggcgtggaggccgccagagtgatcgccaaggccctggagaagaagagcgagctgaagagatgccactggagcgacatgttcaccggcagactgagaaccgagatcccccccgccctgatcagcctgggcgagggcctgatcaccgccggcgcccagctggtggagctggacctgagcgacaacgccttcggccccgacggcgtgcagggcttcgaggccctgctgaagagcagcgcctgcttcaccctgcaggagctgaagctgaacaactgcggcatgggcatcggcggcggcaaggtgatcggcaccctggaggaggtgcacatgccccagaacggcatcaaccaccccggcatcaccgccctggcccaggccttcgccgtgaaccccctgctgagagtgatcaacctgaacgacaacaccttcaccgagaagggcgccgtggccatggccgagaccctgaagaccctgagacaggtggaggtgatcaacttcggcgactgcctggtgagaagcaagggcgccgtggccatcgccgacgccatcagaggcggcctgcccaagctgaaggagctgaacctgagcttctgcgagatcaagagagacgccgccctggccgtggccgaggccatggccgacaaggccgagctggagaagctggacctgaacggcaacaccctgggcgaggagggctgcgagcagctgcaggaggtgctggagggcttcaacatggccaaggtgctggccagcctgtag

SEQ ID NO: 12449 - DNA, 3735 bp, Artificial Sequence
  Description of Artificial Sequence: Synthetic coding sequence
gacgtgggcggcgacagaccctgggacagcggcaacacccagctgccccccagaaaccccgtgaaggccaacgccatgttcggcgccggcgacgaggacgacaccgacttcctgagccccagcggcggcgccagactggccagcctgttcggcctggaccaggccgccgccggccacggcaacgagttcttccagtacaccgcccccaagcagcccaagaagggccagggcaccgccgccaccggcaaccaggccacccccaagaccgcccccgccaccatgagcacccccaccatcctggtggccaccgccgtgcacgcctacagatacaccaacggccagtacgtgaagcagggcaagttcggcgccgccgtgctgggcaaccacaccgccagagagtacagaatcctgctgtacatcagccagcagcagcccgtgaccgtggccagaatccacgtgaacttcgagctgatggtgagacccaacaactacagcaccttctacgacgaccagagacagaactggagcatcatgttcgagagcgagaaggccgccgtggagttcaacaagcaggtgtgcatcgccaagtgcaacagcaccagcagcctggacgccgtgctgagccaggacctgatcgtggccgacggccccgccgtggaggtgggcgacagcctggaggtggcctacaccggctggctgttccagaaccacgtgctgggccaggtgttcgacagcaccgccaacaaggacaagctgctgagactgaagctgggcagcggcaaggtgatcaagggctgggaggacggcatgctgggcatgaagaagggcggcaagagactgctgatcgtgccccccgcctgcgccgtgggcagcgagggcgtgatcggctggacccaggccaccgacagcatcctggtgttcgaggtggaggtgagaagagtgaagttcgccagagacagcggcagcgacggccacagcgtgagcagcagagacagcgccgcccccagccccatccccggcgccgacaacctgagcgccgaccccgtggtgagcccccccaccagcatccccttcaagagcggcgagcccgccctgagaaccaagagcaacagcctgagcgagcagctggccatcaacaccagccccgacgccgtgaaggccaagctgatcagcagaatggccaagatgggccagcccatgctgcccatcctgcccccccagctggacagcaacgacagcgagatcgaggacgtgaacaccctgcagggcggcggccagcccgtggtgacccccagcgtgcagcccagcctgcaccccgcccaccccgccctgccccagatgaccagccaggccccccagcccagcgtgaccggcctgcaggcccccagcgccgccctgatgcaggtgagcagcctggacagccacagcgccgtgagcggcaacgcccagagcttccagccctacgccggcatgcaggcctacgcctacccccaggccagcgccgtgaccagccagctgcagcccgtgagacccctgtaccccgcccccctgagccagcccccccacttccagggcagcggcgacatggccagcttcctgatgaccgaggccagacagcacaacaccgagatcagaatggccgtgagcaaggtggccgacaagatggaccacctgatgaccaaggtggaggagctgcagaagcacagcgccggcaacagcatgctgatccccagcatgagcgtgaccatggagaccagcatgatcatgagcaacatccagagaatcatccaggagaacgagagactgaagcaggagatcctggagaagagcaacagaatcgaggagcagaacgacaagatcagcgagctgatcgagagaaaccagagatacgtggagcagagcaacctgatgatggagaagagaaacaacagcctgcagaccgccaccgagaacacccaggccagagtgctgcacgccgagcaggagaaggccaaggtgaccgaggagctggccgccgccaccgcccaggtgagccacctgcagctgaagatgaccgcccaccagaagaaggagaccgagctgcagatgcagctgaccgagagcctgaaggagaccgacctgctgagaggccagctgaccaaggtgcaggccaagctgagcgagctgcaggagaccagcgagcaggcccagagcaagttcaagagcgagaagcagaacagaaagcagctggagctgaaggtgaccagcctggaggaggagctgaccgacctgagagtggagaaggagagcctggagaagaacctgagcgagagaaagaagaagagcgcccaggagagaagccaggccgaggaggagatcgacgagatcagaaagagctaccaggaggagctggacaagctgagacagctgctgaagaagaccagagtgagcaccgaccaggccgccgccgagcagctgagcctggtgcaggccgagctgcagacccagtgggaggccaagtgcgagcacctgctggccagcgccaaggacgagcacctgcagcagtaccaggaggtgtgcgcccagagagacgcctaccagcagaagctggtgcagctgcaggagaagtgcctggccctgcaggcccagatcaccgccctgaccaagcagaacgagcagcacatcaaggagctggagaagaacaagagccagatgagcggcgtggaggccgccgccagcgaccccagcgagaaggtgaagaagatcatgaaccaggtgttccagagcctgagaagagagttcgagctggaggagagctacaacggcagaaccatcctgggcaccatcatgaacaccatcaagatggtgaccctgcagctgctgaaccagcaggagcaggagaaggaggagagcagcagcgaggaggaggaggagaaggccgaggagagacccagaagacccagccaggagcagagcgccagcgccagcagcggccagccccaggcccccctgaacagagagagacccgagagccccatggtgcccagcgagcaggtggtggaggaggccgtgcccctgcccccccaggccctgaccaccagccaggacggccacagaagaaagggcgacagcgaggccgaggccctgagcgagatcaaggacggcagcctgccccccgagctgagctgcatccccagccacagagtgctgggcccccccaccagcatcccccccgagcccctgggccccgtgagcatggacagcgagtgcgaggagagcctggccgccagccccatggccgccaagcccgacaaccccagcggcaaggtgtgcgtgagagaggtggcccccgacggccccctgcaggagagcagcaccagactgagcctgaccagcgaccccgaggagggcgaccccctggccctgggccccgagagccccggcgagccccagcccccccagctgaagaaggacgacgtgaccagcagcaccggcccccacaaggagctgagcagcaccgaggccggcagcaccgtggccggcgccgccctgagacccagccaccacagccagagaagcagcctgagcggcgacgaggaggacgagctgttcaagggcgccaccctgaaggccctgagacccaaggcccagcccgaggaggaggacgaggacgaggtgagcatgaagggcagacccccccccacccccctgttcggcgacgacgacgacgacgacgacatcgactggctgggctag

SEQ ID NO: 12450 - DNA, 1653 bp, Artificial Sequence
  Description of Artificial Sequence: Synthetic coding sequence
atgaagtgggaggagtacgaggagctgctgcactacgccatcgtgacccccaacatcgagccctgcgccagccagagcagccaccccaagggcgagctggtgcccgacgtgagaatcagcaccatccacgacatcctgcacagccagggcaacaacagcgaggtgagagagaccgccatcgaggtgggcaagggctgcgacttccacatcagcagccacagcaagaccgacgagagcagccccgtgctgagccccagaaagcccagccaccccgtgatggacttcttcagcagccacctgctggccgacagcagcagccccgccaccaacagcagccacaccgacgcccacgagatcctggtgagcgacttcctggtgagcgacgagaacctgcagaagatggagaacgtgctggacctgtggagcagcggcctgaagaccaacatcatcagcgagctgagcaagtggagactgaacttcatcgactggcacagaatggagatgagaaaggagaaggagaagcacgccgcccacctgaagcagctgtgcaaccagatcaacgagctgaaggagctgcagaagaccttcgagatcagcatcggcagaaaggacgaggtgatcagcagcctgagccacgccatcggcaagcagaaggagaagatcgagctgatgagaaccttcttccactggagaatcggccacgtgagagccagacaggacgtgtacgagggcaagctggccgaccagtactaccagagaaccctgctgaagaaggtgtggaaggtgtggagaagcgtggtgcagaagcagtggaaggacgtggtggagagagcctgccaggccagagccgaggaggtgtgcatccagatcagcaacgactacgaggccaaggtggccatgctgagcggcgccctggagaacgccaaggccgagatccagagaatgcagcacgagaaggagcacttcgaggacagcatgaagaaggccttcatgagaggcgtgtgcgccctgaacctggaggccatgaccatcttccagaacagaaacgacgccggcatcgacagcaccaacaacaagaaggaggagtacggccccggcgtgcagggcaaggagcacagcgcccacctggaccccagcgccccccccatgcccctgcccgtgaccagccccctgctgcccagcccccccgccgccgtgggcggcgccagcgccaccgccgtgcccagcgccgccagcatgaccagcaccagagccgccagcgccagcagcgtgcacgtgcccgtgagcgccctgggcgccggcagcgccgccaccgccgccagcgaggagatgtacgtgcccagagtggtgaccagcgcccagcagaaggccggcagaaccatcaccgccagaatcaccggcagatgcgacttcgccagcaagaacagaatcagcagcagcctggccatcatgggcgtgagcccccccatgagcagcgtggtggtggagaagcaccaccccgtgaccgtgcagaccatcccccaggccaccgccgccaagtaccccagaaccatccaccccgagagcagcaccagcgccagcagaagcctgggcaccagaagcgcccacacccagagcctgaccagcgtgcacagcatcaaggtggtggactag

SEQ ID NO: 12451 - DNA, 402 bp, Artificial Sequence
  Description of Artificial Sequence: Synthetic coding sequence
atgagccccagccagatgatcatgcccaacgtgatggagatgatcgccgccctgggccccggccccagcccctaccccctgccccccccccccggcggcaccaacagcaacgactacagcagccagggcaacaactaccagggccacggcaacttcgacttcccccacggcaaccccggcggcaccagcatgaacgacttcatgcacggccccccccagctgagccacccccccgacatgcccaacaacatggccgccctggagaagcccctgagccaccccatgcaggagaccctgctgcccgagctgaccaaccccgacgagctgctgagctacctggacccccccgacctgcccagcaacagcaacgacgacctgctgagcctgttcgagaacaactag

SEQ ID NO: 12452 - DNA, 1473 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagatcctggtgaagaccatgatcagaaagagaagcttcggcaaccccttcgagggcagcagaagagaggagagaagcctgagcgcccccggcaacctgctgaccaagaagcccaccagagagtgcgagagcctgagcgagctgaagacctag

SEQ ID NO: 12453 - DNA, 1872 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagttcagcgccttcgacatgagcgcccccacccccgccagatgctgccccgccatcggcaccctgtacaacaccaacaccctggagagcttcaagaccgccgacaagaagctgctgctggagcaggccgccaacgagatctgggagagcatcaagagcggcaccgccctggagaaccccgtgctgctgaacaagttcctgctgctgaccttcgccatcgaggccctggagtgcgcctacgacaacctgtgccagaccgagggcgtgaccgccctgccctacttcctgatcaagtacgacgagaacatggtgctggtgagcctgctgaagcactacagcgacttcttccagggccagagaaccaagatcaccatcggcgtgtacgacccctgcaacctggcccagtaccccggctggcccctgagaaacttcctggtgctggccgcccacagatggagcagcagcttccagagcgtggaggtggtgtgcttcagagacagaaccatgcagggcgccagagacgtggcccacagcatcatcttcgaggtgaagctgcccgagatggccttcagccccgactgccccaaggccgtgggctgggagaagaaccagaagggcggcatgggccccagaatggtgaacctgagcgagtgcatggaccccaagagactggccgagagcagcgtggacctgaacctgaagctgatgtgctggagactggtgcccaccctggacctggacaaggtggtgagcgtgaagtgcctgctgctgggcgccggcaccctgggctgcaacgtggccagaaccctgatgggctggggcgtgagacacatcaccttcgtggacaacgccaagatcagctacagcaaccccgtgagacagcccctgtacgagttcgaggactgcctgggcggcggcaagcccaaggccctggccgccgccgacagactgcagaagatcttccccggcgtgaacgccagaggcttcaacatgagcatccccatgcccggccaccccgtgaacttcagcagcgtgaccctggagcaggccagaagagacgtggagcagctggagcagctgatcgagagccacgacgtggtgttcctgctgatggacaccagagagagcagatggctgcccgccgtgatcgccgccagcaagagaaagctggtgatcaacgccgccctgggcttcgacaccttcgtggtgatgagacacggcctgaagaagcccaagcagcagggcgccggcgacctgtgccccaaccaccccgtggccagcgccgacctgctgggcagcagcctgttcgccaacatccccggctacaagctgggctgctacttctgcaacgacgtggtggcccccggcgacagcaccagagacagaaccctggaccagcagtgcaccgtgagcagacccggcctggccgtgatcgccggcgccctggccgtggagctgatggtgagcgtgctgcagcaccccgagggcggctacgccatcgccagcagcagcgacgacagaatgaacgagccccccaccagcctgggcctggtgccccaccagatcagaggcttcctgagcagattcgacaacgtgctgcccgtgagcctggccttcgacaagtgcaccgcctgcagcagcaagatctgggacatgagcgacgacgagaccatctag

SEQ ID NO: 12454 - DNA, 966 bp, Artificial Sequence
  Description of Artificial Sequence: Synthetic coding sequence
agaagaaacgtggagctgatcaacgaggaggccgccatgttcgacagcctgctgatggacagctacgtgagcagcaccaccggcgagagcgtgatcaccagagagatggtggagatgctgttcagcgacgacagcgacctgcagctggccaccacccagaagttcagaaagctgctgagcaaggagcccagcccccccatcgacgaggtgatcaacacccccagagtggtggacagattcgtggagttcctgaagagaaacgagaactgcaccctgcaggccgtgtgggccctgggcaacatcgccggcgacagcagcgtgtgcagagactacgtgctgaactgcagcatcctgaaccccctgctgaccctgctgaccaagagcaccagactgaccatgaccagaaacgccgtgtgggccctgagcaacctgtgcagaggcaagaaccccccccccgagttcgccaaggtgagcccctgcctgcccgtgctgagcagactgctgttcagcagcgacagcgacctgctggccgacgcctgctgggccctgagctacctgagcgacggccccaacgagaagatccaggccgtgatcgacagcggcgtgtgcagaagactggtggagctgctgatgcacaacgactacaaggtggccagccccgccctgagagccgtgggcaacatcgtgaccggcgacgacatccagacccaggtgatcctgaactgcagcgccctgccctgcctgctgcacctgctgagcagccccaaggagagcatcagaaaggaggcctgctggaccatcagcaacatcaccgccggcaacagagcccagatccaggccgtgatcgacgccaacatcttccccgtgctgatcgagatcctgcagaaggccgagttcagaaccagaaaggaggccgcctgggccatcaccaacgccaccagcggcggcacccccgagcagatctag

SEQ ID NO: 12455 - DNA, 795 bp, Artificial Sequence
  Description of Artificial Sequence: Synthetic coding sequence
atgggcggcgcccagctggagctgcccagcggcgccagacccggcgtgtgcgtgagaagaagcttcagagcccacgccggcgaccagcccagaagaccccccggccccatccccgtgcccggcaccatgaagcaggagagcgccgcccccaacaccccccccaccagccagagccccacccccagcgcccagttccccagaaacgacggcgacccccaggccctgtggatcttcggctacggcagcctggtgtggagacccgacttcgcctacagcgacagcagagtgggcttcgtgagaggctacagcagaagattctggcagggcgacaccttccacagaggcagcgacaagatgcccggcagagtggtgaccctgctggaggaccacgagggctgcacctggggcgtggcctaccaggtgcagggcgagcaggtgagcaaggccctgaagtacctgaacgtgagagaggccgtgctgggcggctacgacaccaaggaggtgaccttctacccccaggacgcccccgaccagcccctgaaggccctggcctacgtggccaccccccagaaccccggctacctgggccccgcccccgaggaggccatcgccacccagatcctggcctgcagaggcttcagcggccacaacctggagtacctgctgagactggccgacttcatgcagctgtgcggcccccaggcccaggacgagcacctggccgccatcgtggacgccgtgggcaccatgctgccctgcttctgccccaccgagcaggccctggccctggtgtag

SEQ ID NO: 12456 - DNA, 747 bp, Artificial Sequence; identical to SEQ ID NO: 11765
  Description of Artificial Sequence: Synthetic coding sequence

SEQ ID NO: 12457 - DNA, 768 bp, Artificial Sequence
  Description of Artificial Sequence: Synthetic coding sequence
atgagcagcagcatgtggtacatcatgcagagcatccagagcaagtacagcctgagcgagagactgatcagaaccatcgccgccatcagaagcttcccccacgacaacgtggaggacctgatcagaggcggcgccgacgtgaactgcacccacggcaccctgaagcccctgcactgcgcctgcatggtgagcgacgccgactgcgtggagctgctgctggagaagggcgccgaggtgaacgccctggacggctacaacagaaccgccctgcactacgccgccgagaaggacgaggcctgcgtggaggtgctgctggagtacggcgccaaccccaacgccctggactacaacaacgacacccccctgagctgggccgccatgaagggcaacctggagagcgtgagcatcctgctggactacggcgccgaggtgagagtgatcaacctgatcggccagacccccatcagcagactggtggccctgctggtgagaggcctgggcaccgagaaggaggacagctgcttcgagctgctgcacagagccgtgggccacttcgagctgagaaagaacggcaccatgcccagagaggtggccagagacccccagctgtgcgagaagctgaccgtgctgtgcagcgcccccggcaccctgaagaccctggccagatacgccgtgagaagaagcctgggcctgcagtacctgcccgacgccgtgaagggcctgcccctgcccgccagcctgaaggagtacctgctgctgctggagtag

SEQ ID NO: 12458 - DNA, 585 bp, Artificial Sequence
  Description of Artificial Sequence: Synthetic coding sequence
gagcccgtgcagccccactggttctactgcaaggaggtggagtacaagcagctgtggatgcccttcagcgtgttcgacagcctgaacctggaggagatctacaacagcgtgcagcccgaccccgagagcgtggtgctgggcaccgacggcggcagatacgacgtgtacctgtacgacagaatcagaaaggccgcctactgggaggaggagcccgccgaggtgagaagatgcacctggttctacaagggcgacaccgacagcagattcatcccctacaccgaggagttcagcgagaagctggaggtgatcgtgcagttccagcccagcagcgtgcccgacgagtggggcaccacccaggacggccagaccagacccagagtggtgaagagaggcatcgacgacaacctggacgagatccccgacggcgagatgccccaggtggaccacctggtgttcgtggtgcacggcatcggccccgtgtgcgacctgagattcagaagcatcatcgagtgcgtggacgacttcagagtggtgagcctgaagctgctgagaacccacttcaagaagagcctggacgacggctag

SEQ ID NO: 12459 - DNA, 981 bp, Artificial Sequence; identical to SEQ ID NO: 11734
  Description of Artificial Sequence: Synthetic coding sequence

SEQ ID NO: 12460 - DNA, 990 bp, Artificial Sequence
  Description of Artificial Sequence: Synthetic coding sequence
atggccggcgccctggagggcgacatcttcatcggccccaaggccgaggagcacagaggcctgctgagcatcagataccccatggagcacggcatcgtgaaggactggaacgacatggagagaatctggcagtacgtgtacagcaaggaccagctgcagaccttcagcgaggagcaccccgtgctgctgaccgaggcccccctgaaccccagaaagaacagagagagagccgccgaggtgttcttcgagaccttcaacgtgcccgccctgttcatcagcatgcaggccgtgctgagcctgtacgccaccggcagaaccaccggcgtggtgctggacagcggcgacggcgtgacccacgccgtgcccatctacgagggcttcgccatgccccacagcatcatgagaatcgacatcgccggcagagacgtgagcagattcctgagactgtacctgagaaaggagggctacgacttccacagcagcagcgagttcgagatcgtgaaggccatcaaggagagagcctgctacctgagcatcaacccccagaaggacgagaccctggagaccgagaaggcccagtactacctgcccgacggcagcaccatcgagatcggccccagcagattcagagcccccgagctgctgttcagacccgacctgatcggcgaggagagcgagggcatccacgaggtgctggtgttcgccatccagaagagcgacatggacctgagaagaaccctgttcagcaacatcgtgctgagcggcggcagcaccctgttcaagggcttcggcgacagactgctgagcgaggtgaagaagctggcccccaaggacgtgaagatcagaatcagcgccccccaggagagactgtacagcacctggatcggcggcagcatcctggccagcctggacaccttcaagaagatgtgggtgagcaagaaggagtacgaggaggacggcgccagaagcatccacagaaagaccttctag

SEQ ID NO: 12461 - DNA, 450 bp, Artificial Sequence
  Description of Artificial Sequence: Synthetic coding sequence
atggagaagaccgagctgatccagaaggccaagctggccgagcaggccgagagatacgacgacatggccacctgcatgaaggccgtgaccgagcagggcgccgagctgagcaacgaggagagaaacctgctgagcgtggcctacaagaacgtggtgggcggcagaagaagcgcctggagagtgatcagcagcatcgagcagaagaccgacaccagcgacaagaagctgcagctgatcaaggactacagagagaaggtggagagcgagctgagaagcatctgcaccaccgtgctggagctgctggacaagtacctgatcgccaacgccaccaaccccgagagcaaggtgttctacctgaagatgaagggcgactacttcagatacctggccgaggtggcctgcggcgacgacagaaagcagaccatcgacaacagccagggcgcctactag

SEQ ID NO: 12462 - DNA, 735 bp, Artificial Sequence
  Description of Artificial Sequence: Synthetic coding sequence
atgctgagcgacagaaagagagagctggagcacagactgagcgccaccctggaggagaacgacctgctgcagggcaccgtggaggagctgcaggacagagtgctgatcctggagagacagggccacgacaaggacctgcagctgcaccagagccagctggagctgcaggaggtgagactgagctgcagacagctgcaggtgaaggtggaggagctgaccgaggagagaagcctgcagagcagcgccgccaccagcaccagcctgctgagcgagatcgagcagagcatggaggccgaggagctggagcaggagagagagcaggtgaccctgctgagcgtggagatgaccgccctgaaggaggagagagacagactgagagtgaccagcgaggacaaggagcccaaggagcagctgcagaaggccatcagagacagagacgaggccatcgccaagaagaacgccgtggagctggagctggccaagtgcagaatggacatgatgagcctgaacagccagctgctggacgccatccagcagaagctgaacctgagccagcagctggaggcctggcaggacgacatgcacagagtgatcgacagacagctgatggacacccacctgaaggagagaagccagcccgccgccgccctgtgcagaggccacagcgccggcagaggcgacgagcccagcatcgccgagggcaagagactgttcagcttcttcagaaagatctag

SEQ ID NO: 12463 - DNA, 603 bp, Artificial Sequence
  Description of Artificial Sequence: Synthetic coding sequence
tgacacatgctgagcaaggtgggcatgtgggacttcgacatcttcctgttcgacagactgaccaacggcaacagcctggtgaccctgctgtgccacctgttcaacacccacggcctgatccaccacttcaagctggacatggtgaccctgcacagattcctggtgatggtgcaggaggactaccacagccagaacccctaccacaacgccgtgcacgccgccgacgtgacccaggccatgcactgctacctgaaggagcccaagctggccagcttcctgacccccctggacatcatgctgggcctgctggccgccgccgcccacgacgtggaccaccccggcgtgaaccagcccttcctgatcaagaccaaccaccacctggccaacctgtaccaggtgagagagcccaacctggagcccgccaccgtgtggagcatcgccctgggccccgtgctgaagcccgagagctgcccctggagaaagccctgcttcagagtgctggaggtgcagagaagaatgaagcacaacctgtgcccccagaagttcgtgcagacccagatgctgaagatgagcaagatccaggccaacctgatccccgtgtag

SEQ ID NO: 12464 - DNA, 1728 bp, Artificial Sequence; identical to SEQ ID NO: 9795
  Description of Artificial Sequence: Synthetic coding sequence

SEQ ID NO: 12465 - DNA, 3036 bp, Artificial Sequence; identical to SEQ ID NO: 11029
  Description of Artificial Sequence: Synthetic coding sequence

SEQ ID NO: 12466 - DNA, 3786 bp, Artificial Sequence
  Description of Artificial Sequence: Synthetic coding sequence
atggccgccgccgccgccagcggcgccggcggcgccgccggcgccggcaccggcggcgccggccccgccggcagactgctgcccccccccgcccccggcagccccgccgcccccgccgccgtgagccccgccgccggccagcccagaccccccgcccccgccagcagaggccccatgcccgccagaatcggctactacgagatcgacagaaccatcggcaagggcaacttcgccgtggtgaagagagccacccacctggtgaccaaggccaaggtggccatcaagatcatcgacaagacccagctggacgaggagaacctgaagaagatcttcagagaggtgcagatcatgaagatgctgtgccacccccacatcatcagactgtaccaggtgatggagaccgagagaatgatctacctggtgaccgagtacgccagcggcggcgagatcttcgaccacctggtggcccacggcagaatggccgagaaggaggccagaagaaagttcaagcagatcgtgaccgccgtgtacttctgccactgcagaaacatcgtgcacagagacctgaaggccgagaacctgctgctggacgccaacctgaacatcaagatcgccgacttcggcttcagcaacctgttcacccccggccagctgctgaagacctggtgcggcagccccccctacgccgcccccgagctgttcgagggcaaggagtacgacggccccaaggtggacatctggagcctgggcgtggtgctgtacgtgctggtgtgcggcgccctgcccttcgacggcagcaccctgcagaacctgagagccagagtgctgagcggcaagttcagaatccccttcttcatgagcaccgagtgcgagcacctgatcagacacatgctggtgctggaccccaacaagagactgagcatggagcagatctgcaagcacaagtggatgaagctgggcgacgccgaccccaacttcgacagactgatcgccgagtgccagcagctgaaggaggagagacaggtggaccccctgaacgaggacgtgctgctggccatggaggacatgggcctggacaaggagcagaccctgcaggccgagcaggccggcaccgccatgaacatcagcgtgccccaggtgcagctgatcaaccccgagaaccagatcgtggagcccgacggcaccctgaacctggacagcgacgagggcgaggagcccagccccgaggccctggtgagatacctgagcatgagaagacacaccgtgggcgtggccgaccccagaaccgaggtgatggaggacctgcagaagctgctgcccggcttccccggcgtgaacccccaggcccccttcctgcaggtggcccccaacgtgaacttcatgcacaacctgctgcccatgcagaacctgcagcccaccggccagctggagtacaaggagcagagcctgctgcagccccccaccctgcagctgctgaacggcatgggccccctgggcagaagagccagcgacggcggcgccaacatccagctgcacgcccagcagctgctgaagagacccagaggccccagccccctggtgaccatgacccccgccgtgcccgccgtgacccccgtggacgaggagagcagcgacggcgagcccgaccaggaggccgtgcagagatacctggccaacagaagcaagagacacaccctggccatgaccaaccccaccgccgagatcccccccgacctgcagagacagctgggccagcagcccttcagaagcagagtgtggcccccccacctggtgcccgaccagcacagaagcacctacaaggacagcaacaccctgcacctgcccaccgagagattcagccccgtgagaagattcagcgacggcgccgccagcatccaggccttcaaggcccacctggagaagatgggcaacaacagcagcatcaagcagctgcagcaggagtgcgagcagctgcagaagatgtacggcggccagatcgacgagagaaccctggagaagacccagcagcagcacatgctgtaccagcaggagcagcaccaccagatcctgcagcagcagatccaggacagcatctgccccccccagcccagcccccccctgcaggccgcctgcgagaaccagcccgccctgctgacccaccagctgcagagactgagaatccagcccagcagccccccccccaaccaccccaacaaccacctgttcagacagcccagcaacagccccccccccatgagcagcgccatgatccagccccacggcgccgccagcagcagccagttccagggcctgcccagcagaagcgccatcttccagcagcagcccgagaactgcagcagcccccccaacgtggccctgacctgcctgggcatgcagcagcccgcccagagccagcaggtgaccatccaggtgcaggagcccgtggacatgctgagcaacatgcccggcaccgccgccggcagcagcggcagaggcatcagcatcagccccagcgccggccagatgcagatgcagcacagaaccaacctgatggccaccctgagctacggccacagacccctgagcaagcagctgagcgccgacagcgccgaggcccacagcgcccaccagcagcccccccactacaccaccagcgccctgcagcaggccctgctgagccccaccccccccgactacaccagacaccagcaggtgccccacatcctgcagggcctgctgagccccagacacagcctgaccggccacagcgacatcagactgccccccaccgagttcgcccagctgatcaagagacagcagcagcagagacagcagcagcagcagcagcagcagcagcaggagtaccaggagctgttcagacacatgaaccagggcgacgccggcagcctggcccccagcctgggcggccagagcatgaccgagagacaggccctgagctaccagaacgccgacagctaccaccaccacaccagcccccagcacctgctgcagatcagagcccaggagtgcgtgagccaggccagcagccccacccccccccacggctacgcccaccagcccgccctgatgcacagcgagagcatggaggaggactgcagctgcgagggcgccaaggacggcttccaggacagcaagagcagcagcaccctgaccaagggctgccacgacagccccctgctgctgagcaccggcggccccggcgaccccgagagcctgctgggcaccgtgagccacgcccaggagctgggcatccacccctacggccaccagcccaccgccgccttcagcaagaacaaggtgcccagcagagagcccgtgatcggcaactgcatggacagaagcagccccggccaggccgtggagctgcccgaccacaacggcctgggctaccccgccagacccagcgtgcacgagcaccacagacccagagccctgcagagacaccacaccatccagaacagcgacgacgcctacgtgcagctggacaacctgcccggcatgagcctggtggccggcaaggccctgagcagcgccagaatgagcgacgccgtgctgagccagagcagcctgatgggcagccagcagttccaggacggcgagaacgaggagtgcggcgccagcctgggcggccacgagcaccccgacctgagcgacggcagccagcacctgaacagcagctgctaccccagcacctgcatcaccgacatcctgctgagctacaagcaccccgaggtgagcttcagcatggagcaggccggcgtgtag

SEQ ID NO: 12467 - DNA, 519 bp, Artificial Sequence
  Description of Artificial Sequence: Synthetic coding sequence
atgagcagcaacgagtgcttcaagtgcggcagaagcggccactgggccagagagtgccccaccggcggcggcagaggcagaggcatgagaagcagaggcagaggcttccagttcgtgagcagcagcctgcccgacatctgctacagatgcggcgagagcggccacctggccaaggactgcgacctgcaggaggacgtggaggcctgctacaactgcggcagaggcggccacatcgccaaggactgcaaggagcccaagagagagagagagcagtgctgctacaactgcggcaagcccggccacctggccagagactgcgaccacgccgacgagcagaagtgctacagctgcggcgagttcggccacatccagaaggactgcaccaaggtgaagtgctacagatgcggcgagaccggccacgtggccatcaactgcagcaagaccagcgaggtgaactgctacagatgcggcgagagcggccacctggccagagagtgcaccatcgaggccaccgcctag

SEQ ID NO: 12468 - DNA, 471 bp, Artificial Sequence
  Description of Artificial Sequence: Synthetic coding sequence
atgctggccgagaagctgcccaacctgacccacctgaacctgagcggcaacaagctgaaggacatcagcaccctggagcccctgaagaagctggagtgcctgaagagcctggacctgttcaactgcgaggtgaccaacctgaacgactacagagagagcgtgttcaagctgctgccccagctgacctacctggacggctacgacagagaggaccaggaggcccccgacagcgacgccgaggtggacggcgtggacgaggaggaggaggacgaggagggcgaggacgaggaggacgaggacgacgaggacggcgaggaggaggagttcgacgaggaggacgacgaggacgaggacgtggagggcgacgaggacgacgacgaggtgagcgaggaggaggaggagttcggcctggacgaggaggacgaggacgaggacgaggacgaggaggaggaggagggcggcaagggctag

SEQ ID NO: 12469 - DNA, 516 bp, Artificial Sequence; identical to SEQ ID NO: 12009
  Description of Artificial Sequence: Synthetic coding sequence

SEQ ID NO: 12470 - DNA, 111 bp, Artificial Sequence
  Description of Artificial Sequence: Synthetic coding sequence
atgatcgagaagatgcagggcagcagaatggacgagcagagatgcagcttccccccccccctgaagaccgaggaggactacatcccctaccccagcgtgcacgaggtgtag

SEQ ID NO: 12471 - DNA, 639 bp, Artificial Sequence
  Description of Artificial Sequence: Synthetic coding sequence
atgagcagcaagggcagcagcaccgacggcagaaccgacctggccaacggcagcctgagcagcagccccgaggagatgagcggcgccgaggagggcagagagaccagcagcggcatcgaggtggaggccagcgacctgagcctgagcctgaccggcgacgacggcggccccaacagaaccagcaccgagagcagaggcaccgacaccgagagcagcggcgaggacaaggacagcgacagcatggaggacaccggccactacagcatcaacgacgagaacagagtgcacgacagaagcgaggaggaggaggaggaggaggaggaggaggaggaggagcagcccagaagaagagtgcagagaaagagagccaacagagaccaggacagcagcgacgacgagagagccctggaggactgggtgagcagcgagaccagcgccctgcccagacccagatggcaggccctgcccgccctgagagagagagagctgggcagcagcgccagattcgtgtacgaggcctgcggcgccagagtgttcgtgcagagattcagactgcagcacggcctggagggccacaccggctgcgtgaacaccctgcacttcaaccagagaggcacctggctggccagcggcagctag

SEQ ID NO: 12472 - DNA, 726 bp, Artificial Sequence
  Description of Artificial Sequence: Synthetic coding sequence
atgaccagcgtgaccagaagcgagatcatcgacgagaagggccccgtgatgagcaagacccacgaccaccagctggagagcagcctgagccccgtggaggtgttcgccaagaccagcgccagcctggagatgaaccagggcgtgagcgaggagagaatccacctgggcagcagccccaagaagggcggcaactgcgacctgagccaccaggagagactgcagagcaagagcctgcacctgagcccccaggagcagagcgccagctaccaggacagaagacagagctggagaagagccagcatgaaggagaccaacagaagaaagagcctgcaccccatccaccagggcatcaccgagctgagcagaagcatcagcgtggacctggccgagagcaagagactgggctgcctgctgctgagcagcttccagttcagcatccagaagctggagcccttcctgagagacaccaagggcttcagcctggagagcttcagagccaaggccagcagcctgagcgaggagctgaagcacttcgccgacggcctggagaccgacggcaccctgcagaagtgcttcgaggacagcaacggcaaggccagcgacttcagcctggaggccagcgtggccgagatgaaggagtacatcaccaagttcagcctggagagacagacctgggaccagctgctgctgcactaccagcaggaggccaaggagatcctgagctag

SEQ ID NO: 12473 - DNA, 1188 bp, Artificial Sequence; identical to SEQ ID NO: 11022
  Description of Artificial Sequence: Synthetic coding sequence

SEQ ID NO: 12474 - DNA, 1887 bp, Artificial Sequence
  Description of Artificial Sequence: Synthetic coding sequence
atgagcgacaagagcgacctgaaggccgagctggagagaaagaagcagagactggcccagatcagagaggagaagaagagaaaggaggaggagagaaagaagaaggaggccgacatgcagcagaagaaggagcccgtgcaggacgacagcgacctggacagaaagagaagagagaccgaggccctgctgcagagcatcggcatcagccccgagccccccctggtgcccacccccatgagccccagcagcaagagcgtgagcacccccagcgaggccggcagccaggacagcggcgacctgggccccctgaccagaaccctgcagtgggacaccgaccccagcgtgctgcagctgcagagcgacagcgagctgggcagaagactgcacaagctgggcgtgagcaaggtgacccaggtggacttcctgcccagagaggtggtgagctacagcaaggagacccagacccccctggccacccaccagagcgaggaggacgaggaggacgaggagatggtggagagcaaggtgggccaggacagcgagctggagaaccaggacaagaagcaggaggtgaaggaggccccccccagagagctgaccgaggaggagaagcagcagatcctgcacagcgaggagttcctgatcttcttcgacagaaccatcagagtgatcgagagagccctggccgaggacagcgacatcttcttcgactacagcggcagagagctggaggagaaggacggcgacgtgcaggccggcgccaacctgagcttcaacagacagttctacgacgagcactggagcaagcacagagtggtgacctgcatggactggagcctgcagtaccccgagctgatggtggccagctacaacaacaacgaggacgccccccacgagcccgacggcgtggccctggtgtggaacatgaagttcaagaagaccacccccgagtacgtgttccactgccagagcagcgtgatgagcgtgtgcttcgccagattccaccccaacctggtggtgggcggcacctacagcggccagatcgtgctgtgggacaacagaagccacagaagaacccccgtgcagagaacccccctgagcgccgccgcccacacccaccccgtgtactgcgtgaacgtggtgggcacccagaacgcccacaacctgatcaccgtgagcaccgacggcaagatgtgcagctggagcctggacatgctgagcaccccccaggagagcatggagctggtgtacaacaagagcaagcccgtggccgtgaccggcatggccttccccaccggcgacgtgaacaacttcgtggtgggcagcgaggagggcaccgtgtacaccgcctgcagacacggcagcaaggccggcatcggcgaggtgttcgagggccaccagggccccgtgaccggcatcaactgccacatggccgtgggccccatcgacttcagccacctgttcgtgaccagcagcttcgactggaccgtgaagctgtggaccaccaagcacaacaagcccctgtacagcttcgaggacaacgccgactacgtgtacgacgtgatgtggagccccgtgcaccccgccctgttcgcctgcgtggacggcatgggcagactggacctgtggaacctgaacaacgacaccgaggtgcccaccgccagcgtggccatcgagggcgccagcgccctgaacagagtgagatgggcccaggccggcaaggaggtggccgtgggcgacagcgagggcagaatctgggtgtacgacgtgggcgagctggccgtgccccacaacgacgagtggaccagattcgccagaaccctggtggagatcagagccaacagagccgacagcgaggaggagggcaccgtggagctgagcgcctag

SEQ ID NO: 12475 - DNA, 1644 bp, Artificial Sequence; identical to SEQ ID NO: 10555
  Description of Artificial Sequence: Synthetic coding sequence

SEQ ID NO: 12476 - DNA, 747 bp, Artificial Sequence
  Description of Artificial Sequence: Synthetic coding sequence
atggccttcagcggcagagccagaccctgcatcatccccgagaacgaggagatccccagagccgccctgaacaccgtgcacgaggccaacggcaccgaggacgagagagccgtgagcaagctgcagagaagacacagcgacgtgaaggtgtacaaggagttctgcgacttctacgccaagttcaacatggccaacgccctggccagcgccacctgcgagagatgcaagggcggcttcgcccccgccgagaccatcgtgaacagcaacggcgagctgtaccacgagcagtgcttcgtgtgcgcccagtgcttccagcagttccccgagggcctgttctacgagttcgagggcagaaagtactgcgagcacgacttccagatgctgttcgccccctgctgccaccagtgcggcgagttcatcatcggcagagtgatcaaggccatgaacaacagctggcaccccgagtgcttcagatgcgacctgtgccaggaggtgctggccgacatcggcttcgtgaagaacgccggcagacacctgtgcagaccctgccacaacagagagaaggccagaggcctgggcaagtacatctgccagaagtgccacgccatcatcgacgagcagcccctgatcttcaagaacgacccctaccaccccgaccacttcaactgcgccaactgcggccaggagggcagcgactgcagatgcaccggcgccgagagaggcgccatcctgcccgccatgccctag

SEQ ID NO: 12477 - DNA, 621 bp, Artificial Sequence
  Description of Artificial Sequence: Synthetic coding sequence
atggagagcaacttcaaccaggagggcgtgcccagacccagctacgtgttcagcgccgaccccatcgccagacccagcgagatcaacttcgacggcatcaagctggacctgagccacgagttcagcctggtggcccccaacaccgaggccaacagcttcgagagcaaggactacctgcaggtgtgcctgagaatcagacccttcacccagagcgagaaggagctggagagcgagggctgcgtgcacatcctggacagccagaccgtggtgctgaaggagccccagtgcatcctgggcagactgagcgagaagagcagcggccagatggcccagaagttcagcttcagcaaggtgttcggccccgccaccacccagaaggagttcttccagggctgcatcatgcagcccgtgaaggacctgctgaagggccagagcagactgatcttcacctacggcctgaccaacagcggcaagacctacaccttccagggcaccgaggagaacatcggcatcctgcccagaaccctgaacgtgctgttcgacagcctgcaggagagactgtacaccaagatgaacctgaagccccacagaagcagagagtacctgagactgagcagctag

SEQ ID NO: 12478 - DNA, 990 bp, Artificial Sequence
  Description of Artificial Sequence: Synthetic coding sequence
atggaggtggccgagcccagcagccccaccgaggaggaggaggaggaggaggagcacagcgccgagcccagacccagaaccagaagcaaccccgagggcgccgaggacagagccgtgggcgcccaggccagcgtgggcagcagaagcgagggcgagggcgaggccgccagcgccgacgacggcagcctgaacaccagcggcgccggccccaagagctggcaggtgcccccccccgcccccgaggtgcagatcagaacccccagagtgaactgccccgagaaggtgatcatctgcctggacctgagcgaggagatgagcctgcccaagctggagagcttcaacggcagcaagaccaacgccctgaacgtgagccagaagatgatcgagatgttcgtgagaaccaagcacaagatcgacaagagccacgagttcgccctggtggtggtgaacgacgacaccgcctggctgagcggcctgaccagcgaccccagagagctgtgcagctgcctgtacgacctggagaccgccagctgcagcaccttcaacatcagcggcgccagccccgccagacagcagaagaccgagctgcccgtgaccgagaacgtgcagaccatcccccccccctacgtggtgagaaccatcctggtgtacagcagacccccctgccagccccagttcagcctgaccgagcccatgaagaagatgttccagtgcccctacttcttcttcgacgtggtgtacatccacaacggcaccgaggagaaggaggaggagatgagctggaaggacatgttcgccttcatgggcagcctggacaccaagggcaccagctacaagtacgaggtggccctggccggccccgccctggagctgcacaactgcatggccaagctgctggcccaccccctgcagagaccctgccagagccacgccagctacagcctgctggaggaggaggacgaggccatcgaggtggaggccaccgtgtag

SEQ ID NO: 12479 - DNA, 1620 bp, Artificial Sequence; identical to SEQ ID NO: 10018
  Description of Artificial Sequence: Synthetic coding sequence

SEQ ID NO: 12480 - DNA, 3558 bp, Artificial Sequence
  Description of Artificial Sequence: Synthetic coding sequence
atgtgcgaggtgatgcccaccatcaacgagggcgacagactgggccccccccacggcgccgacgccgacgccaacttcgagcagctgatggtgaacatgctggacgagagagagaagctgctggagagcctgagagagagccaggagaccctggccgccacccagagcagactgcaggacgccatccacgagagagaccagctgcagagacacctgaacagcgccctgccccaggagttcgccaccctgaccagagagctgagcatgtgcagagagcagctgctggagagagaggaggagatcagcgagctgaaggccgagagaaacaacaccagactgctgctggagcacctggagtgcctggtgagcagacacgagagaagcctgagaatgaccgtggtgaagagacaggcccagagccccagcggcgtgagcagcgaggtggaggtgctgaaggccctgaagagcctgttcgagcaccacaaggccctggacgagaaggtgagagagagactgagagccgccctggagagagtgaccaccctggaggagcagctggccggcgcccaccagcaggtgagcgccctgcagcagggcgccggcgtgagagacggcgccgccgaggaggagggcaccgtggagctgggccccaagagactgtggaaggaggacaccggcagagtggaggagctgcaggagctgctggagaagcagaacttcgagctgagccaggccagagagagactggtgaccctgaccaccaccgtgaccgagctggaggaggacctgggcaccgccagaagagacctgatcaagagcgaggagctgagcagcaagcaccagagagacctgagagaggccctggcccagaaggaggacatggaggagagaatcaccaccctggagaagagatacctggccgcccagagagaggccaccagcatccacgacctgaacgacaagctggagaacgagctggccaacaaggagagcctgcacagacagtgcgaggagaaggccagacacctgcaggagctgctggaggtggccgagcagaagctgcagcagaccatgagaaaggccgagaccctgcccgaggtggaggccgagctggcccagagaatcgccgccctgaccaaggccgaggagagacacggcaacatcgaggagcacctgagacagctggagggccagctggaggagaagaaccaggagctggccagaaccgccgtgcaggtgagacagagagagaagatgaacgaggaccacaacaagagactgagcgacaccgtggacagactgctgagcgagagcaacgagagactgcagctgcacctgaaggagagaatggccgccctggaggagaagaacaccctgatccaggagctggagagcagccagagacagatcgaggagcagcaccaccacaagggcagactgagcgaggagatcgagaagctgagacaggaggtggaccagctgaagggcagaggcggccccttcgtggacggcgtgcacagcagaagccacatgggcagcgccgccgacgtgagattcagcctgggcaccaccacccacgccccccccggcgtgcacagaagatacagcgccctgagagaggagagcgccaagctggccctgcccctgaccgtgaccctgagaagccccacctggatgagaatgagccagggcgtgtgctgcaacctggagtaccacagcagcggcaccctgtgcggcagcagcggccccctgcccgtgcccgagatgatccaggaggagaaggagagcaccgagctgagagccgaggagatcgagaccagagtgaccagcggcagcatggaggccctgaacctgaagcagctgagaaagagaggcagcatccccaccagcctgaccgccctgagcctggccagcgccagcccccccctgagcggcagaagcacccccaagctgaccagcagaagcgccgcccaggacctggacagaatgggcgtgatgaccctgcccagcgacctgagaaagcacagaagaaagctgctgagccccgtgagcagagaggagaacagagaggacaaggccaccatcaagtgcgagaccagcccccccagcagccccagaaccctgagactggagaagctgggccaccccgccctgagccaggaggagggcaagagcgccctggaggaccagggcagcaaccccagcagcagcaacagcagccaggacagcctgcacaagggcgccaagagaaagggcatcaagagcagcatcggcagactgttcggcaagaaggagaagggcagactgatccagctgagcagagacggcgccaccggccacgtgctgctgaccgacagcgagttcagcatgcaggagcccatggtgcccgccaagctgggcacccaggccgagaaggacagaagactgaagaagaagcaccagctgctggaggacgccagaagaaagggcatgcccttcgcccagtgggacggccccaccgtggtgagctggctggagctgtgggtgggcatgcccgcctggtacgtggccgcctgcagagccaacgtgaagagcggcgccatcatgagcgccctgagcgacaccgagatccagagagagatcggcatcagcaacgccctgcacagactgaagctgagactggccatccaggagatggtgagcctgaccagccccagcgccccccccaccagcagaaccagcagcggcaacgtgtgggtgacccacgaggagatggagaccctggagaccagcaccaagaccgacagcgaggagggcagctgggcccagaccctggcctacggcgacatgaaccacgagtggatcggcaacgagtggctgcccagcctgggcctgccccagtacagaagctacttcatggagtgcctggtggacgccagaatgctggaccacctgaccaagaaggacctgagagtgcacctgaagatggtggacagcttccacagaaccagcctgcagtacggcatcatgtgcctgaagagactgaactacgacagaaaggagctggagaagagaagagaggagagccagcacgagatcaaggacgtgctggtgtggaccaacgaccaggtggtgcactgggtgcagagcatcggcctgagagactacgccggcaacctgcacgagagcggcgtgcacggcgccctgctggccctggacgagaacttcgaccacaacaccctggccctgatcctgcagatccccacccagaacacccaggccagacaggtgatggagagagagttcaacaacctgctggccctgggcaccgacagaaagctggacgacggcgacgacaaggtgttcagaagagcccccagctggagaaagagattcagacccagagagcaccacggcagaggcggcatgctgagcgccagcgccgagaccctgcccgccggcttcagagtgagcaccctgggcaccctgcagcccccccccgccccccccaagaagatcatgcccgaggcccacagccactacctgtacggccacatgctgagcgccttcagagactag

SEQ ID NO: 12481 - DNA, 1383 bp, Artificial Sequence
  Description of Artificial Sequence: Synthetic coding sequence
atggagatctgcgacatcatcaacgagaccgaggagggccccaaggacgccctgagagccgtgaagaagagaatcgtgggcaacaagaacttccacgaggtgatgctggccctgaccgtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacaccccccagagaaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggcatgaacctgggcagcagcagcgtgagagccggcctgcagagcctggaggccagcggcagactggaggacgagttcgacatgttcgccctgaccagaggcagcagcctggccgaccagagaaaggaggtgaagtacgaggccccccaggccaccgacggcctggccggcgccctggacgccagacagcagagcaccggcgccatccccgtgacccaggcctgcctgatggaggacatcgagcagtggctgagcaccgacgtgggcaacgacgccgaggagcccaagggcgtgaccagcgagggcaagttcgacaagttcctggaggagagagccaaggccgccgacagactgcccaacctgagcagccccagcgccgagggcccccccggcccccccagcggccccgcccccagaaagaagacccaggagaaggacgacgacatgctgttcgccctgtag

SEQ ID NO: 12482 - DNA, 180 bp, Artificial Sequence
  Description of Artificial Sequence: Synthetic coding sequence
atgatgatgaagatgatgatgagaatgaagatcagaaagatcagataccactgccagagaaagcagaacctgatccacaacaacggcaacggcctgggcagcgtgcccgtggagaagctggtgctgcaccccagccccatccagaacccccagcagagcgccgtggtgagctgcgagtag

SEQ ID NO: 12483 - DNA, 537 bp, Artificial Sequence
  Description of Artificial Sequence: Synthetic coding sequence
atgctgggcctggacgcctgcgagctgggcgcccagctgctggagctgctgagactggccctgtgcgccagagtgctgctggccgacaaggagggcggcccccccgccgtggacgaggtgctggacgaggccgtgcccgagtacagagcccccggcagaaagagcctgctggagatcagacagctggaccccgacgacagaagcctggccaagtacaagagagtgctgctgggccccctgccccccgccgtggaccccagcctgcccaacgtgcaggtgaccagactgaccctgctgagcgagcaggcccccggccccgtggtgatggacctgaccggcgacctggccgtgctgaaggaccaggtgttcgtgctgaaggagggcgtggactacagagtgcacagagagatcgtgagcggcctgaagtgcctgcaccacacctacagaagaggcctgagagtggacaagaccgtgtacatggtgggcagctacggccccagcgcccaggagtacgagttcgtgacccccgtggagtag

SEQ ID NO: 12484 - DNA, 1119 bp, Artificial Sequence
  Description of Artificial Sequence: Synthetic coding sequence
atggacagcgtgagaagcggccccttcggccaggtgttcagacccgacaacttcatcttcggccagtgcggcgccggcaacaactgggccaagggccactacaccgagggcgccgagctgatggagagcgtgatggacgtggtgagaaaggaggccgagagctgcgactgcctgcagggcttccagctgacccacagcctgggcggcggcaccggcagcggcatgggcaccctgctgctgagcaagatcagagaggagtaccccgacagaatcatcaacaccttcagcatcctgcccagccccaaggtgagcgacaccgtggtggagccctacaacgccaccctgagcgtgcaccagctgatcgagaacgccgacgagaccttctgcatcgacaacgaggccctgtacgacatctgcagcaagaccctgaagctgcccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtggccgagctgacccagcagatgttcgacgccaagaacatgatggccgcctgcgaccccagacacggcagatacctgaccgccgccgccatcttcagaggcagaatgcccatgagagaggtggacgagcagatgttcaacatccaggacaagaacagcagctacttcgccgactggctgcccaacaacgtgaagaccgccgtgtgcgacatcccccccagaggcctgaagatgagcgccaccttcatcggcaacaacaccgccatccaggagctgttcaagagagtgagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacgaggagtacgccgaggaggaggtggcctag

SEQ ID NO: 12485 - DNA, 576 bp, Artificial Sequence
  Description of Artificial Sequence: Synthetic coding sequence
atggccgccgccaaggacacccacgaggaccacgacaccagcaccgagaacaccgacgagagcaaccacgacccccagttcgagcccatcgtgagcctgcccgagcaggagatcaagaccctggaggaggacgaggaggagctgttcaagatgagagccaagctgttcagattcgccagcgagaacgacctgcccgagtggaaggagagaggcaccggcgacgtgaagctgctgaagcacaagaccctgaagatctgcgccaaccactacatcacccccatgatggagctgaagcccaacgccggcagcgacagagcctgggtgtggaacacccacgccgacttcgccgacgagtgccccaagcccgagctgctggccatcagattcctgaacgccgagagcgagcccagagccctgggcacctgcctgacctggggcagccccgcctggcagagaggcggcctgtgcgccaccaacgccgtggccttctggggcgagggcgccgtgaccggcaagtgcgtggtgtgggccgccctgccctgctgcctgggcgccatgcccagactgaagccctag

SEQ ID NO: 12486 - DNA, 369 bp, Artificial Sequence; identical to SEQ ID NO: 12080
  Description of Artificial Sequence: Synthetic coding sequence

SEQ ID NO: 12487 - DNA, 1383 bp, Artificial Sequence
  Description of Artificial Sequence: Synthetic coding sequence
atggccagcctgctgcagagcgacagagtgctgtacctggtgcagggcgagaagaaggtgagagcccccctgagccagctgtacttctgcagatactgcagcgagctgagaagcctggagtgcgtgagccacgaggtggacagccactactgccccagctgcctggagaacatgcccagcgccgaggccaagctgaagaagaacagatgcgccaactgcttcgactgccccggctgcatgcacaccctgagcaccagagccaccagcatcagcacccagctgcccgacgaccccgccaagaccaccatgaagaaggcctactacctggcctgcggcttctgcagatggaccagcagagacgtgggcatggccgacaagagcgtggccagcggcggctggcaggagcccgagaacccccacacccagagaatgaacaagctgatcgagtactaccagcagctggcccagaaggagaaggtggagagagacagaaagaagctggccagaagaagaaactacatgcccctggccttcagcgacaagtacggcctgggcaccagactgcagagacccagagccggcgccagcatcagcaccctggccggcctgagcctgaaggagggcgaggaccagaaggagatcaagatcgagcccgcccaggccgtggacgaggtggagcccctgcccgaggactactacaccagacccgtgaacctgaccgaggtgaccaccctgcagcagagactgctgcagcccgacttccagcccgtgtgcgccagccagctgtaccccagacacaagcacctgctgatcaagagaagcctgagatgcagaaagtgcgagcacaacctgagcaagcccgagttcaaccccaccagcatcaagttcaagatccagctggtggccgtgaactacatccccgaggtgagaatcatgagcatccccaacctgagatacatgaaggagagccaggtgctgctgaccctgaccaaccccgtggagaacctgacccacgtgaccctgttcgagtgcgaggagggcgaccccgacgacatcaacagcaccgccaaggtggtggtgccccccaaggagctggtgctggccggcaaggacgccgccgccgagtacgacgagctggccgagccccaggacttccaggacgaccccgacatcatcgccttcagaaaggccaacaaggtgggcatcttcatcaaggtgaccccccagagagaggagggcgaggtgaccgtgtgcttcaagatgaagcacgacttcaagaacctggccgcccccatcagacccatcgaggagagcgaccagggcaccgaggtgatctggctgacccagcacgtggagctgagcctgggccccctgctgccctag

SEQ ID NO: 12488 - DNA, 3336 bp, Artificial Sequence
  Description of Artificial Sequence: Synthetic coding sequence
atggagatggacgcccccagaccccccagcctggccgtgcccggcgccgccagcagacccggcagactgctggacggcggccacggcagacagcaggtgcaggccctgagcagccagctgctggaggtgatccccgacagcatgagaaagcaggaggtgagaaccggcagagaggccggccagggccacggcaccggcagccccgccgagcaggtgaaggccctgatggacctgctggccggcaagggcagccagggcagccaggccccccaggccctggacagaacccccgacgcccccctgggcccctgcagcaacgacagcagaatccagagacacagaaaggccctgctgagcaaggtgggcggcggccccgagctgggcggcccctggcacagactggccagcctgctgctggtggagggcctgaccgacctgcagctgagagagcacgacttcacccaggtggaggccaccagaggcggcggccaccccgccagaaccgtggccctggacagactgttcctgcccctgagcagagtgagcgtgccccccagagtgagcatcaccatcggcgtggccggcatgggcaagaccaccctggtgagacacttcgtgagactgtgggcccacggccaggtgggcaaggacttcagcctggtgctgcccctgaccttcagagacctgaacacccacgagaagctgtgcgccgacagactgatctgcagcgtgttcccccacgtgggcgagcccagcctggccgtggccgtgcccgccagagccctgctgatcctggacggcctggacgagtgcagaacccccctggacttcagcaacaccgtggcctgcaccgaccccaagaaggagatccccgtggaccacctgatcaccaacatcatcagaggcaacctgttccccgaggtgagcatctggatcaccagcagacccagcgccagcggccagatccccggcggcctggtggacagaatgaccgagatcagaggcttcaacgaggaggagatcaaggtgtgcctggagcagatgttccccgaggaccaggccctgctgggctggatgctgagccaggtgcaggccgacagagccctgtacctgatgtgcaccgtgcccgccttctgcagactgaccggcatggccctgggccacctgtggagaagcagaaccggcccccaggacgccgagctgtggccccccagaaccctgtgcgagctgtacagctggtacttcagaatggccctgagcggcgagggccaggagaagggcaaggccagccccagaatcgagcaggtggcccacggcggcagaaagatggtgggcaccctgggcagactggccttccacggcctgctgaagaagaagtacgtgttctacgagcaggacatgaaggccttcggcgtggacctggccctgctgcagggcgccccctgcagctgcttcctgcagagagaggagaccctggccagcagcgtggcctactgcttcacccacctgagcctgcaggagttcgtggccgccgcctactactacggcgccagcagaagagccatcttcgacctgttcaccgagagcggcgtgagctggcccagactgggcttcctgacccacttcagaagcgccgcccagagagccatgcaggccgaggacggcagactggacgtgttcctgagattcctgagcggcctgctgagccccagagtgaacgccctgctggccggcagcctgctggcccagggcgagcaccaggcctacagaacccaggtggccgagctgctgcagggctgcctgagacccgacgccgccgtgtgcgccagagccatcaacgtgctgcactgcctgcacgagctgcagcacaccgagctggccagaagcgtggaggaggccatggagagcggcgccctggccagactgaccggccccgcccacagagccgccctggcctacctgctgcaggtgagcgacgcctgcgcccaggaggccaacctgagcctgagcctgagccagggcgtgctgcagagcctgctgccccagctgctgtactgcagaaagctgagactggacaccaaccagttccaggaccccgtgatggagctgctgggcagcgtgctgagcggcaaggactgcagaatccagaagatcagcctggccgagaaccagatcagcaacaagggcgccaaggccctggccagaagcctgctggtgaacagaagcctgaccagcctggacctgagaggcaacagcatcggcccccagggcgccaaggccctggccgacgccctgaagatcaacagaaccctgaccagcctgagcctgcagggcaacaccgtgagagacgacggcgccagaagcatggccgaggccctggccagcaacagaaccctgagcatgctgcacctgcagaagaacagcatcggccccatgggcgcccagagaatggccgacctgaagcagaacagaagcctgaaggagctgatgttcagcagcaacagcatcggcgacggcggcgccaaggccctggccgaggccctgaaggtgaaccagggcctggagagcctggacctgcagagcaacagcatcagcgacgccggcgtggccgccctgatgggcgccctgtgcaccaaccagaccctgctgagcctgagcctgagagagaacagcatcagccccgagggcgcccaggccatcgcccacgccctgtgcgccaacagcaccctgaagaacctggacctgaccgccaacctgctgcacgaccagggcgccagagccatcgccgtggccgtgagagagaacagaaccctgaccagcctgcacctgcagtggaacttcatccaggccggcgccgcccaggccctgggccaggccctgcagctgaacagaagcctgaccagcctggacctgcaggagaacgccatcggcgacgacggcgcctgcgccgtggccagagccctgaaggtgaacaccgccctgaccgccctgtacctgcaggtggccagcatcggcgccagcggcgcccaggtgctgggcgaggccctggccgtgaacagaaccctggagatcctggacctgagaggcaacgccatcggcgtggccggcgccaaggccctggccaacgccctgaaggtgaacagcagcctgagaagactgaacctgcaggagaacagcctgggcatggacggcgccatctgcatcgccaccgccctgagcggcaaccacagactgcagcacatcaacctgcagggcaaccacatcggcgacagcggcgccagaatgatcagcgaggccatcaagaccaacgcccccacctgcaccgtggagatgtag

SEQ ID NO: 12489 - DNA, 2424 bp, Artificial Sequence
  Description of Artificial Sequence: Synthetic coding sequence
atgctggagagaagagccctgctgtggcagagagaggccggccccggctggggcgacagagccagagccggcaccggcggcgccggcggcggctgcggcggcgccatggccgagagaggccccgccttctgcggcctgtacgacaccagcagcctgctgagatactgcaacgacgacaacctgagcggcaccagcggcatggaggtggacgacagagtgagcgccctggagcagagactgcagctgcaggaggacgagctggccgtgctgaaggccgccctggccgacgccctgagaagactgagagcctgcgaggagcagggcgccgccctgagagccagaggcacccccaagggcagagccccccccagactgggcaccaccgccagcgtgtgccagctgctgaagggcctgcccaccagaacccccctgaacggcagcggcccccccagaagagtgggcggctacgccaccagccccagcagccccaagaaggaggccaccagcggcagaagcagcgtgagaagatacctgagccccgagagactggccagcgtgagaagagaggaccccagaagcagaaccaccagcagcagcagcaactgcagcgccaagaaggagggcaagaccaaggaggtgatcttcagcgtggaggacggcagcgtgaagatgttcctgagaggcagacccgtgcccatgatgatccccgacgagctggcccccacctacagcctggacaccagaagcgagctgcccagctgcagactgaagctggagtgggtgtacggctacagaggcagagactgcagagccaacctgtacctgctgcccaccggcgagatcgtgtacttcgtggccagcgtggccgtgctgtacagcgtggaggagcagagacagagacactacctgggccacaacgacgacatcaagtgcctggccatccaccccgacatggtgaccatcgccaccggccaggtggccggcaccaccaaggagggcaagcccctgcccccccacgtgagaatctgggacagcgtgagcctgagcaccctgcacgtgctgggcctgggcgtgttcgacagagccgtgtgctgcgtgggcttcagcaagagcaacggcggcaacctgctgtgcgccgtggacgagagcaacgaccacatgctgagcgtgtgggactgggccaaggagaccaaggtggtggacgtgaagtgcagcaacgaggccgtgctggtggccaccttccaccccaccgaccccaccgtgctgatcacctgcggcaagagccacatctacttctggaccctggagggcggcagcctgagcaagagacagggcctgttcgagaagcacgagaagcccaagtacgtgctgtgcgtgaccttcctggagggcggcgacgtggtgaccggcgacagcggcggcaacctgtacgtgtggggcaagggcggcaacagaatcacccaggccgtgctgggcgcccacgacggcggcgtgttcggcctgtgcgccctgagagacggcaccctggtgagcggcggcggcagaaacagcatcctgcagggcagcgtgcacaccggcttcagcctgctggtgcagggccacgtggaggagctgtggggcctggccacccaccccagcagagcccagttcgtgacctgcggccaggacaagctggtgcacctgtggagcagcgacagccaccagcccctgtggagcagaatcatcgaggaccccgccagaagcgccggcttccaccccagcggcagcgtgctggccgtgggcaccgtgaccggcagatggctgctgctggacaccgagacccacgacctggtggccatccacaccgacggcaacgagcagatcagcgtggtgagcttcagccccgacggcgcctacctggccgtgggcagccacgacaacctggtgtacgtgtacaccgtggaccagggcggcagaaaggtgagcagactgggcaagtgcagcggccacagcagcttcatcacccacctggactgggcccaggacagcagctgcttcgtgaccaacagcggcgactacgagatcctgtactgggaccccgccacctgcaagcagatcaccagcgccgacgccgtgagaaacatggagtgggccaccgccacctgcgtgctgggcttcggcgtgttcggcatctggagcgagggcgccgacggcaccgacatcaacgccgtggccagaagccacgacggcaagctgctggccagcgccgacgacttcggcaaggtgcacctgttcagctacccctgctgccagcccagagccctgagccacaagtacggcggccacagcagccacgtgaccaacgtggccttcctgtgggacgacagcatggccctgaccaccggcggcaaggacaccagcgtgctgcagtggagagtggtgtag

SEQ ID NO: 12490 - DNA, 1413 bp, Artificial Sequence
  Description of Artificial Sequence: Synthetic coding sequence
atggaggagaccatcaaggacccccccaccagcgccgtgctgctggaccactgccacttcagccaggtgatcttcaacagcgtggagaagttctacatccccggcggcgacgtgacctgccactacaccttcacccagcacttcatccccagaagaaaggactggatcggcatcttcagagccttcaagtgcttccaggacaagctggagcaggagctgctgaagtggagaagccagggccagaagctgcaggtgggctggaagaccaccagagagtactacaccttcatgtgggtgaccctgcccatcgacctgaacaacaagagcgccaagcagcaggaggtgcagttcaaggcctactacctgcccaaggacgacgagtactaccagttctgctacgtggacgaggacggcgtggtgagaggcgccagcatccccttccagttcagacccgagaacgaggaggacatcctggtggtgaccacccagggcgaggtggaggagatcgagcagcacaacaaggagctgtgcaaggagaaccaggagctgaaggacagctgcatcagcctgcagaagcagaacagcgacatgcaggccgagctgcagaagaagcaggaggagctggagaccctgcagagcatcaacaagaagctggagctgaaggtgaaggagcagaaggactactgggagaccgagctgctgcagctgaaggagcagaaccagaagatgagcagcgagaacgagaagatgggcatcagagtggaccagctgcaggcccagctgagcacccaggagaaggagatggagaagctggtgcagggcgaccaggacaagaccgagcagctggagcagctgaagaaggagaacgaccacctgttcctgagcctgaccgagcagagaaaggaccagaagaagctggagcagaccgtggagcagatgaagcagaacgagaccaccgccatgaagaagcagcaggagctgatggacgagaacttcgacctgagcaagagactgagcgagaacgagatcatctgcaacgccctgcagagacagaaggagagactggagggcgagaacgacctgctgaagagagagaacagcagactgctgagctacatgggcctggacttcaacagcctgccctaccaggtgcccaccagcgacgagggcggcgccagacagaaccccggcctggcctacggcaacccctacagcggcatccaggagagcagcagccccagccccctgagcatcaagaagtgccccatctgcaaggccgacgacatctgcgaccacaccctggagcagcagcagatgcagcccctgtgcttcaactgccccatctgcgacaagatcttccccgccaccgagaagcagatcttcgaggaccacgtgttctgccacagcctgtag

SEQ ID NO: 12491 - DNA, 1023 bp, Artificial Sequence
  Description of Artificial Sequence: Synthetic coding sequence
atgagcaagacccacgaccaccagctggagagcagcctgagccccgtggaggtgttcgccaagaccagcgccagcctggagatgaaccagggcgtgagcgaggagagaatccacctgggcagcagccccaagaagggcggcaactgcgacctgagccaccaggagagactgcagagcaagagcctgcacctgagcccccaggagcagagcgccagctaccaggacagaagacagagctggagaagagccagcatgaaggagaccaacagaagaaagagcctgcaccccatccaccagggcatcaccgagctgagcagaagcatcagcgtggacctggccgagagcaagagactgggctgcctgctgctgagcagcttccagttcagcatccagaagctggagcccttcctgagagacaccaagggcttcagcctggagagcttcagagccaaggccagcagcctgagcgaggagctgaagcacttcgccgacggcctggagaccgacggcaccctgcagaagtgcttcgaggacagcaacggcaaggccagcgacttcagcctggaggccagcgtggccgagatgaaggagtacatcaccaagttcagcctggagagacagacctgggaccagctgctgctgcactaccagcaggaggccaaggagatcctgagcagaggcagcaccgaggccaagatcaccgaggtgaaggtggagcccatgacctacctgggcagcagccagaacgaggtgctgaacaccaagcccgactaccagaagatcctgcagaaccagagcaaggtgttcgactgcatggagctggtgatggacgagctgcagggcagcgtgaagcagctgcaggccttcatggacgagagcacccagtgcttccagaaggtgagcgtgcagctgggcaagagaagcatgcagcagctggaccccagccccgccagaaagctgctgaagctgcagctgcagaacccccccgccatccacggcagcggcagcggcagctgccagtag

SEQ ID NO: 12492 - DNA, 522 bp, Artificial Sequence
  Description of Artificial Sequence: Synthetic coding sequence
atgacccacgtggccagccagttcgccagcagctacgtgttctactggagagactacttcgaggaccagcccctgctgtacccccccggcttcgacggcagagtggtggtgtaccccagcaaccagaccctgaaggactacctgagctggagacaggccgactgccacatcaacaacctgtacaacaccgtgttctgggccctgatccagcagagcggcctgacccccgtgcaggcccagggcagactgcagggcaccctggccgccgacaagaacgagatcctgttcagcgagttcaacatcaactacaacaacgagctgcccatgtacagaaagggcaccgtgctgatctggcagaaggtggacgaggtgatgaccaaggagatcaagctgcccaccgagatggagggcaagaagatggccgtgaccagaaccagaaccaagcccgtgcccctgcactgcgacatcatcggcgacgccttctggaaggagcaccccgagatcctggacgaggacagctag

SEQ ID NO: 12493 - DNA, 285 bp, Artificial Sequence
  Description of Artificial Sequence: Synthetic coding sequence
atggagatggagagcgccgccgccagcaccagattccaccagccccacatggagagaaagatgagcgccatggcctgcgagatcttcaacgagctgagactggagggcaagctgtgcgacgtggtgatcaaggtgaacggcttcgagttcagcgcccacaagaacatcctgtgcagctgcagcagctacttcagagccctgttcaccagcggctggaacaacaccgagaagaaggtgtacaacatccccggcatcagccccgacatgatgaagctgatcatctag

SEQ ID NO: 12494 - DNA, 1572 bp, Artificial Sequence; identical to SEQ ID NO: 9871
  Description of Artificial Sequence: Synthetic coding sequence

SEQ ID NO: 12495 - DNA, 372 bp, Artificial Sequence
  Description of Artificial Sequence: Synthetic coding sequence
atgggcaccggcgacttcatctgcatcagcatgaccggcggcgccccctggggcttcagactgcagggcggcaaggagcagaagcagcccctgcaggtggccaagatcagaaaccagagcaaggccagcggcagcggcctgtgcgagggcgacgaggtggtgagcatcaacggcaacccctgcgccgacctgacctaccccgaggtgatcaagctgatggagagcatcaccgacagcctgcagatgctgatcaagagaagagtgggcgcccccttcctgttcctggaggaccagagccacccccccttcctgcacctgctgggctacaccagcctgctgatcgtgaccctggtgaaccagcccatggactag

SEQ ID NO: 12496 - DNA, 1146 bp, Artificial Sequence; identical to SEQ ID NO: 11154
  Description of Artificial Sequence: Synthetic coding sequence

SEQ ID NO: 12497 - DNA, 615 bp, Artificial Sequence
  Description of Artificial Sequence: Synthetic coding sequence
atggtgatggccgagggcaccgccgtgctgagaagaaacagacccggcaccaaggcccagtacatccagcagaacatcagagccgactgcagcaacatcgacaagatcctggagccccccgagggccaggacgagggcgtgtggaagtacgagcacctgagacagttctgcctggagctgaacggcctggccgtgaagctgcagagcgagtgccaccccgacacctgcacccagatgaccgccaccgagcagtggatcttcctgtgcgccgcccacaagacccccaaggagtgccccgccatcgactacaccagacacaccctggacggcgccgcctgcctgctgaacagcaacaagtacttccccagcagagtgagcatcaaggagagcagcgtggccaagctgggcagcgtgtgcagaagaatctacagaatcttcagccacgcctacttccaccacagacagatcttcgacgagtacgagaacgagaccttcctgtgccacagattcaccaagttcgtgatgaagtacaacctgatgagcaaggacaacctgatcgtgcccatcctggaggaggaggtgcagaacagcgtgagcggcgagagcgaggcctag

SEQ ID NO: 12498 - DNA, 1293 bp, Artificial Sequence
  Description of Artificial Sequence: Synthetic coding sequence
atggccgccaacctgagcagaaacggccccgccctgcaggaggcctacgtgagagtggtgaccgagaagagccccaccgactgggccctgttcacctacgagggcaacagcaacgacatcagagtggccggcaccggcgagggcggcctggaggagatggtggaggagctgaacagcggcaaggtgatgtacgccttctgcagagtgaaggaccccaacagcggcctgcccaagttcgtgctgatcaactggaccggcgagggcgtgaacgacgtgagaaagggcgcctgcgccagccacgtgagcaccatggccagcttcctgaagggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12499 - DNA, 3189 bp, Artificial Sequence
  Description of Artificial Sequence: Synthetic coding sequence
atggtgagcagcgcccagatgggcttcaacctgcaggccctgctggagcagctgagccaggacgagctgagcaagttcaagtacctgatcaccaccttcagcctggcccacgagctgcagaagatcccccacaaggaggtggacaaggccgacggcaagcagctggtggagatcctgaccacccactgcgacagctactgggtggagatggccagcctgcaggtgttcgagaagatgcacagaatggacctgagcgagagagccaaggacgaggtgagagaggccgccctgaagagcttcaacaagagaaagcccctgagcctgggcatcaccagaaaggagagaccccccctggacgtggacgagatgctggagagattcaagaccgaggcccaggccttcaccgagaccaagggcaacgtgatctgcctgggcaaggaggtgttcaagggcaagaagcccgacaaggacaacagatgcagatacatcctgaagaccaagttcagagagatgtggaagagctggcccggcgacagcaaggaggtgcaggtgatggccgagagatacaagatgctgatccccttcagcaaccccagagtgctgcccggccccttcagctacaccgtggtgctgtacggccccgccggcctgggcaagaccaccctggcccagaagctgatgctggactgggccgaggacaacctgatccacaagttcaagtacgccttctacctgagctgcagagagctgagcagactgggcccctgcagcttcgccgagctggtgttcagagactggcccgagctgcaggacgacatcccccacatcctggcccaggccagaaagatcctgttcgtgatcgacggcttcgacgagctgggcgccgcccccggcgccctgatcgaggacatctgcggcgactgggagaagaagaagcccgtgcccgtgctgctgggcagcctgctgaacagagtgatgctgcccaaggccgccctgctggtgaccaccagacccagagccctgagagacctgagaatcctggccgaggagcccatctacatcagagtggagggcttcctggaggaggacagaagagcctacttcctgagacacttcggcgacgaggaccaggccatgagagccttcgagctgatgagaagcaacgccgccctgttccagctgggcagcgcccccgccgtgtgctggatcgtgtgcaccaccctgaagctgcagatggagaagggcgaggaccccgtgcccacctgcctgaccagaaccggcctgttcctgagattcctgtgcagcagattcccccagggcgcccagctgagaggcgccctgagaaccctgagcctgctggccgcccagggcctgtgggcccagaccagcgtgctgcacagagaggacctggagagactgggcgtgcaggagagcgacctgagactgttcctggacggcgacatcctgagacaggacagagtgagcaagggctgctacagcttcatccacctgagcttccagcagttcctgaccgccctgttctacaccctggagaaggaggaggaggaggacagagacggccacacctgggacatcggcgacgtgcagaagctgctgagcggcgtggagagactgagaaaccccgacctgatccaggccggctactacagcttcggcctggccaacgagaagagagccaaggagctggaggccaccttcggctgcagaatgagccccgacatcaagcaggagctgctgagatgcgacatcagctgcaagggcggccacagcaccgtgaccgacctgcaggagctgctgggctgcctgtacgagagccaggaggaggagctggtgaaggaggtgatggcccagttcaaggagatcagcctgcacctgaacgccgtggacgtggtgcccagcagcttctgcgtgaagcactgcagaaacctgcagaagatgagcctgcaggtgatcaaggagaacctgcccgagaacgtgaccgccagcgagagcgacgccgaggtggagagaagccaggacgaccagcacatgctgcccttctggaccgacctgtgcagcatcttcggcagcaacaaggacctgatgggcctggccatcaacgacagcttcctgagcgccagcctggtgagaatcctgtgcgagcagatcgccagcgacacctgccacctgcagagagtggtgttcaagaacatcagccccgccgacgcccacagaaacctgtgcctggccctgagaggccacaagaccgtgacctacctgaccctgcagggcaacgaccaggacgacatgttccccgccctgtgcgaggtgctgagacaccccgagtgcaacctgagatacctgggcctggtgagctgcagcgccaccacccagcagtgggccgacctgagcctggccctggaggtgaaccagagcctgacctgcgtgaacctgagcgacaacgagctgctggacgagggcgccaagctgctgtacaccaccctgagacaccccaagtgcttcctgcagagactgagcctggagaactgccacctgaccgaggccaactgcaaggacctggccgccgtgctggtggtgagcagagagctgacccacctgtgcctggccaagaaccccatcggcaacaccggcgtgaagttcctgtgcgagggcctgagataccccgagtgcaagctgcagaccctggtgctgtggaactgcgacatcaccagcgacggctgctgcgacctgaccaagctgctgcaggagaagagcagcctgctgtgcctggacctgggcctgaaccacatcggcgtgaagggcatgaagttcctgtgcgaggccctgagaaagcccctgtgcaacctgagatgcctgtggctgtggggctgcagcatcccccccttcagctgcgaggacctgtgcagcgccctgagctgcaaccagagcctggtgaccctggacctgggccagaaccccctgggcagcagcggcgtgaagatgctgttcgagaccctgacctgcagcagcggcaccctgagaaccctgagactgaagatcgacgacttcaacgacgagctgaacaagctgctggaggagatcgaggagaagaacccccagctgatcatcgacaccgagaagcaccacccctgggccgagagacccagcagccacgacttcatgatctag

SEQ ID NO: 12500 - DNA, 390 bp, Artificial Sequence; identical to SEQ ID NO: 10956
  Description of Artificial Sequence: Synthetic coding sequence

SEQ ID NO: 12501 - DNA, 516 bp, Artificial Sequence
  Description of Artificial Sequence: Synthetic coding sequence
atggaggtggccgagcccagcagccccaccgaggaggaggaggaggaggaggagcacagcgccgagcccagacccagaaccagaagcaaccccgagggcgccgaggacagagccgtgggcgcccaggccagcgtgggcagcagaagcgagggcgagggcgaggccgccagcgccgacgacggcagcctgaacaccagcggcgccggccccaagagctggcaggtgcccccccccgcccccgaggtgcagatcagaacccccagagtgaactgccccgagaaggtgatcatctgcctggacctgagcgaggagatgagcctgcccaagctggagagcttcaacggccagcagaagaccgagctgcccgtgaccgagaacgtgcagaccatcccccccccctacgtggtgagaaccatcctggtgtacagcagacccccctgccagccccagttcagcctgaccgagcccatgaaggtgggcgaggcctgggagagagagggctgcctgcagccctag

SEQ ID NO: 12502 - DNA, 1446 bp, Artificial Sequence; identical to SEQ ID NO: 12062
  Description of Artificial Sequence: Synthetic coding sequence

SEQ ID NO: 12503 - DNA, 1986 bp, Artificial Sequence
  Description of Artificial Sequence: Synthetic coding sequence
atgaacaccggcagagacagccagagccccgacagcgcctggagaagctacaacgacggcaaccaggagaccctgaacggcgacgccacctacagcagcctggccgccaagggcttcagaagcgtgagacccaacctgcaggacaagagaagccccacccagagccagatcaccgtgaacggcaacagcggcggcgccgtgagccccatgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagaccatgttcaagcagatccacatggtgcacaagcccgacgacgacaccgacatgtacaacaccccctacacctacaacgccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccccccccaagaagcccctggactacgtgcaggaccacagcagcggcgtgttcaacgaggccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 12504 - DNA, 483 bp, Artificial Sequence; identical to SEQ ID NO: 10977
  Description of Artificial Sequence: Synthetic coding sequence

SEQ ID NO: 12505 - DNA, 717 bp, Artificial Sequence
  Description of Artificial Sequence: Synthetic coding sequence
atggactgcagagagatggacctgtacgaggactaccagagccccttcgacttcgacgccggcgtgaacaagagctacctgtacctgagccccagcggcaacagcagcccccccggcagccccaccctgcagaagttcggcctgctgagaaccgaccccgtgcccgaggagggcgaggacgtggccgccaccatcagcgccaccgagaccctgagcgaggaggagcaggaggagctgagaagagagctggccaaggtggaggaggagatccagaccctgagccaggtgctggccgccaaggagaagcacctggccgagatcaagagaaagctgggcatcaacagcctgcaggagctgaagcagaacatcgccaagggctggcaggacgtgaccgccaccagcgcctacaagaagaccagcgagaccctgagccaggccggccagaaggccagcgccgccttcagcagcgtgggcagcgtgatcaccaagaagctggaggacgtgaacatcagaagcatccagcacagcatcagcatgcccgccatgagaaacagccccaccttcaagagcttcgaggagaaggtggagaacctgaagagcaaggtgggcggcaccaagcccgccggcggcgacttcggcgaggtgctgaacagcgccgccaacgccagcgccaccaccaccgagcccctgcccgagaagacccaggagagcctgtag

SEQ ID NO: 12506 - DNA, 108 bp, Artificial Sequence
  Description of Artificial Sequence: Synthetic coding sequence
atgcagaccagcagcagcagaagcgtgcacctgagcgagtggcagaagaactacttcgccatcaccagcggcatctgcaccggccccaaggccgacgcctacagatag

SEQ ID NO: 12507 - DNA, 327 bp, Artificial Sequence
  Description of Artificial Sequence: Synthetic coding sequence
atgaccagaggcaaccagagagagctggccagacagaagaacatgaagaagcagagcgacagcgtgaagggcaagagaagagacgacggcctgagcgccgccgccagaaagcagagcgccatcaccagcagcagaaacttcctgtaccccgcctacgtgtacttccccagcagcgtgcccagcccccccagaaagtacacccagacctactacgccgccgtgcccgccggctggtggggcagcggcggcggccccgccacccagcccgccgccggcggcagatggagattcctgcacatcctgggcacccagccccagagccactag

SEQ ID NO: 12508 - DNA, 846 bp, Artificial Sequence
  Description of Artificial Sequence: Synthetic coding sequence
atgggcgccggcaacctgccccccatcacccaggaggaggccctgcacatcctgggcttccagccccccttcgaggacatcagattcggccccttcaccggcaacaccaccctgatgagatggttcagacagatcaacgaccacttccacgtgaagggctgcagctacgtgctgtacaagccccacggcaagaacaagaccgccggcgagaccgccagcggcgccctgagcaagctgaccagaggcctgaaggacgagagcctggcctacatctaccactgccagaaccactacttctgccccatcggcttcgaggccacccccgtgaaggccaacaaggccttcagcagaggccccctgagcccccaggaggtggagtactggatcctgatcggcgagagcagcagaaagcaccccgccatccactgcaagaagtgggccgacatcgtgaccgacctgaacacccagaaccccgagtacctggacatcagacacctggagagaggcctgcagtacagaaagaccaagaagcccaccttcttcagcagccaggtgggcggcaacctgcactgcatcatcgccttccagagactgaactggcagagattcggcctgtggaacttccccttcggcaccatcagacaggagagccagccccccacccacgcccagggcatcgccaagagcgagagcgaggacaacatcagcaagaagcagcacggcagactgggcagaagcttcagcgccagcttccaccaggacagcgcctggaagaagatgagcagcatccacgagagaagaaacagcggctaccagggctacagcgactacgacggcaacgactag

SEQ ID NO: 12509 - DNA, 213 bp, Artificial Sequence
  Description of Artificial Sequence: Synthetic coding sequence
atgagagccctgaccgtgcagagagtgaagttcgccatggacctgcccctgctgaagagagccggccaggacctggccgagaagaccaagaacttcgtgagcagaagcctggtgatcggcgaggtgctgagcatggccgacatggccaccggcgtgaagtgcggcatcatctactggctgttcggcggcgccatcagaaacctgggcagctag

SEQ ID NO: 12510 - DNA, 1644 bp, Artificial Sequence; identical to SEQ ID NO: 10555
  Description of Artificial Sequence: Synthetic coding sequence

SEQ ID NO: 12511 - DNA, 489 bp, Artificial Sequence
  Description of Artificial Sequence: Synthetic coding sequence
atgagctacaactgctgcagcagaaacttcagcagctgcagccacggcggctacctgcactaccccggcagcagctgcggcagcagctaccccagcaacctggtgtacagcaccgacctgtgcagccccagcacctgccagctgggcagcagcctgtacagaggctgccaggagacctgctggagacccaacagctgccagaccttctgctactaccccagaacccacatgctgtgcaacagctgcctgaccatgcacgtgggcagcagaggcttcggcagcaacagctgctgcagcctgagctgcggcagcagaagctgcagcagcctgggctgcggcagcaacggcttcagatacctgaactacagaatccacaccagccccagccagagctacagaagcagattctgccaccccatctacttcccccccagaagatggttccacagcagctgctaccagcccttctgcagaagcggcttctactag

SEQ ID NO: 12512 - DNA, 495 bp, Artificial Sequence
  Description of Artificial Sequence: Synthetic coding sequence
atgttcatcagcttctacgacttcaagaacatcccccaggacagcagatgcgacggccagctgttcatcaacggcagaaacaacaagaacaacagcatcagcctgtacttccagggcggcctgagacacgccagcgccagcatcggcggcagcgaggcctacagacacatgaagttcgagggcggcgtgcacagagtgcagagagtgcccaagaccgagaagcagggcagagtgcacaccagcaccatgaccgtggccatcctgccccagcccaccgagatcaacctggtgatcaaccccaaggacctgagaatcgacaccaagagagccagcggcgccggcggccagcacgtgaacaccaccgacagcgccgtgagaatcgtgcacctgcccaccggcgtggtgagcgagtgccagcaggagagaagccagctgaagaacaaggagctggccatgaccaagctgagagccaagctgtacagcatgcacctgtag

SEQ ID NO: 12513 - DNA, 2166 bp, Artificial Sequence
  Description of Artificial Sequence: Synthetic coding sequence
atggaggaggagctgaagtgccccgtgtgcggcagcctgttcagagagcccatcatcctgccctgcagccacaacgtgtgcctgccctgcgccagaaccatcgccgtgcagacccccgacggcggcagcgccgccggcggcctgggcggcggcgccggcggcggcggcgaccacgccgacaagctgagcctgtacagcgagaccgacagcggctacggcagctacacccccagcctgaagagccccaacggcgtgagagtgctgcccatggtgcccgccccccccggcagcagcgccgccgccgccagaggcgccgcctgcagcagcctgagcagcagcagcagcagcatcacctgcccccagtgccacagaagcgccagcctggaccacagaggcctgagaggcttccagagaaacagactgctggaggccatcgtgcagagataccagcagggcagaggcgccgtgcccggcaccagcgccgccgccgccgtggccatctgccagctgtgcgacagaaccccccccgagcccgccgccaccctgtgcgagcagtgcgacgtgctgtactgcagcgcctgccagctgaagtgccaccccagcagaggccccttcgccaagcacagactgggcgcccccagcggcggcggcggctgcaagagccccggcggcgccggcgccggcgccaccggcggcagcaccgccagaaagttccccacctgccccgagcacgagatggagaactacagcatgtactgcgtgagctgcagaacccccgtgtgctacctgtgcctggaggagggcagacacgccaagcacgaggtgaagcccctgggcgccatgtggaagcagcacaaggcccagctgagccaggccctgaacggcgtgagcgacaaggccaaggaggccaaggagttcctggtgcagctgaagaacatcctgcagcagatccaggagaacggcctggactacgaggcctgcctggtggcccagtgcgacgccctggtggacgccctgaccagacagaaggccaagctgctgaccaaggtgaccaaggagagagagcacaagctgaagatggtgtgggaccagatcaaccactgcaccctgaagctgagacagagcaccggcctgatggagtactgcctggaggtgatcaaggagaacgaccccagcggcttcctgcagatcagcgacgccctgatcaagagagtgcaggtgagccaggagcagtgggtgaagggcgccctggagcccaaggtgagcgccgagttcgacctgaccctggacagcgagcccctgctgcaggccatccaccagctggacttcatccagatgaagtgcagagtgccccccgtgcccctgctgcagctggagaagtgctgcaccagaaacaacagcgtgaccctggcctggagaatgccccccttcacccacagccccgtggacggctacatcctggagctggacgacggcgccggcggccagttcagagaggtgtacgtgggcaaggagaccctgtgcaccatcgacggcctgcacttcaacagcacctacaacgccagagtgaaggccttcaacagcagcggcgtgggcccctacagcaagaccgtggtgctgcagaccagcgacgtggcctggttcaccttcgaccccaacagcggccacagagacatcatcctgagcaacgacaaccagaccgccacctgcagcagctacgacgacagagtggtgctgggcaccgccgccttcagcaagggcgtgcactactgggagctgcacgtggacagatacgacaaccaccccgaccccgccttcggcgtggccagagccagcgtggtgaaggacatgatgctgggcaaggacgacaaggcctgggccatgtacgtggacaacaacagaagctggttcatgcactgcaacagccacaccaacagaaccgagggcggcgtgtgcaagggcgccaccgtgggcgtgctgctggacctgaacaagcacaccctgaccttcttcatcaacggccagcagcagggccccaccgccttcagccacgtggacggcgtgttcatgcccgccctgagcctgaacagaaacgtgcaggtgaccctgcacaccggcctggaggtgcccaccaacctgggcagacccaagctgagcggcaactag

SEQ ID NO: 12514 - DNA, 1479 bp, Artificial Sequence
  Description of Artificial Sequence: Synthetic coding sequence
atggacttcctgctgggcaaccccttcagcagccccgtgggccagagaatcgagaaggccaccgacggcagcctgcagagcgaggactgggccctgaacatggagatctgcgacatcatcaacgagaccgaggagggccccaaggacgccctgagagccgtgaagaagagaatcgtgggcaacaagaacttccacgaggtgatgctggccctgaccgtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacaccccccagagaaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggcatgaacctgggcagcagcagcgtgagagccggcctgcagagcctggaggccagcggcagactggaggacgagttcgacatgttcgccctgaccagaggcagcagcctggccgaccagagaaaggaggtgaagtacgaggccccccaggccaccgacggcctggccggcgccctggacgccagacagcagagcaccggcgccatccccgtgacccaggcctgcctgatggaggacatcgagcagtggctgagcaccgacgtgggcaacgacgccgaggagcccaagggcgtgaccagcgaggagttcgacaagttcctggaggagagagccaaggccgccgacagactgcccaacctgagcagccccagcgccgagggcccccccggcccccccagcggccccgcccccagaaagaagacccaggagaaggacgacgacatgctgttcgccctgtag

SEQ ID NO: 12515 - DNA, 747 bp, Artificial Sequence; identical to SEQ ID NO: 11765
  Description of Artificial Sequence: Synthetic coding sequence

SEQ ID NO: 12516 - DNA, 21 bp, Artificial Sequence
  Description of Artificial Sequence: Synthetic coding sequence
atgagcagaagaagattctag

SEQ ID NO: 12517 - DNA, 165 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagagcctggacgaggaggagaagctggagctgcagagaagactggaggcccagaaccaggagagaagatag

SEQ ID NO: 12518 - DNA, 1446 bp, Artificial Sequence; identical to SEQ ID NO: 12062
  Description of Artificial Sequence: Synthetic coding sequence

SEQ ID NO: 12519 - DNA, 312 bp, Artificial Sequence; identical to SEQ ID NO: 10772
  Description of Artificial Sequence: Synthetic coding sequence

SEQ ID NO: 12520 - DNA, 2919 bp, Artificial Sequence
  Description of Artificial Sequence: Synthetic coding sequence
atggagagaatgaactggctgagcagactggccagcagaggccccggccacagaatcccccagggcgccaacctgcagacccccgtgatggccgaccccgagacctgcctgatggtgttcaagaaccactggagccaggtggtgagaatcctggagagacagggccccagagccgcccccggcggcgccgacgacctgagcgccgtgagaaaccacacctaccagatgctgaccctgctggccgaggacagagccgtgcccagcgcccccaccggccccggccccctgctggagttcgccctgcacgaggacctgctgaccagagtgctgacctggcagctgcagtgggacgagctgggcgacggcgtggaggagagaagagccgagcagctgaagctgttcgagatgctggtgagcgaggccagacagcccctgctgagacacggccccgtgagagaggccctgctgaccctgctggacgcctgcggcagacccgtgcccagcagccccgccctggacgagggcctggtgctgctgctgagccagctgtgcgtgtgcgtggcccaggagcccagcctgctggagttcttcctgcagcccccccccgagcccggcgccgcccccagactgctgctgttcagcagactggtgcccttcgtgcacagagagggcaccctgggccagcaggccagagacgccctgctgctgctgatggccctgagcgccggcagccccaccgtgggcagatacatcgccgaccacagctacttctgccccgtgctggccaccggcctgagcgccctgtacagcagcctgcccagaaagatcgaggtgcccggcgacgactggcactgcctgagaagagaggactggctgggcgtgcccgccctggccctgttcatgagcagcctggagttctgcaacgccgtgatccaggtggcccaccccctggtgcagaagcagctggtggactacatccacaacggcttcctggtgcccgtgatgggccccgccctgcacaagaccagcgtggaggagatgatcgccagcaccgcctacctggagctgttcctgagaagcatcagcgagcccgccctgctgagaaccttcctgagattcctgctgctgcacagacacgacacccacaccatcctggacaccctggtggccagaatcggcagcaacagcagactgtgcatggtgagcctgagcctgttcagaaccctgctgaacctgagctgcgaggacgtgctgctgcagctggtgctgagatacctggtgccctgcaaccacgtgatgctgagccagaagcccgccgtgagagacgtggacctgtacggcagagccgccgacaagttcctgagcctgatccccagatgctgcagacaccacgcccccagcccccccagacccgagcacgccagctgggccagaggccccggcagccccagcgtggacagcagcagcgtgaccaccgtgcccagacccagcacccccagcagactggccctgttcctgagacagcagagcctgggcggcagcgagagccccggccccgccccctgcagccccggcctgagcgccagccccgccagcagccccggcagaagacccacccccgccgaggagcccggcgagctggaggacaactacctggagtacctgagagaggccagaagaggcgtggacagatgcgtgagagcctgcagaacctggagcgccccctacgacggcgagagacccagccccgagcccagccccttcggcagcagaaccaagaagagaagcctgctgcccgaggaggacagaaacaacgtgggcgagggcgaggaggaggagctgggcagaagaggcagagccggcggcgccggcgagggccccggccacctgccccccccccagctgaacggcgtgcccggcagctggcccgagggcgccaagaaggtgagactggtgcccaaggagggcgccggcgagctgctggagggcatcagcgagggcatggccggcctggagggcttcggccaggagctgagagagctggaggtggccctgagcaacggcggcaccggcagcgagagccccctggagccccccctgcccctggaggaggaggaggcctacgagagcttcacctgcccccccgagccccccggccccttcctgagcagccccctgagaaccctgaaccagctgcccagccagcccttcaccggccccttcatggccgtgctgttcgccaagctggagaacatgctgcagaacagcgtgtacgtgaacttcctgctgaccggcctggtggcccagctggcctgccacccccagcccctgctgagaagcttcctgctgaacaccaacatggtgttccagcccagcgtgaagagcctgctgcaggtgctgggcagcgtgaagaacaagatcgagaacttcgccgccagccaggaggacttccccgccctgctgagcaaggccaagaagtacctgatcgccagaggcaagctggactgggccgagggccccgccgccggccccgcccccagaagaagcgaccccctggtgaagagcagaagacccagcctgggcgagctgctgctgagacacgcccacagccccaccagagccagacaggccgcccagctggtgctgcagcccggcagagacggcgccggcctgggcctgagcggcggcagccccggcgccagcacccccgtgctgctgaccagaggcggcgcccccgagagacagggcgaggccctgagagtgaagaacgccgtgtactgcgccgtgatcttccccgagttcctgaaggagctggccgccatcagccaggcccacgccgtgaccagccccttcctgctggagaccagcgaggagggcagcggccccctgatcagcggctgcggccccctgaacccctag

SEQ ID NO: 12521 - DNA, 1929 bp, Artificial Sequence; identical to SEQ ID NO: 12350
  Description of Artificial Sequence: Synthetic coding sequence

SEQ ID NO: 12522 - DNA, 1935 bp, Artificial Sequence
  Description of Artificial Sequence: Synthetic coding sequence
atgagcgtgaccctgaccagcgtgaagagagtgcagagcagccccaacctgctggccgccggcagagacagccagagccccgacagcgcctggagaagctacaacgacggcaaccaggagaccctgaacggcgacgccacctacagcagcctggccgccaagggcttcagaagcgtgagacccaacctgcaggacaagagaagccccacccagagccagatcaccgtgaacggcaacagcggcggcgccgtgagccccatgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactaccccggcatcggccccgtggacgagagcggcatccccaccgccatcagaaccaccgtggacagacccaaggactggtacaagaccatgttcaagcagatccacatggtgcacaagcccggcctgtacaaccccccctacagcgcccagagccaccccgccgccaagacccagacctacagacccctgagcaagagccacagcgacaacagccccaacgccttcaaggacgccagcagccccgtgccccccccccacgtgcccccccccgtgccccccctgagacccagagacagaagcagcaccgagaagcacgactgggacccccccgacagaaaggtggacaccagaaagttcagaagcgagcccagaagcatcttcgagtacgagcccggcaagagcagcatcctgcagcacgagagacccgccagcctgtaccagagcagcatcgacagaagcctggagagacccatgagcagcgccagcatggccagcgacttcagaaagagaagaaagagcgagcccgccgtgggcccccccagaggcctgggcgaccagagcgccagcagaaccagccccggcagagtggacctgcccggcagcagcaccaccctgaccaagagcttcaccagcagcagccccagcagccccagcagagccaaggacagagagagccccagaagctacagcagcaccctgaccgacatgggcagaagcgcccccagagagagaagaggcacccccgagaaggagaagctgcccgccaaggccgtgtacgacttcaaggcccagaccagcaaggagctgagcttcaagaagggcgacaccgtgtacatcctgagaaagatcgaccagaactggtacgagggcgagcaccacggcagagtgggcatcttccccatcagctacgtggagaagctgaccccccccgagaaggcccagcccgccagaccccccccccccgcccagcccggcgagatcggcgaggccatcgccaagtacaacttcaacgccgacaccaacgtggagctgagcctgagaaagggcgacagagtgatcctgctgaagagagtggaccagaactggtacgagggcaagatccccggcaccaacagacagggcatcttccccgtgagctacgtggaggtggtgaagaagaacaccaagggcgccgaggactaccccgacccccccatcccccacagctacagcagcgacagaatccacagcctgagcagcaacaagccccagagacccgtgttcacccacgagaacatccagggcggcggcgagcccttccaggccctgtacaactacacccccagaaacgaggacgagctggagctgagagagagcgacgtgatcgacgtgatggagaagtgcgacgacggctggttcgtgggcaccagcagaagaaccaagttcttcggcaccttccccggcaactacgtgaagagactgtag

SEQ ID NO: 12523 - DNA, 294 bp, Artificial Sequence
  Description of Artificial Sequence: Synthetic coding sequence
atgggcaagagctgcaaggtggtggtgtgcggccaggccagcgtgggcaagaccagcatcctggagcagctgctgtacggcaaccacgtggtgggcagcgagatgatcgagacccaggaggacatctacgtgggcagcatcgagaccgacagaggcgtgagagagcagatcgccgagagcctgttcagcgtgtggagctgcagcagaagaagactgaccaaccccagaaccagaagaagaagccccagctggagcctggccaccagcgtgacctacagaagcagcggcgtgtag

SEQ ID NO: 12524 - DNA, 915 bp, Artificial Sequence
  Description of Artificial Sequence: Synthetic coding sequence
atgagcaagacccacgaccaccagctggagagcagcctgagccccgtggaggtgttcgccaagaccagcgccagcctggagatgaaccagggcgtgagcgaggagagaatccacctgggcagcagccccaagaagggcggcaactgcgacctgagccaccaggagagactgcagagcaagagcctgcacctgagcccccaggagcagagcgccagctaccaggacagaagacagagctggagaagagccagcatgaaggagaccaacagaagaaagagcctgcaccccatccaccagggcatcaccgagctgagcagaagcatcagcgtggacctggccgagagcaagagactgggctgcctgctgctgagcagcttccagttcagcatccagaagctggagcccttcctgagagacaccaagggcttcagcctggagagcttcagagccaaggccagcagcctgagcgaggagctgaagcacttcgccgacggcctggagaccgacggcaccctgcagaagtgcttcgaggacagcaacggcaaggccagcgacttcagcctggaggccagcgtggccgagatgaaggagtacatcaccaagttcagcctggagagacagacctgggaccagctgctgctgcactaccagcaggaggccaaggagatcctgagcagaggcagcaccgaggccaagatcaccgaggtgaaggtggagcccatgacctacctgggcagcagccagaacgaggtgctgaacaccaagcccgactaccagaagatcctgcagaaccagagcaaggtgttcgactgcatggagctggtgatggacgagctgcagggcagcgtgaagcagctgcaggccttcatggacgagagcacccagtgcttccagaaggtgagcgtgcagctgtag

SEQ ID NO: 12525 - DNA, 1842 bp, Artificial Sequence; identical to SEQ ID NO: 9548
  Description of Artificial Sequence: Synthetic coding sequence

SEQ ID NO: 12526 - DNA, 1560 bp, Artificial Sequence
  Description of Artificial Sequence: Synthetic coding sequence
atggagggcgtgctgtacaagtggaccaactacctgagcggctggcagcccagatggttcctgctgtgcggcggcatcctgagctactacgacagccccgaggacgcctggaagggctgcaagggcagcatccagatggccgtgtgcgagatccaggtgcacagcgtggacaacaccagaatggacctgatcatccccggcgagcagtacttctacctgaaggccagaagcgtggccgagagacagagatggctggtggccctgggcagcgccaaggcctgcctgaccgacagcagaacccagaaggagaaggagttcgccgagaacaccgagaacctgaagaccaagatgagcgagctgagactgtactgcgacctgctggtgcagcaggtggacaagaccaaggaggtgaccaccaccggcgtgagcaacagcgaggagggcatcgacgtgggcaccctgctgaagagcacctgcaacaccttcctgaagaccctggaggagtgcatgcagatcgccaacgccgccttcaccagcgagctgctgtacagaaccccccccggcagcccccagctggccatgctgaagagcagcaagatgaagcaccccatcatccccatccacaacagcctggagagacagatggagctgagcacctgcgagaacggcagcctgaacatggagatcaacggcgaggaggagatcctgatgaagaacaagaacagcctgtacctgaagagcgccgagatcgactgcagcatcagcagcgaggagaacaccgacgacaacatcaccgtgcagggcgagatcagaaaggaggacggcatggagaacctgaagaaccacgacaacaacctgacccagagcggcagcgacagcagctgcagccccgagtgcctgtgggaggagggcaaggaggtgatccccaccttcttcagcaccatgaacaccagcttcagcgacatcgagctgctggaggacagcggcatccccaccgaggccttcctggccagctgctacgccgtggtgcccgtgctggacaagctgggccccaccgtgttcgcccccgtgaagatggacctggtgggcaacatcaagaaggtgaaccagaagtacatcaccaacaaggaggagttcaccaccctgcagaagatcgtgctgcacgaggtggaggccgacgtggcccaggtgagaaacagcgccaccgaggccctgctgtggctgaagagaggcctgaagttcctgaagggcttcctgaccgaggtgaagaacggcgagaaggacatccagaccgccctgaacaacgcctacggcaagaccctgagacagcaccacggctgggtggtgagaggcgtgttcgccctggccctgagagccgcccccagctacgaggacttcgtggccgccctgaccgtgaaggagggcgaccaccagaaggaggccttcagcatcggcatgcagagagacctgagcctgtacctgcccgccatggagaagcagctggccatcctggacaccctgtacgaggtgcacggcctggagagcgacgaggtggtgtag

SEQ ID NO: 12527 - DNA, 1446 bp, Artificial Sequence; identical to SEQ ID NO: 12062
  Description of Artificial Sequence: Synthetic coding sequence

SEQ ID NO: 12528 - DNA, 1173 bp, Artificial Sequence
  Description of Artificial Sequence: Synthetic coding sequence
atgagcgccgccaaccccgagacccccaacagcaccatcagcagagaggccagcacccagagcagcagcgccgccgccagccagggctgggtgctgcccgagggcaagatcgtgcccaacaccgtgttcgtgggcggcatcgacgccagaatggacgagaccgagatcggcagctgcttcggcagatacggcagcgtgaaggaggtgaagatcatcaccaacagaaccggcgtgagcaagggctacggcttcgtgagcttcgtgaacgacgtggacgtgcagaagatcgtgggcagccagatccacttccacggcaagaagctgaagctgggccccgccatcagaaagcagaagctgtgcgccagacacgtgcagcccagacccctggtggtgaacccccccccccccccccagttccagaacgtgtggagaaaccccaacaccgagacctacctgcagccccagatcacccccaaccccgtgacccagcacgtgcaggcctacagcgcctacccccacagccccggccaggtgatcaccggctgccagctgctggtgtacaactaccaggagtaccccacctaccccgacagcgccttccaggtgaccaccggctaccagctgcccgtgtacaactaccagcccttccccgcctaccccagaagccccttccaggtgaccgccggctaccagctgcccgtgtacaactaccaggccttccccgcctaccccaacagccccttccaggtggccaccggctaccagttccccgtgtacaactaccagcccttccccgcctaccccagcagccccttccaggtgaccgccggctaccagctgcccgtgtacaactaccaggccttccccgcctaccccaacagccccttccaggtggccaccggctaccagttccccgtgtacaactaccaggccttccccgcctaccccaacagccccgtgcaggtgaccaccggctaccagctgcccgtgtacaactaccaggccttccccgcctaccccaacagcgccgtgcaggtgaccaccggctaccagttccacgtgtacaactaccagatgcccccccagtgccccgtgggcgagcagagaagaaacctgtggaccgaggcctacaagtggtggtacctggtgtgcctgatccagagaagagactag

SEQ ID NO: 12529 - DNA, 1143 bp, Artificial Sequence
  Description of Artificial Sequence: Synthetic coding sequence
atggagaagaagaagatggtgacccagggcaaccaggagcccaccaccacccccgacgccatggtgcagcccttcaccaccatccccttccccccccccccccagaacggcatccccaccgagtacggcgtgccccacacccaggactacgccggccagaccggcgagcacaacctgaccctgtacggcagcacccaggcccacggcgagcagagcagcaacagccccagcacccagaacggcagcctgaccaccgagggcggcgcccagaccgacggccagcagagccagacccagagcagcgagaacagcgagagcaagagcacccccaagagactgcacgtgagcaacatccccttcagattcagagaccccgacctgagacagatgttcggccagttcggcaagatcctggacgtggagatcatcttcaacgagagaggcagcaagggcttcggcttcgtgaccttcgagaacagcgccgacgccgacagagccagagagaagctgcacggcaccgtggtggagggcagaaagatcgaggtgaacaacgccaccgccagagtgatgaccaacaagaagatggtgaccccctacgccaacggctggaagctgagccccgtggtgggcgccgtgtacggccccgagctgtacgccgccagcagcttccaggccgacgtgagcctgggcaacgacgccgccgtgcccctgagcggcagaggcggcatcaacacctacatccccctgatcagcctgcccctggtgcccggcttcccctaccccaccgccgccaccaccgccgccgccttcagaggcgcccacctgagaggcagaggcagaaccgtgtacggcgccgtgagagccgtgccccccaccgccatccccgcctaccccggcgtggtgtaccaggacggcttctacggcgccgacctgtacggcggctacgccgcctacagatacgcccagcccgccaccgccaccgccgccaccgccgccgccgccgccgccgccgcctacagcgacggctacggcagagtgtacaccgccgacccctaccacgccctggcccccgccgccagctacggcgtgggcgccgtggccagcctgtacagaggcggctacagcagattcgccccctactag

SEQ ID NO: 12530 - DNA, 1614 bp, Artificial Sequence
  Description of Artificial Sequence: Synthetic coding sequence
atggaccccggcgacgccgccatcctggagagcagcctgagaatcctgtacagactgttcgagagcgtgctgccccccctgcccgccgccctgcagagcagaatgaacgtgatcgaccacgtgagagacatggccgccgccggcctgcacagcaacgtgagactgctgagcagcctgctgctgaccatgagcaacaacaaccccgagctgttcagccccccccagaagtaccagctgctggtgtaccacgccgacagcctgttccacgacaaggagtacagaaacgccgtgagcaagtacaccatggccctgcagcagaagaaggccctgagcaagaccagcaaggtgagacccagcaccggcaacagcgccagcaccccccagagccagtgcctgcccagcgagatcgaggtgaagtacaagatggccgagtgctacaccatgctgaagcaggacaaggacgccatcgccatcctggacggcatccccagcagacagagaacccccaagatcaacatgatgctggccaacctgtacaagaaggccggccaggagagacccagcgtgaccagctacaaggaggtgctgagacagtgccccctggccctggacgccatcctgggcctgctgagcctgagcgtgaagggcgccgaggtggccagcatgaccatgaacgtgatccagaccgtgcccaacctggactggctgagcgtgtggatcaaggcctacgccttcgtgcacaccggcgacaacagcagagccatcagcaccatctgcagcctggagaagaagagcctgctgagagacaacgtggacctgctgggcagcctggccgacctgtacttcagagccggcgacaacaagaacagcgtgctgaagttcgagcaggcccagatgctggacccctacctgatcaagggcatggacgtgtacggctacctgctggccagagagggcagactggaggacgtggagaacctgggctgcagactgttcaacatcagcgaccagcacgccgagccctgggtggtgagcggctgccacagcttctacagcaagagatacagcagagccctgtacctgggcgccaaggccatccagctgaacagcaacagcgtgcaggccctgctgctgaagggcgccgccctgagaaacatgggcagagtgcaggaggccatcatccacttcagagaggccatcagactggccccctgcagactggactgctacgagggcctgatcgagtgctacctggccagcaacagcatcagagaggccatggtgatggccaacaacgtgtacaagaccctgggcgccaacgcccagaccctgaccctgctggccaccgtgtgcctggaggaccccgtgacccaggagaaggccaagaccctgctggacaaggccctgacccagagacccgactacatcaaggccgtggtgaagaaggccgagctgctgagcagagagcagaagtacgaggacggcatcgccctgctgagaaacgccctggccaaccagagcgactgcgtgctgcacagaatcctgggcgacttcctggtggccgtgaacgagtaccaggaggccatggaccagtacagcatcgccctgagatag

SEQ ID NO: 12531 - DNA, 351 bp, Artificial Sequence
  Description of Artificial Sequence: Synthetic coding sequence
atggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagcccggcagagccggcagatag

SEQ ID NO: 12532 - DNA, 285 bp, Artificial Sequence
  Description of Artificial Sequence: Synthetic coding sequence
atgaccggcagcagaaactggagagccaccagagacatgtgcagatacagacacaactaccccgacctggtggagagagactgcaacggcgacacccccaacctgagcttctacagaaacgagatcagattcctgcccaacggctgcttcatcgaggacatcctgcagaactggaccgacaactacgacctgctggaggacaaccacagctacatccagtggctgttccccctgagagagcccggcgtgaactggcacgccaagcccctgaccctgagagagtag

SEQ ID NO: 12533 - DNA, 1029 bp, Artificial Sequence
  Description of Artificial Sequence: Synthetic coding sequence
atgagattctgggccccctggggcagcagaacccccagcggcagaagcctgtggaccgaccccgtgacctactacaccgccctgcacatcgccgtgctgagaaaccagcccgacatggtggagctgctggtgcaccacggcgccgacgtgaacagaagagacagaatccacgagagcagccccctggacctggccagcgaggagcccgagagactgccctgcctgcagagactgctggacctgggcgccgacgtgaacgccgccgacaagcacggcaagaccgccctgctgcacgccctggccagcagcgacggcgtgcagatccacaacaccgagaacatcagactgctgctggagggcggcgccgacgtgaaggccaccaccaaggacggcgacaccgtgttcacctgcatcatcttcctgctgggcgagaccgtgggcggcgacaaggaggaggcccagatgatcaacagattctgcttccaggtgaccagactgctgctggcccacggcgccgaccccagcgagtgccccgcccacgagagcctgacccacatctgcctgaagagcttcaagctgcacttccccctgctgagattcctgctggagagcggcgccgcctacaactgcagcctgcacggcgccagctgctggagcggcttccacatcatcttcgagagactgtgcagccaccccggctgcaccgaggacgagagccacgccgacctgctgagaaaggccgagaccgtgctggacctgatggtgaccaacagccagaagctgcagctgcccgagaacttcgacatccaccccgtgggcagcctggccgagaagatccaggccctgcacttcagcctgagacagctggagagctaccccccccccctgaagcacctgtgcagagtggccatcagactgtacctgcagccctggcccgtggacgtgaaggtgaaggccctgcccctgcccgacagactgaagtggtacctgctgagcgagcacagcggcagcgtggaggacgacatctag

SEQ ID NO: 12534 - DNA, 3192 bp, Artificial Sequence; identical to SEQ ID NO: 11218
  Description of Artificial Sequence: Synthetic coding sequence

SEQ ID NO: 12535 - DNA, 96 bp, Artificial Sequence
  Description of Artificial Sequence: Synthetic coding sequence
atgagcgacgaggtgttcagcaccaccctggcctacaccaagagccccaaggtgaccaagagaaccaccttccaggacgagctgatcagagcctag

SEQ ID NO: 12536 - DNA, 606 bp, Artificial Sequence
  Description of Artificial Sequence: Synthetic coding sequence
atgcccctgcagctgaagaaccccagactgagacagaagagcagaaccagatgcaacaagagccagaagaaggccgagctgctggacaacgagaagcccgccgccgtggtggcccccatcaccaccggctacaccgtgaagatcagcaactacggctgggaccagagcgacaagttcgtgaagatctacatcaccctgaccggcgtgcaccaggtgcccaccgagaacgtgcaggtgcacttcaccgagagaagcttcgacctgctggtgaagaacctgaacggcaagagctacagcatgatcgtgaacaacctgctgaagcccatcagcgtggagggcagcagcaagaaggtgaagaccgacaccgtgctgatcctgtgcagaaagaaggtggagaacaccagatgggactacctgacccaggtggagaaggagtgcaaggagaaggagaagcccagctacgacaccgagaccgaccccagcgagggcctgatgaacgtgctgaagaagatctacgaggacggcgacgacgacatgaagagaaccatcaacaaggcctgggtggagagcagagagaagcaggccaagggcgacaccgagttctag

SEQ ID NO: 12537 - DNA, 480 bp, Artificial Sequence; identical to SEQ ID NO: 11816
  Description of Artificial Sequence: Synthetic coding sequence

SEQ ID NO: 12538 - DNA, 4599 bp, Artificial Sequence
  Description of Artificial Sequence: Synthetic coding sequence
atgcagagagagctggtgtacgccagaggcgacggccccggcgcccccagacccggcagcaccgcccaccccccccacgccatccccaacagcccccccagcacccccgtgccccacagcatgccccccagccccagcagaatcccctacggcggcaccagaagcatggtggtgcccggcaacgccaccatccccagagacagaatcagcagcctgcccgtgagcagacccatcagccccagccccagcgccatcctggagagaagagacgtgaagcccgacgaggacatgagcggcaagaacatcgccatgtacagaaacgagggcttctacgccgacccctacctgtaccacgagggcagaatgagcatcgccagcagccacggcggccaccccctggacgtgcccgaccacatcatcgcctaccacagaaccgccatcagaagcgccagcgcctactgcaaccccagcatgcaggccgagatgcacatggagcagagcctgtacagacagaagagcagaaagtaccccgacagccacctgcccaccctgggcagcaagaccccccccgccagcccccacagagtgagcgacctgagaatgatcgacatgcacgcccactacaacgcccacggccccccccacaccatgcagcccgacagagccagccccagcagacaggccttcaagaaggagcccggcaccctggtgtacatcgagaagcccagaagcgccgccggcctgagcagcctggtggacctgggcccccccctgatggagaagcaggtgttcgcctacagcaccgccaccatccccaaggacagagagaccagcgagaagatgatgaagaccaccgccaacagaaaccacaccgacagcgccggcaccccccacgtgagcggcggcaagatgctgagcgccctggagagcaccgtgccccccagccagcccccccccgtgggcaccagcgccatccacatgagcctgctggagatgagaagaagcgtggccgagctgagactgcagctgcagcagatgagacagctgcagctgcagaaccaggagctgctgagagccatgatgaagaaggccgagctggagatcagcggcaaggtgatggagaccatgaagagactggaggaccccgtgcagagacagagagtgctggtggagcaggagagacagaagtacctgcacgaggaggagaagatcgtgaagaagctgtgcgagctggaggacttcgtggaggacctgaagaaggacagcaccgccgccagcagactggtgaccctgaaggacgtggaggacggcgccttcctgctgagacaggtgggcgaggccgtggccaccctgaagggcgagttccccaccctgcagaacaagatgagagccatcctgagaatcgaggtggaggccgtgagattcctgaaggaggagccccacaagctggacagcctgctgaagagagtgagaagcatgaccgacgtgctgaccatgctgagaagacacgtgaccgacggcctgctgaagggcaccgacgccgcccaggccgcccagtacatggccatggagaaggccaccgccgccgaggtgctgaagagccaggaggaggccgcccacaccagcggccagcccttccacagcaccggcgcccccggcgacgccaagagcgaggtggtgcccctgagcggcatgatggtgagacacgcccagagcagccccgtggtgatccagcccagccagcacagcgtggccctgctgaaccccgcccagaacctgccccacgtggccagcagccccgccgtgccccaggaggccaccagcaccctgcagatgagccaggccccccagagcccccagatccccatgaacggcagcgccatgcagagcctgttcatcgaggagatccacagcgtgagcgccaagaacagagccgtgagcatcgagaaggccgagaagaagtgggaggagaagagacagaacctggaccactacaacggcaaggagttcgagaagctgctggaggaggcccaggccaacatcatgaagagcatccccaacctggagatgccccccgccaccggccccctgcccagaggcgacgcccccgtggacaaggtggagctgagcgaggacagccccaacagcgagcaggacctggagaagctgggcggcaagagcccccccccccccccccccccccccagaagaagctacctgcccggcagcggcctgaccaccaccagaagcggcgacgtggtgtacaccggcagaaaggagaacatcaccgccaaggccagcagcgaggacgccggccccagcccccagaccagagccaccaagtaccccgccgaggagcccgccagcgcctggacccccagccccccccccgtgaccaccagcagcagcaaggacgaggaggaggaggaggaggagggcgacaagatcatggccgagctgcaggccttccagaagtgcagcttcatggacgtgaacagcaacagccacgccgagcccagcagagccgacagccacgtgaaggacaccagaagcggcgccaccgtgccccccaaggagaagaagaacctggagttcttccacgaggacgtgagaaagagcgacgtggagtacgagaacggcccccagatggagttccagaaggtgaccaccggcgccgtgagacccagcgacccccccaagtgggagagaggcatggagaacagcatcagcgacgccagcagaaccagcgagtacaagaccgagatcatcatgaaggagaacagcatcagcaacatgagcctgctgagagacagcagaaactacagccaggagaccgtgcccaaggccagcttcggcttcagcggcatcagccccctggaggacgagatcaacaagggcagcaagatcagcggcctgcagtacagcatccccgacaccgagaaccagaccctgaactacggcaagaccaaggagatggagaagcagaacaccgacaagtgccacgtgagcagccacaccagactgaccgagagcagcgtgcacgacttcaagaccgaggaccaggaggtgatcaccaccgacttcggccaggtggtgctgagacccaaggaggccagacacgccaacgtgaaccccaacgaggacggcgagagcagcagcagcagccccaccgaggagaacgccgccaccgacaacatcgccttcatgatcaccgagaccaccgtgcaggtgctgagcagcggcgaggtgcacgacatcgtgagccagaagggcgaggacatccagaccgtgaacatcgacgccagaaaggagatgacccccagacaggagggcaccgacaacgaggaccccgtggtgtgcctggacaagaagcccgtgatcatcatcttcgacgagcccatggacatcagaagcgcctacaagagactgagcaccatcttcgaggagtgcgacgaggagctggagagaatgatgatggaggagaagatcgaggaggaggaggaggaggagaacggcgacagcgtggtgcagaacaacaacaccagccagatgagccacaagaaggtggcccccggcaacctgagaaccggccagcaggtggagaccaagagccagccccacagcctggccaccgagaccagaaaccccggcggccaggagatgaacagaaccgagctgaacaagttcagccacgtggacagccccaacagcgagtgcaagggcgaggacgccaccgacgaccagttcgagagccccaagaagaagttcaagttcaagttccccaagaagcagctggccgccctgacccaggccatcagaaccggcaccaagaccggcaagaagaccctgcaggtggtggtgtacgaggaggaggaggaggacggcaccctgaagcagcacaaggaggccaagagattcgagatcgccagaagccagcccgaggacacccccaccagcatccccagcgccagcagaaagggcagcagcggcgccccccagaccagcagaatgcccgtgcccatgagcgccaagaacagacccggcaccctggacaagcccggcaagcagagcaagctgcaggaccccagacagtacagacaggccaacggcagcgccaagaagagcggcggcgacttcaagcccaccagccccagcctgcccgccagcaagatccccgccctgagccccagcagcggcaagagcagcagcctgcccagcagcagcggcgacagcagcaacctgcccaacccccccgccaccaagcccagcatcgccagcaaccccctgagcccccagaccggcccccccgcccacagcgccagcctgatccccagcgtgagcaacggcagcctgaagttccagagcctgacccacaccggcaagggccaccacctgagcttcagcccccagagccagaacggcagagcccccccccccctgagcttcagcagcagcccccccagccccgccagcagcgtgagcctgaaccagggcgccaagggcaccagaaccatccacacccccagcctgaccagctacaaggcccagaacggcagcagcagcaaggccacccccagcaccgccaaggagaccagctag

SEQ ID NO: 12539 - DNA, 1566 bp, Artificial Sequence
  Description of Artificial Sequence: Synthetic coding sequence
atgaccagcgccttcaagctggacttcctgcccgacatgatggtggagggcagactgctggtgcccgacagaatcaacggcaccgccaacaagatgaacggcgccctggaccacagcgaccagcccgaccccgacgccatcaagatgttcgtgggccagatccccagaagctggagcgagaaggagctgaaggagctgttcgagccctacggcgccgtgtaccagatcaacgtgctgagagacagaagccagaaccccccccagagcaagggctgctgcttcgtgaccttctacaccagaaaggccgccctggaggcccagaacgccctgcacaacatcaagaccctgcccggcatgcaccaccccatccagatgaagcccgccgacagcgagaagagcaacgccgtggaggacagaaagctgttcatcggcatggtgagcaagaagtgcaacgagaacgacatcagagtgatgttcagccccttcggccagatcgaggagtgcagaatcctgagaggccccgacggcctgagcagaggctgcgccttcgtgaccttcagcaccagagccatggcccagaacgccatcaaggccatgcaccagagccagaccatggagggctgcagcagccccatcgtggtgaagttcgccgacacccagaaggacaaggagcagagaagactgcagcagcagctggcccagcagatgcagcagctgaacaccgccacctggggcaacctgaccggcctgggcggcctgaccccccagtacctggccctgctgcagcaggccaccagcagcagcaacctgggcgccttcagcggcatccagcagatggccggcatgaacgccctgcagctgcagaacctggccaccctggccgccgccgccgccgccgcccagaccagcgccaccagcaccaacgccaaccccctgagcaccaccagcagcgccctgggcgccctgaccagccccgtggccgccagcacccccaacagcaccgccggcgccgccatgaacagcctgaccagcctgggcaccctgcagggcctggccggcgccaccgtgggcctgaacaacatcaacgccctggccgtggcccagatgctgagcggcatggccgccctgaacggcggcctgggcgccaccggcctgaccaacggcaccgccggcaccatggacgccctgacccaggcctacagcggcatccagcagtacgccgccgccgccctgcccaccctgtacagccagagcctgctgcagcagcagagcgccgccggcagccagaaggagggccccgagggcgccaacctgttcatctaccacctgccccaggagttcggcgaccaggacatcctgcagatgttcatgcccttcggcaacgtgatcagcgccaaggtgttcatcgacaagcagaccaacctgagcaagtgcttcggcttcgtgagctacgacaaccccgtgagcgcccaggccgccatccaggccatgaacggcttccagatcggcatgaagagactgaaggtgcagctgaagagaagcaagaacgacagcaagccctactag

SEQ ID NO: 12540 - DNA, 315 bp, Artificial Sequence
  Description of Artificial Sequence: Synthetic coding sequence
atgagcgagcagggcgacctgaaccaggccatcgccgaggagggcggcaccgagcaggagaccgccacccccgagaacggcatcgtgaagagcgagagcctggacgaggaggagaagctggagctgcagagaagactggaggcccagaaccaggagagaagaaagagcaagagcggcgccggcaagggcaagctgaccagaagcctggccgtgtgcgaggagagcagcgccagacccggcggcgagagcctgcaggaccaggagagcatccacctgcagctgagcagcttcagcagcctgcaggaggaggactag

SEQ ID NO: 12541 - DNA, 1653 bp, Artificial Sequence
  Description of Artificial Sequence: Synthetic coding sequence
atggagcccccccaggagaccaacagacccttcagcaccctggacaacagaagcggccaggtgcaggtgctgagcgccacccccctgctgcagagaaacccctacagcagccccgacatcatgcacatcaagggcagcgaggccagcagcgtgccctacgccctgaaccagggcaccaccgccctgcccaagaacaagaaccaggagggcaccggccacagactgctgaacatgctgagaaagaccctgaaggagagcgacagcgaggagctggagatcacccaggagacccccaacctggtgcccttcggcgacgtggtgggctgcctgggcatccacatcaagaactgcagacacttcatgcccaagatcagcctgcagcactacgccaacctgttcatcagaatcagcatcaacaaggccgtgaagtgcaccaagatgtgcagcctgctgagcaagaacgacgagaagaacaccgtgatcaagttcgacgaggtgaagtacttcagcgtgcaggtgcccagaagatacgacgacaagagaaacaacatcctgctggagctgatccagtacgacaacagagagaagagagccttcctgctgggcagcgtgcagatccacctgtacgaggtgatccagaagggctgcttcatcgaggaggtgcaggtgctgcacggcaacatcttcgtgtgcagactggaggtggagttcatgttcagctacggcaacttcggctacggcttcagccaccagctgaagcccctgcagaagatcaccgagcccagcatgttcatgaacctggcccccccccccgagagaaccgaccccgtgaccaaggtgatcaccccccagaccgtggagtaccccgccttcctgagccccgacctgaacgtgaccgtgggcacccccgccgtgcagagcagcaaccagcccagcgtggtgagactggagaagctgcagcagcagcccagagagagactggagaagatgaagaaggagtacagaaacctgaacacctggatcgacaaggccaactacctggagagcatcctgatgcccaagctggagcacaaggacagcgaggagaccaacatcgacgaggccagcgagaacaccaagagcaaccaccccgaggaggagctggagaacatcgtgggcgtggacatccccctggtgaacgaggaggccgagaccaccgccaacgagctgctggacaacgacagcgagaagggcctgaccatccccaccctgaaccagagcgaccaggacaacagcaccgccgacgccagcaagaacgacgagagcacccccagccccaccgaggtgcacagcctgtgcaccatcagcaaccaggagaccatcaaggccggcagaatcccccccctgggcgagagacagagcgagagcatgcccgacagaaagatgaagaacgtgttcttccccctggaggtgaagctgaaggacaactaccccagcatcctgaaggccgacagcagcctgagcgaggtgaacctgagaagcatctgcatcaaccccaagagcagaaacctggacagcagccccaccgagatcagctggcagaacaacaacctgaacctggccgagagagagaacaccggcctggtgagcaccagactgaagatcaagagatag

SEQ ID NO: 12542 - DNA, 363 bp, Artificial Sequence
  Description of Artificial Sequence: Synthetic coding sequence
atgagcatcagcagcgacgaggtgaacttcctggtgtacagatacctgcaggagagcggcttcagccacagcgccttcaccttcggcatcgagagccacatcagccagagcaacatcaacggcgccctggtgccccccgccgccctgatcagcatcatccagaagggcctgcagtacgtggaggccgaggtgagcatcaacgaggacggcaccctgttcgacggcagacccatcgagagcctgagcctgatcgacgccgtgatgcccgacgtggtgcagaccagacagcaggcctacagagacaagctggcccagcagcaggccgccgccgccgccgccgccgccgccgccgccagccagtag

SEQ ID NO: 12543 - DNA, 222 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgaggaggagaagagagtgaccgtgatcaaggccccccactacccctag

SEQ ID NO: 12544 - DNA, 717 bp, Artificial Sequence
  Description of Artificial Sequence: Synthetic coding sequence
atgaccgaggacagccagagaaacttcagaagcgtgtactacgagaaggtgggcttcagaggcgtggaggagaagaagagcctggagatcctgctgaaggacgacagactgggcatcctgcccccccaccacgagagccacgccaaggtgatgatgtacagaaaggagcagtacctggacgtgctgcacgccctgaaggtggtgagattcgtgagcgacgccaccccccaggccgaggtgtacctgagaatgtaccagctggagagcggcaagctgcccagaagccccagcttccccctggagcccgacgacgaggtgttcctggccatcgccaaggccatggaggagatggtggaggacagcgtggactgctactggatcaccagaagattcgtgaaccagctgaacaccaagtacagagacagcctgccccagctgcccaaggccttcgagcagtacctgaacctggaggacggcagactgctgacccacctgagaatgtgcagcgccgcccccaagctgccctacgacctgtggttcaagagatgcttcgccggctgcctgcccgagagcagcctgcagagagtgtgggacaaggtggtgagcggcagctgcaagatcctggtgttcgtggccgtggagatcctgctgaccttcaagatcaaggtgatggccctgaacagcgccgagaagatcaccaagttcctggagaactag

SEQ ID NO: 12545 - DNA, 1620 bp, Artificial Sequence; identical to SEQ ID NO: 10018
  Description of Artificial Sequence: Synthetic coding sequence

SEQ ID NO: 12546 - DNA, 609 bp, Artificial Sequence
  Description of Artificial Sequence: Synthetic coding sequence
atgggccagaaggtgaccggcggcatcaagaccgtggacatgagagaccccacctacagacccctgaagcaggagctgcagggcctggactactgcaagcccaccagactggacctgctgctggacatgccccccgtgagctacgacgtgcagctgctgcacagctggaacaacaacgacagaagcctgaacgtgttcgtgaaggaggacgacaagctgatcttccacagacaccccgtggcccagagcaccgacgccatcagaggcaaggtgggctacaccagaggcctgcacgtgtggcagatcacctgggccatgagacagagaggcacccacgccgtggtgggcgtggccaccgccgacgcccccctgcacagcgtgggctacaccaccctggtgggcaacaaccacgagagctggggctgggacctgggcagaaacagactgtaccacgacggcaagaaccagcccagcaagacctaccccgccttcctggagcccgacgagaccttcatcgtgcccgacagcttcctggtggccctggacatggacgacggcaccctgagcttcatcgtggacggccagtacatgggcgtggccttcagatag

SEQ ID NO: 12547 - DNA, 174 bp, Artificial Sequence
  Description of Artificial Sequence: Synthetic coding sequence
aacctgcccatctgcatggccaagacccacctgagcctgagccaccagcccgacaagaagggcgtgcccagagacttcatcctgcccatcagcgacgtgagagccagcatcggcgccggcttcatctaccccctggtgggcaccggcggcagagaggcccccctgtggctgtag

SEQ ID NO: 12548 - DNA, 468 bp, Artificial Sequence
  Description of Artificial Sequence: Synthetic coding sequence
atgaacaaccagaagcagcagaagcccaccctgagcggccagagattcaagaccagaaagagagacgagaaggagagattcgaccccacccagttccaggactgcatcatccagggcctgaccgagaccggcaccgacctggaggccgtggccaagttcctggacgccagcggcgccaagctggactacagaagatacgccgagaccctgttcgacatcctggtggccggcggcatgctggcccccggcggcaccctggccgacgacatgatgagaaccgacgtgtgcgtgttcgccgcccaggaggacctggagaccatgcaggccttcgcccaggtgttcaacaagctgatcagaagatacaagtacctggagaagggcttcgaggacgaggtgaagaagctgctgctgttcctgaagggcttcagcgagagcgagagaaacaagctggccatgctgaccggctag

SEQ ID NO: 12549 - DNA, 528 bp, Artificial Sequence
  Description of Artificial Sequence: Synthetic coding sequence
tgattcgacgaccagagaagaatgagcctgcacctgcacggcgccgactgcgaccccaagacccagaacgagatgaacatctgcgaggaggagttcgtggagtacaagaacagagacgccatcagcgccctgatgcccctgttcagcgaggaggagagcagcgacggcagcaagcacaacaacggcctgcccgaccacatcagcgcccagctgcagaacacctacaccctgaaggccttcaccgtgggcagcaagtgcgtggtgtggagcagcctgagaaacacctggagcaagtgcgagatcctggagaccgccgaggagggcaccagagtgctgaacctgagcaacggcatggaggagatcgtgaaccccgagaacgtgtggaacggcatccccaagctggacaagagcccccccgaggccgtgagccagagagtgggcaaggacctgtacttcatgagcgtgggcgacaccaccatcaaggagaagggcttcggcggcgacggcgacctgaccgtggacctgtag

SEQ ID NO: 12550 - DNA, 2814 bp, Artificial Sequence
  Description of Artificial Sequence: Synthetic coding sequence
tgactgagaagccagcccggctgcggctgcctgtggcaggaggcccccacccacagcaccggccccagcgtggagggcgaggcccccagcagcgagaccggcaccagcctggacagccccagcgcctacccccagggccccctggtgcccggcagcagcctgagccccgaccactacgagcacaccagcgtgggcgcctacggcctgtacagcggcccccccggccagcagcagagaaccagaagacccaagctgcagcacagcaccagcatcctgagaaagcaggccgaggaggaggccatcaagagaagcagaagcctgagcgagagctacgagctgagcagcgacctgcaggacaagcaggtggagatgctggagagaaagtacggcggcagactggtgaccagacacgccgccagaaccatccagaccgccttcagacagtaccagatgaacaagaacttcgagagactgagaagcagcatgagcgagaacagaatgagcagaagaatcgtgctgagcaacatgagaatgcagttcagcttcgagggccccgagaaggtgcacagcagctacttcgagggcaagcaggtgagcgtgaccaacgacggcagccagctgggcgccctggtgagccccgagtgcggcgacctgagcgagcccaccaccctgaagagccccgcccccagcagcgacttcgccgacgccatcaccgagctggaggacgccttcagcagacaggtgaagagcctggccgagagcatcgacgacgccctgaactgcagaagcctgcacaccgaggaggcccccgccctggacgccgccagagccagagacaccgagccccagaccgccctgcacggcatggaccacagaaagctggacgagatgaccgccagctacagcgacgtgaccctgtacatcgacgaggaggagctgagcccccccctgcccctgagccaggccggcgacagacccagcagcaccgagagcgacctgagactgagagccggcggcgccgcccccgactactgggccctggcccacaaggaggacaaggccgacaccgacaccagctgcagaagcacccccagcctggagagacaggagcagagactgagagtggagcacctgcccctgctgaccatcgagccccccagcgacagcagcgtggacctgagcgacagaagcgagagaggcagcctgaagagacagagcgcctacgagagaagcctgggcggccagcagggcagccccaagcacggcccccacagcggcgcccccaagagcctgcccagagaggagcccgagctgagacccagaccccccagacccctggacagccacctggccatcaacggcagcgccaacagacagagcaagagcgagagcgactacagcgacggcgacaacgacagcatcaacagcaccagcaacagcaacgacaccatcaactgcagcagcgagagcagcagcagagacagcctgagagagcagaccctgagcaagcagacctaccacaaggaggccagaaacagctgggacagccccgccttcagcaacgacgtgatcagaaagagacactacagaatcggcctgaacctgttcaacaagaagcccgagaagggcgtgcagtacctgatcgagagaggcttcgtgcccgacacccccgtgggcgtggcccacttcctgctgcagagaaagggcctgagcagacagatgatcggcgagttcctgggcaacagacagaagcagttcaacagagacgtgctggactgcgtggtggacgagatggacttcagcaccatggagctggacgaggccctgagaaagttccaggcccacatcagagtgcagggcgaggcccagaaggtggagagactgatcgaggccttcagccagagatactgcatctgcaaccccggcgtggtgagacagttcagaaaccccgacaccatcttcatcctggccttcgccatcatcctgctgaacaccgacatgtacagccccaacgtgaagcccgagagaaagatgaagctggaggacttcatcaagaacctgagaggcgtggacgacggcgaggacatccccagagagatgctgatgggcatctacgagagaatcagaaagagagagctgaagaccaacgaggaccacgtgagccaggtgcagaaggtggagaagctgatcgtgggcaagaagcccatcggcagcctgcaccccggcctgggctgcgtgctgagcctgccccacagaagactggtgtgctactgcagactgttcgaggtgcccgaccccaacaagccccagaagctgggcctgcaccagagagagatcttcctgttcaacgacctgctggtggtgaccaagatcttccagaagaagaagaacagcgtgacctacagcttcagacagagcttcagcctgtacggcatgcaggtgctgctgttcgagaaccagtactaccccaacggcatcagactgaccagcagcgtgcccggcgccgacatcaaggtgctgatcaacttcaacgcccccaacccccaggacagaaagaagttcaccgacgacctgagagagagcatcgccgaggtgcaggagatggagaagcacagaatcgagagcgagctggagaagcagaagggcgtggtgagacccagcatgagccagtgcagcagcctgaagaaggagagcggcaacggcaccctgagcagagcctgcctggacgacagctacgccagcggcgagggcctgaagagaagcgccctgagcagcagcctgagagacctgagcgaggccggcgtgcaccactag

SEQ ID NO: 12551 - DNA, 198 bp, Artificial Sequence
  Description of Artificial Sequence: Synthetic coding sequence
atggtggaggccgccgacagagagaaggtggagctgctgaaccagctggaggaggagaagagaaaggtggaggacctgcagttcagagtggaggaggagagcatcaccaagggcgacctggagcagaagagccagatcagcgaggaccccgagaacgtggccaccgtgagcgagaagagcagaatcatggagctgtag

SEQ ID NO: 12552 - DNA, 630 bp, Artificial Sequence
  Description of Artificial Sequence: Synthetic coding sequence
atggacttcctgctgggcaaccccttcagcagccccgtgggccagagaatcgagaaggccaccgacggcagcctgcagagcgaggactgggccctgaacatggagatctgcgacatcatcaacgagaccgaggagggccccaaggacgccctgagagccgtgaagaagagaatcgtgggcaacaagaacttccacgaggtgatgctggccctgaccgtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacacccccagaggcccctgcagcacccagagacacaaccaggacagaatcctgtgggccctgacccccgccagcaagagaaccctggccagcatgctgcccctgtgcccccccagaccctacagccccgtgaccagaccctag

SEQ ID NO: 12553 - DNA, 255 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgccggcaaccccctggtgcagcagggcggccagcccctgatcctgacccagaaccccgcccccggcctgggcaccatggtgacccagcccgtgctgagacccgtgcaggtgatgcagaacgccaaccactag

SEQ ID NO: 12554 - DNA, 618 bp, Artificial Sequence
  Description of Artificial Sequence: Synthetic coding sequence
atggccacccccctgggctggagcaaggccggcagcggcagcgtgtgcctggccctggaccagctgagagacgtgatcgagagccaggaggagctgatccaccagctgagaaacgtgatggtgctgcaggacgagaacttcgtgagcaaggaggagttccaggccgtggagaagaagctggtggaggagaaggccgcccacgccaagaccaaggtgctgctggccaaggaggaggagaagctgcagttcgccctgggcgaggtggaggtgctgagcaagcagctggagaaggagaagctggccttcgagaaggccctgagcagcgtgaagagcaaggtgctgcaggagagcagcaagaaggaccagctgatcaccaagtgcaacgagatcgagagccacatcatcaagcaggaggacatcctgaacggcaaggagaacgagatcaaggagctgcagcaggtgatcagccagcagaagcagatcttcagaaaccacatgagcgacttcagaatccagaagcagcaggagagctacatggcccaggtgctggaccagaagcacaagaaggccagcggcaccagacaggccagaagccaccagcaccccagagagaagtag

SEQ ID NO: 12555 - DNA, 330 bp, Artificial Sequence
  Description of Artificial Sequence: Synthetic coding sequence
atggagcccagcgcccagcagctgcagctggccgccagcctgcccgccaacctgagcaacttctgccagggcagcgagatgcccaccaccagcagacccgccctggacgtgaagggcggcaccagccccgccaaggaggacgccaaccaggagatgagcagcgtggcctacagcaacctggccgtgaaggacagaaaggccgtggccatcctgcactaccccggcgtggccagcaacggcaccaaggccagcggcgcccccaccagcagcagcggcagccccatcggcagccccaccaccaccccccccaccaagccccccagcttctag

SEQ ID NO: 12556 - DNA, 1737 bp, Artificial Sequence
  Description of Artificial Sequence: Synthetic coding sequence
atgcccgagatcagagtgacccccctgggcgccggccaggacgtgggcagaagctgcatcctggtgagcatcgccggcaagaacgtgatgctggactgcggcatgcacatgggcttcaacgacgacagaagattccccgacttcagctacatcacccagaacggcagactgaccgacttcctggactgcgtgatcatcagccacttccacctggaccactgcggcgccctgccctacttcagcgagatggtgggctacgacggccccatctacatgacccaccccacccaggccatctgccccatcctgctggaggactacagaaagatcgccgtggacaagaagggcgaggccaacttcttcaccagccagatgatcaaggactgcatgaagaaggtggtggccgtgcacctgcaccagaccgtgcagatcaaggtgggcagcgagagcgtggtgtacaccggcgactacaacatgacccccgacagacacctgggcgccgcctggatcgacaagtgcagacccaacctgctgatcaccgagagcacctacgccaccaccatcagagacagcaagagatgcagagagagagacttcctgaagaaggtgcacgagaccgtggagagaggcggcaaggtgctgatccccgtgttcgccctgggcagagcccaggagctgtgcatcctgctggagaccttctgggagagaatgaacctgaaggtgcccatctacttcagcaccggcctgaccgagaaggccaaccactactacaagctgttcatcccctggaccaaccagaagatcagaaagaccttcgtgcagagaaacatgttcgagttcaagcacatcaaggccttcgacagagccttcgccgacaaccccggccccatggtggtgttcgccacccccggcatgctgcacgccggccagagcctgcagatcttcagaaagtgggccggcaacgagaagaacatggtgatcatgcccggctactgcgtgcagggcaccgtgggccacaagatcctgagcggccagagaaagctggagatggagggcagacaggtgctggaggtgaagatgcaggtggagtacatgagcttcagcgcccacgccgacgccaagggcatcatgcagctggtgggccaggccgagcccgagagcgtgctgctggtgcacggcgaggccaagaagatggagttcctgaagcagaagatcgagcaggagctgagagtgaactgctacatgcccgccaacggcgagaccgtgaccctgcccaccagccccagcatccccgtgggcatcagcctgggcctgctgaagagagagatggcccagggcctgctgcccgaggccaagaagcccagactgctgcacggcaccctgatcatgaaggacagcaacttcagactggtgagcagcgagcaggccctgaaggagctgggcctggccgagcaccagctgagattcacctgcagagtgcacctgcacgacaccagaaaggagcaggagaccgccctgagagtgtacagccacctgaagagcgtgctgaaggaccactgcgtgcagcacctgcccgacggcagcgtgaccgtggagagcgtgctgctgcaggccgccgcccccagcgaggaccccggcaccaaggtgctgctggtgagctggacctaccaggacgaggagctgggcagcttcctgaccagcctgctgaagaagggcctgccccaggcccccagctag

SEQ ID NO: 12557 - DNA, 570 bp, Artificial Sequence
  Description of Artificial Sequence: Synthetic coding sequence
atgcagcccatgagcttcggctgggaccacagcctgcacaagagaaagagactgccccccgtgaagagaagcctggtgtactacctgaagaacagagaggtgagactgcagaacgagaccagctacagcagagtgctgcacggctacgccgcccagcagctgcccagcctgctgaaggagagagagttccacctgggcaccctgaacaaggtgttcgccagccagtggctgaaccacagacaggtggtgtgcggcaccaagtgcaacaccctgttcgtggtggacgtgcagaccagccagatcaccaagatccccatcctgaaggacagagagcccggcggcgtgacccagcagggctgcggcatccacgccatcgagctgaaccccagcagaaccctgctggccaccggcggcgacaaccccaacagcctggccatctacagactgcccaccctggaccccgtgtgcgtgggcgacgacggccacaaggactggatcttcagcatcgcctggatcagcgacaccatggccgtgagcggcagcagagacggcagcatgggcctgtggtag

SEQ ID NO: 12558 - DNA, 2289 bp, Artificial Sequence; identical to SEQ ID NO: 11859
  Description of Artificial Sequence: Synthetic coding sequence

SEQ ID NO: 12559 - DNA, 1362 bp, Artificial Sequence
  Description of Artificial Sequence: Synthetic coding sequence
atggccggcgccgccggcagagtgcaggacagagccctgagaagattccccatcaccctgcccgtgggcgacctgagcaacctgcacctgaaggaggagaagatcaagcccgacaccaacggcgccgtggtgaagaccaacgccaacgccgagaagaccgacgaggaggagaaggaggacagagccgcccagagcctgctgaacaagctgatcagaagcaacctggtggacaacaccaaccaggtggaggtgctgcagagagaccccaacagccccctgtacagcgtgaagagcttcgaggagctgagactgccccagaacctgatcgcccagagccagagcggcaccggcaagaccgccgccttcgtgctggccatgctgagccaggtggagcccgccaacaagtacccccagtgcctgtgcctgagccccacctacgagctggccctgcagaccggcaaggtgatcgagcagatgggcaagttctaccccgagctgaagctggcctacgccgtgagaggcaacaagctggagagaggccagaagatcagcgagcagatcgtgatcggcacccccggcaccgtgctggactggtgcagcaagctgaagttcatcgaccccaagaagatcaaggtgttcgtgctggacgaggccgacgtgatgatcgccacccagggccaccaggaccagagcatcagaatccagagaatgctgcccagaaactgccagatgctgctgttcagcgccaccttcgaggacagcgtgtggaagttcgcccagaaggtggtgcccgaccccaacgtgatcaagctgaagagagaggaggagaccctggacaccatcaagcagtactacgtgctgtgcagcagcagagacgagaagttccaggccctgtgcaacctgtacggcgccatcaccatcgcccaggccatgatcttctgccacaccagaaagaccgccagctggctggccgccgagctgagcaaggagggccaccaggtggccctgctgagcggcgagatgatggtggagcagagagccgccgtgatcgagagattcagagagggcaaggagaaggtgctggtgaccaccaacgtgtgcgccagaggcatcgacgtggagcaggtgagcgtggtgatcaacttcgacctgcccgtggacaaggacggcaaccccgacaacgagacctacctgcacagaatcggcagaaccggcagattcggcaagagaggcctggccgtgaacatggtggacagcaagcacagcatgaacatcctgaacagaatccaggagcacttcaacaagaagatcgagagactggacaccgacgacctggacgagatcgagaagatcgccaactag

SEQ ID NO: 12560 - DNA, 921 bp, Artificial Sequence
  Description of Artificial Sequence: Synthetic coding sequence
atggccagagtgcccctgggcagaagcctgaccctgagccccagactggagcacaacggcatgaccagcgcccaccacaacttcagactgcccggcagcagagacagccccgccagcgccagccaggtggccgagatcatcgacctggagtggtacgagaagagcgaggagacccacgccagccagatcgagctgctggagaccagcagcacccaggagcccctgaacgccagcgaggccttctgccccagagactgcatggtgcccgtggtgttccccggccccgtgagccaggagggctgctgccagttcacctgcgagctgctgaagcacatcatgtaccagagacagcagctgcccctgccctacgagcagctgaagcacttctacagaaagcccagcccccaggccgaggagatgctgaagaagaagcccagagccaccaccgaggtgagcagcagaaagtgccagcaggccctggccgagctggagagcgtgctgagccacctggaggacttcttcgccagaaccctggtgcccagagtgctgatcctgctgggcggcaacgccctgagccccaaggagttctacgagctggacctgagcctgctggccccctacagcgtggaccagagcctgagcaccgccgcctgcctgagaagactgttcagagccatcttcatggccgacgccttcagcgagctgcaggccccccccctgatgggcaccgtggtgatggcccagggccacagaaactgcggcgaggactggttcagacccaagctgaactacagagtgcccagcagaggccacaagctgaccgtgaccctgagctgcggcagacccagcatcagaaccaccgcctgggaggactacatctggttccaggcccccgtgaccttcaagggcttcagagagtag

SEQ ID NO: 12561 - DNA, 426 bp, Artificial Sequence
  Description of Artificial Sequence: Synthetic coding sequence
atgccccagctgctgcagaacatcaacggcatcatcgaggccttcagaagatacgccagaaccgagggcaactgcaccgccctgaccagaggcgagctgaagagactgctggagcaggagttcgccgacgtgatcgtgaagccccacgaccccgccaccgtggacgaggtgctgagactgctggacgaggaccacaccggcaccgtggagttcaaggagttcctggtgctggtgttcaaggtggcccaggcctgcttcaagaccctgagcgagagcgccgagggcgcctgcggcagccaggagagcggcagcctgcacagcggcgccagccaggagctgggcttcagacccagagtgagacccctggccctgagaggcagcgccgccatgaccggcaagctgagccccagagccagaaaggagtag

SEQ ID NO: 12562 - DNA, 480 bp, Artificial Sequence; identical to SEQ ID NO: 11816
  Description of Artificial Sequence: Synthetic coding sequence

SEQ ID NO: 12563 - DNA, 1506 bp, Artificial Sequence
  Description of Artificial Sequence: Synthetic coding sequence
atggacttcctgctgggcaaccccttcagcagccccgtgggccagagaatcgagaaggccaccgacggcagcctgcagagcgaggactgggccctgaacatggagatctgcgacatcatcaacgagaccgaggagggccccaaggacgccctgagagccgtgaagaagagaatcgtgggcaacaagaacttccacgaggtgatgctggcccacagcgccagaagacacctgagcgccctgcaggtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacaccccccagagaaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggcatgaacctgggcagcagcagcgtgagagccggcctgcagagcctggaggccagcggcagactggaggacgagttcgacatgttcgccctgaccagaggcagcagcctggccgaccagagaaaggaggtgaagtacgaggccccccaggccaccgacggcctggccggcgccctggacgccagacagcagagcaccggcgccatccccgtgacccaggcctgcctgatggaggacatcgagcagtggctgagcaccgacgtgggcaacgacgccgaggagcccaagggcgtgaccagcgaggagttcgacaagttcctggaggagagagccaaggccgccgacagactgcccaacctgagcagccccagcgccgagggcccccccggcccccccagcggccccgcccccagaaagaagacccaggagaaggacgacgacatgctgttcgccctgtag

SEQ ID NO: 12564 - DNA, 117 bp, Artificial Sequence
  Description of Artificial Sequence: Synthetic coding sequence
gagcccgtgtacttcgccgagaaggtgatgagcctgggcagaaactggcacagaccctgcctgagatgccagagatgccacaagaccctgaccgccggcagccacgccgaggtgtag

SEQ ID NO: 12565 - DNA, 1122 bp, Artificial Sequence; identical to SEQ ID NO: 10359
  Description of Artificial Sequence: Synthetic coding sequence

SEQ ID NO: 12566 - DNA, 453 bp, Artificial Sequence
  Description of Artificial Sequence: Synthetic coding sequence
atgcacaccggcgaccccaagcaggacctggcctacgagagacagtacgagcagcagacctaccaggtgatccccgaggtgatcaagaacttcatccagtacttccacaagaccgtgagcgacctgatcgaccagaaggtgtacgagctgcaggccagcagagtgagcagcgacgtgatcgaccagaaggtgtacgagatccaggacatctacgagaacagctggaccaagctgaccgagagattcttcaagaacaccccctggcccgaggccgaggccatcgccccccaggtgggcaacgacgccgtgttcctgatcctgtacaaggagctgtactacagacacatctacgccaaggtgagcggcggccccagcctggagcagagattcgagagctactacaactactgcaacctgttcaactacatcctgaacgccgacggccccgcctag

SEQ ID NO: 12567 - DNA, 2136 bp, Artificial Sequence
  Description of Artificial Sequence: Synthetic coding sequence
atggccatgcaggagaagtaccccaccgagggcatcagccacgtgaccagccccaacttctgcagcagcagcggcagcccccccttccagcccatcaagagccacgtgaccatccccaccgcccacgtgatgcccagcaccctgggcaccagccccgccaagcccaacagcacccccgtgggccccagcagcagcaagctgcccctgagcggcctggccgagagcgtgggcatgaccagaaacggcgacctgggcgccatgaagcacagccccggcctgagcagagacctgatgtacttcagcggcgccaccggcgagaacggcatcgagcagagctggttccccgccgtgggccacgagagacaggaggaggccagaaagttcgacatccccagcatggagagcaccctgaaccagagcgccatgatggagaccctgtacagcgacccccaccacagagtgagattccacaaccccagaaccagcaccagcaaggagctgtacagagtgctgcccgaggccaagaaggcccccggcagcggcgccgtgttcgagagaaacggcccccacagcaacagcagcggcgtgctgcccctgggcctgcagcccgcccccggcctgagcaagcccctgcccagccaggtgtggcagcccagccccgacacctggcaccccagagagcagagctgcgagctgagcacctgcagacagcagctggagctgatcagactgcagatggagcagatgcagctgcagaacggcgccatctgccaccaccccgccgccttcggccccagcctgcccatcctggagcccgcccagtggatcagcatcctgaacagcaacgagcacctgctgaaggagaaggagctgctgatcgacaagcagagaaagcacatcagccagctggagcagaaggtgagagagagcgagctgcaggtgcacagcgccctgctgggcagacccgcccccttcggcgacgtgtgcctgctgagactgcaggagctgcagagagagaacaccttcctgagagcccagttcgcccagaagaccgaggccctgagcagagagaagatcgacctggagaagaagctgagcgccagcgaggtggaggtgcagctgatcagagagagcctgaaggtggccctgcagaagcacagcgaggaggtgaagaagcaggaggagagagtgaagggcagagacaagcacatcaacaacctgaagaagaagtgccagaaggagagcgagcagaacagagagaagcagcagagaatcgagaccctggagagatacctggccgacctgcccaccctggaggaccaccagaagcagagccagcagctgaaggacagcgagctgaagagcaccgagctgcaggagaaggtgaccgagctggagagcctgctggaggagacccaggccatctgcagagagaaggagatccagctggagagcctgagacagagagaggccgagttcagcagcgccggccacagcctgcaggacaagcagagcgtggaggagaccagcggcgagggccccgaggtggagatggagagctggcagaagagatacgacagcctgcagaagatcgtggagaagcagcagcagaagatggaccagctgagaagccaggtgcagagcctggagcaggaggtggcccaggaggagggcaccagccaggccctgagagaggaggcccagagaagagacagcgccctgcagcagctgagaaccgccgtgaaggagctgagcgtgcagaaccaggacctgatcgagaagaacctgaccctgcaggagcacctgagacaggcccagcccggcagcccccccagccccgacaccgcccagctggccctggagctgcaccaggagctggccagctgcctgcaggacctgcaggccgtgtgcagcatcgtgacccagagagcccagggccacgaccccaacctgagcctgctgctgggcatccacagcgcccagcaccccgagacccagctggacctgcagaagcccgacgtgatcaagagaaagctggaggaggtgcagcagctgagaagagacatcgaggacctgagaaccaccatgagcgacagatacgcccaggacatgggcgagaactgcgtgacccagtag

SEQ ID NO: 12568 - DNA, 531 bp, Artificial Sequence
  Description of Artificial Sequence: Synthetic coding sequence
atggccgccgccaccggcgaccccggcctgagcaagctgcagttcgcccccttcagcagcgccctggacgtgggcttctggcacgagctgacccagaagaagctgaacgagtacagactggacgaggcccccaaggacatcaagggctactactacaacggcgacagcgccggcctgcccgccagactgaccctggagttcagcgccttcgacatgagcgcccccacccccgccagatgctgccccgccatcggcaccctgtacaacaccaacaccctggagagcttcaagaccgccgacaagaagctgctgctggagcaggccgccaacgagatctgggagagcatcaagagcggcaccgccctggagaaccccgtgctgctgaacaagttcctgctgctgaccttcgccgacctgaagaagtaccacttctactactggttctgctaccccgccctgtgcctgcccgagagcctgcccctgatccagggccccgtgggcctggaccagagattcagcctgaagcagtag

SEQ ID NO: 12569 - DNA, 1443 bp, Artificial Sequence
  Description of Artificial Sequence: Synthetic coding sequence
atgaagctgaaggagctggagagacccgccgtgcaggcctggagccccgccagccagtaccccctgtacctggccaccggcaccagcgcccagcagctggacagcagcttcagcaccaacggcaccctggagatcttcgaggtggacttcagagaccccagcctggacctgaagcacagaggcgtgctgagcgccctgagcagattccacaagctggtgtggggcagcttcggcagcggcctgctggagagcagcggcgtgatcgtgggcggcggcgacaacggcatgctgatcctgtacaacgtgacccacatcctgagcagcggcaaggagcccgtgatcgcccagaagcagaagcacaccggcgccgtgagagccctggacctgaaccccttccagggcaacctgctggccagcggcgccagcgacagcgagatcttcatctgggacctgaacaacctgaacgtgcccatgaccctgggcagcaagagccagcagccccccgaggacatcaaggccctgagctggaacagacaggcccagcacatcctgagcagcgcccaccccagcggcaaggccgtggtgtgggacctgagaaagaacgagcccatcatcaaggtgagcgaccacagcaacagaatgcactgcagcggcctggcctggcaccccgacatcgccacccagctggtgctgtgcagcgaggacgacagactgcccgtgatccagctgtgggacctgagattcgccagcagccccctgaaggtgctggagagccacagcagaggcatcctgagcgtgagctggagccaggccgacgccgagctgctgctgaccagcgccaaggacagccagatcctgtgcagaaacctgggcagcagcgaggtggtgtacaagctgcccacccagagcagctggtgcttcgacgtgcagtggtgccccagagaccccagcgtgttcagcgccgccagcttcaacggctggatcagcctgtacagcgtgatgggcagaagctgggaggtgcagcacatgagacaggccgacaagatcagcagcagcttcagcaagggccagcccctgccccccctgcaggtgcccgagcaggtggcccaggcccccctgatcccccccctgaagaagccccccaagtggatcagaagacccaccggcgtgagcttcgccttcggcggcaagctggtgaccttcggcctgcccagcacccccgcccacctggtgccccagccctgccccagactggtgttcatcagccaggtgaccaccgagagcgagttcctgatgagaagcgccgagctgcaggaggccctgggcagcggcaacctgctgaactactgccagaacaagagccagcaggccctgctgcagagcgagaagatgctgtggcagttcctgaagcccgccagagacagcagcggcgccagaagatag

SEQ ID NO: 12570 - DNA, 1842 bp, Artificial Sequence; identical to SEQ ID NO: 9548
  Description of Artificial Sequence: Synthetic coding sequence

SEQ ID NO: 12571 - DNA, 1446 bp, Artificial Sequence; identical to SEQ ID NO: 12062
  Description of Artificial Sequence: Synthetic coding sequence

SEQ ID NO: 12572 - DNA, 537 bp, Artificial Sequence
  Description of Artificial Sequence: Synthetic coding sequence
atgagcagcaacgagtgcttcaagtgcggcagaagcggccactgggccagagagtgccccaccggcggcggcagaggcagaggcatgagaagcagaggcagaggcggcttcaccagcgacagaggcttccagttcgtgagcagcagcctgcccgacatctgctacagatgcggcgagagcggccacctggccaaggactgcgacctgcaggaggacgaggcctgctacaactgcggcagaggcggccacatcgccaaggactgcaaggagcccaagagagagagagagcagtgctgctacaactgcggcaagcccggccacctggccagagactgcgaccacgccgacgagcagaagtgctacagctgcggcgagttcggccacatccagaaggactgcaccaaggtgaagtgctacagatgcggcgagaccggccacgtggccatcaactgcagcaagaccagcgaggtgaactgctacagatgcggcgagagcggccacctggccagagagtgcaccatcgaggccaccgcctag

SEQ ID NO: 12573 - DNA, 87 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgtag

SEQ ID NO: 12574 - DNA, 603 bp, Artificial Sequence
  Description of Artificial Sequence: Synthetic coding sequence
atggccgccaccgccagagaggacggcgccagcggccaggagagaggccagagaggctgcgagcactacgacagaggctgcctgctgaaggccccctgctgcgacaagctgtacacctgcagactgtgccacgacaacaacgaggaccaccagctggacagattcaaggtgaaggaggtgcagtgcatcaactgcgagaagatccagcacgcccagcagacctgcgaggagtgcagcaccctgttcggcgagtactactgcgacatctgccacctgttcgacaaggacaagaagcagtaccactgcgagaactgcggcatctgcagaatcggccccaaggaggacttcttccactgcctgaagtgcaacctgtgcctggccatgaacctgcagggcagacacaagtgcatcgagaacgtgagcagacagaactgccccatctgcctggaggacatccacaccagcagagtggtggcccacgtgctgccctgcggccacctgctgcacagaacctgctacgaggagatgctgaaggagctgcagatgagcatcatgtacgccctgtgcttcagatacgaccaggtgctggagaccgccggctag

SEQ ID NO: 12575 - DNA, 567 bp, Artificial Sequence
  Description of Artificial Sequence: Synthetic coding sequence
atggccacccccctgggctggagcaaggccggcagcggcagcgtgtgcctggccctggaccagctgagagacgtgatcgagagccaggaggagctgatccaccagctgagaaacgtgatggtgctgcaggacgagaacttcgtgagcaaggaggagttccaggccgtggagaagaagctggtggaggagaaggccgcccacgccaagaccaaggtgctgctggccaaggaggaggagaagctgcagttcgccctgggcgaggtggaggtgctgagcaagcagctggagaaggagaagctggccttcgagaaggccctgagcagcgtgaagagcaaggtgctgcaggagagcagcaagaaggaccagctgatcaccaagtgcaacggcagaagagaggccagagccctgcaccacggctacatcaacggcctgttccccaaccaccccgtgcccgtgagcaaggccggcttccacagcaacacctgcccccagctgagaatccaggccggccccggcggcccccacctgagaaagggcctgaagggccccggcagacccagaaagtag

SEQ ID NO: 12576 - DNA, 381 bp, Artificial Sequence
  Description of Artificial Sequence: Synthetic coding sequence
atggacagaagcaagagaaacagcatcgccggcttcccccccagagtggagagactggaggagttcgagggcggcggcggcggcgagggcaacgtgagccaggtgggcagagtgtggcccagcagctacagagccctgatcagcgccttcagcagactgaccagactggacgacttcacctgcgagaagatcggcagcggcttcttcagcgaggtgttcaaggtgagacacagagccagcggccaggtgatggccctgaagatgaacaccctgagcagcaacagagccaacatgctgaaggaggtgcagctgatgaacagactgagccaccccaacatcctgagatgcagaagcatgaaccagaacttcagccccaactag

SEQ ID NO: 12577 - DNA, 1443 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccccccatcatgggcatcatcatcgaccacttcgtggacagaccctaccccagcagcagccccatgcacccctgcaactacagaaccgccggcgaggacaccggcgtgatctaccccagcgtggaggacagccaggaggtgtgcaccaccagcttcagcaccagcccccccagccagctgatggtgcccggcaaggagggcggcgtgcccctggcccccaaccagcccgtgcacggcacccaggccgaccaggagagactggccacctgcacccccagcgacagaacccactgcgccgccacccccagcagcagcgaggacaccgagaccgtgagcaacagcagcgagggcagagccagcccccacgacgtgctggagaccatcttcgtgagaaaggtgggcgccttcgtgaacaagcccatcaaccaggtgaccctgaccagcctggacatccccttcgccatgttcgcccccaagaacctggagctggaggacaccgaccccatggtgaacccccccgacagccccgagaccgagagccccctgcagggcagcctgcacagcgacggcagcagcggcggcagcagcggcaacacccacgacgacttcgtgatgatcgacttcaagcccgccttcagcaaggacgacatcctgcccatggacctgggcaccttctacagagagttccagaaccccccccagctgagcagcctgagcatcgacatcggcgcccagagcatggccgaggacctggacagcctgcccgagaagctggccgtgcacgagaagaacgtgagagagttcgacgccttcgtggagaccctgcagtag

SEQ ID NO: 12578 - DNA, 390 bp, Artificial Sequence; identical to SEQ ID NO: 10956
  Description of Artificial Sequence: Synthetic coding sequence

SEQ ID NO: 12579 - DNA, 348 bp, Artificial Sequence
  Description of Artificial Sequence: Synthetic coding sequence
atggtggaggacgagctggccctgttcgacaagagcatcaacgagttctggaacaagttcaagagcaccgacaccagctgccagatggccggcctgagagacacctacaaggacagcatcaaggccttcgccgagaagctgagcgtgaagctgaaggaggaggagagaatggtggagatgttcctggagtaccagaaccagatcagcagacagaacaagctgatccaggagaagaaggacaacctgctgaagctgatcgccgaggtgaagggcaagaagcaggagctggaggtgctgaccgccaacatccaggacctgaaggaggagtacagcagaaagaaggagtag

SEQ ID NO: 12580 - DNA, 402 bp, Artificial Sequence
  Description of Artificial Sequence: Synthetic coding sequence
atggccagcagcgccagagagcacctgctgttcgtgagaagaagaaacccccagatgagatacaccctgagccccgagaacctgcagagcctggccgcccagagcagcatgcccgagaacatgaccctgcagagagccaacagcgacaccgacctggtgaccagcgagagcagaagcagcctgaccgccagcatgtacgagtacaccctgggccaggcccagaacctgatcatcttctgggacatcaaggaggaggtggaccccagcgactggatcggcctgtaccacatcgacgagaacagccccgccaacttctgggacagcaagaacagaggcgtgaccggcacccagaagggccagatcgtgtggagaatcgagcccggcccctacttcatggagtag

SEQ ID NO: 12581 - DNA, 264 bp, Artificial Sequence
  Description of Artificial Sequence: Synthetic coding sequence
atgagcctgttcggcaccaccagcggcttcggcaccagcggcaccagcatgttcggcagcgccaccaccgacaaccacaaccccatgaaggacatcgaggtgaccagcagccccgacgacagcatcggctgcctgagcttcagcccccccaccctgcccggcaacttcctgatcgccggcagctgggccaacgacgtgagatgctgggaggtgcaggacagcggccagaccatccccaaggcccagcagatgcacaccggctag

SEQ ID NO: 12582 - DNA, 1329 bp, Artificial Sequence
  Description of Artificial Sequence: Synthetic coding sequence
atggccaacagcttcgccgccagaatcttcaccaccctgagcgacctgcagaccaacatggccaacctgaaggtgatcggcatcgtgatcggcaagaccgacgtgaagggcttccccgacagaaagagcatcggcagcgagagatacaccttcagcttcaccatcagagacagccccgcccacttcgtgaacgccgccagctggggcaacgaggactacatcaagagcctgagcgacagcttcagagtgggcgactgcgtgatcatcgagaaccccctgatccagagaaaggagatcgagagagaggagaagttcagccccgccacccccagcaactgcaagctgctgctgagcgagaaccacagcaccgtgaaggtgtgcagcagctacgaggtggacaccaagctgctgagcctgatccacctgcccgtgaaggagagccacgactactacagcctgggcgacatcgtggccaacggccacagcctgaacggcagaatcatcaacgtgctggccgccgtgaagagcgtgggcgagcccaagtacttcaccaccagcgacagaagaaagggccagagatgcgaggtgagactgtacgacgagaccgagagcagcttcgccatgacctgctgggacaacgagagcatcctgctggcccagagctggatgcccagagagaccgtgatcttcgccagcgacgtgagaatcaacttcgacaagttcagaaactgcatgaccgccaccgtgatcagcaagaccatcatcaccaccaaccccgacatccccgaggccaacatcctgctgaacttcatcagagagaacaaggagaccaacgtgctggacgacgagatcgacagctacttcaaggagagcatcaacctgagcaccatcgtggacgtgtacaccgtggagcagctgaagggcaaggccctgaagaacgagggcaaggccgaccccagctacggcatcctgtacgcctacatcagcaccctgaacatcgacgacgagaccaccaaggtggtgagaaacagatgcagcagctgcggctacatcgtgaacgaggccagcaacatgtgcaccacctgcaacaagaacagcctggacttcaagagcgtgttcctgagcttccacgtgctgatcgacctgaccgaccacaccggcaccctgcacagctgcagcctgaccggcagcgtggccgaggagaccctgggctgcaccttcgtgctgagccacagagccagaagcggcctgaagatcagcgtgctgagctgcaagctggccgaccccaccgaggccagcagaaacctgagcggccagaagcacgtgtag

SEQ ID NO: 12583 - DNA, 651 bp, Artificial Sequence
  Description of Artificial Sequence: Synthetic coding sequence
atgaacaaccagaagcagcagaagcccaccctgagcggccagagattcaagaccagaaagagagacgagaaggagagattcgaccccacccagttccaggactgcatcatccagggcctgaccgagaccggcaccgacctggaggccgtggccaagttcctggacgccagcggcgccaagctggactacagaagatacgccgagaccctgttcgacatcctggtggccggcggcatgctggcccccggcggcaccctggccgacgacatgatgagaaccgacgtgtgcgtgttcgccgcccaggaggacctggagaccatgcaggccttcgcccaggtgttcaacaagctgatcagaagatacaagtacctggagaagggcttcgaggacgaggtgaagaagctgctgctgttcctgaagggcttcagcgagagcgagagaaacaagctggccatgctgaccggcgtgctgctggccaacggcaccctgaacgccagcatcctgaacagcctgtacaacgagaacctggtgaaggagggcgtgagcgccgccttcgccgtgaagctgttcaagagctggatcaacgagaaggacatcaacgccgtggccgccagcctgagaaaggtgagcatggacaacagactgatgtag

SEQ ID NO: 12584 - DNA, 429 bp, Artificial Sequence; identical to SEQ ID NO: 12103
  Description of Artificial Sequence: Synthetic coding sequence

SEQ ID NO: 12585 - DNA, 447 bp, Artificial Sequence
  Description of Artificial Sequence: Synthetic coding sequence
gccatccacatcctggacgtgctggtgctgaacggcaccgacgtgagagagcagcacttcaaccagagaatccagctggccgagaagttcgtgaaggccgtgagcaagcccagcagacccgacatgaaccccatcagagtgaaggaggtgtacagactggaggagatggagaagatcttcgtgagactggagatgaagatcatcaagggcagcagcggcacccccaagctgagctacaccggcagagacgacagacacttcgtgcccatgggcctgtacatcgtgagaaccgtgaacgagccctggaccatgggcttcagcaagagcttcaagaagaagttcttctacaacaagaagaccaaggacagcaccttcgacctgccctactaccccttccccagcttcttcttccccaacagaagatacaacctgctgctgttcgtgtag

SEQ ID NO: 12586 - DNA, 300 bp, Artificial Sequence
  Description of Artificial Sequence: Synthetic coding sequence
atggaggagatccccgcccaggaggccgccggcagccccagagtgcagttccagagcctggagacccagagcgagtgcctgagccccgagccccagttcgtgcaggacaccgacatggagcagggcctgaccggcggcatcctgctgagactgcccaccaccagaatccacagcgtgaacagctgccccgccctgagccacacccaggccagcgccttcagcggcgagaccctggccgtgctgaccgccggcatcagcaagagatggcccaagtacagactgcccatcgacatcgcctag

SEQ ID NO: 12587 - DNA, 2493 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagacccaagaagtacatcgtgagcagcggcagcgagccccccgagctgggctacgtggacatcagaaccctggccgacagcgtgtgcagatacgacctgaacgacatggacgccgcctggctggagctgaccaacgaggagttcaaggagatgggcatgcccgagctggacgagtacaccatggagagagtgctggaggagttcgagcagagatgctacgacaacatgaaccacgccatcgagaccgaggagggcctgggcatcgagtacgacgaggacgtggtgtgcgacgtgtgccagagccccgacggcgaggacggcaacgagatggtgttctgcgacaagtgcaacatctgcgtgcaccaggcctgctacggcatcctgaaggtgcccgagggcagctggctgtgcagaacctgcgccctgggcgtgcagcccaagtgcctgctgtgccccaagaagggcggcgccatgaagcccaccagaagcggcaccaagtgggtgcacgtgagctgcgccctgtggatccccgaggtgagcatcggcagccccgagaagatggagcccatcaccaaggtgagccacatccccagcagcagatgggccctggtgtgcagcctgtgcaacgagaagttcggcgccagcatccagtgcagcgtgaagaactgcagaaccgccttccacgtgacctgcgccttcgacagaggcctggagatgaagaccatcctggccgagaacgacgaggtgaagttcaagagctactgccccaagcacagcagccacagaaagcccgaggagagcctgggcaagggcgccgcccaggagaacggcgcccccgagtgcagccccagaaaccccctggagcccttcgccagcctggagcagaacagagaggaggcccacagagtgagcgtgagaaagcagaagctgcagcagctggaggacgagttctacaccttcgtgaacctgctggacgtggccagagccctgagactgcccgaggaggtggtggacttcctgtaccagtactggaagctgaagagaaaggtgaacttcaacaagcccctgatcacccccaagaaggacgaggaggacaacctggccaagagagagcaggacgtgctgttcagaagactgcagctgttcacccacctgagacaggacctggagagagtgagaaacctgacctacatggtgaccagaagagagaagatcaagagaagcgtgtgcaaggtgcaggagcagatcttcaacctgtacaccaagctgctggagcaggagagagtgagcggcgtgcccagcagctgcagcagcagcagcctggagaacatgctgctgttcaacagccccagcgtgggccccgacgcccccaagatcgaggacctgaagtggcacagcgccttcttcagaaagcagatgggcaccagcctggtgcacagcctgaagaagccccacaagagagaccccctgcagaacagccccggcagcgagggcaagaccctgctgaagcagcccgacctgtgcggcagaagagagggcatggtggtgcccgagagcttcctgggcctggagaagaccttcgccgaggccagactgatcagcgcccagcagaagaacggcgtggtgatgcccgaccacggcaagagaagagacaacagattccactgcgacctgatcaagggcgacctgaaggacaagagcttcaagcagagccacaagcccctgagaagcaccgacgtgagccagagacacctggacaacaccagagccgccaccagccccggcgtgggccagagcgcccccggcaccagaaaggagatcgtgcccaagtgcaacggcagcctgatcaaggtgaactacaaccagaccgccgtgaaggtgcccaccacccccgccagccccgtgaagaactggggcggcttcagaatccccaagaagggcgagagacagcagcagggcgaggcccacgacggcgcctgccaccagcacagcgactacccctacctgggcctgggcagagtgcccgccaaggagagagccaagagcaagctgaagagcgacaacgagaacgacggctacgtgcccgacgtggagatgagcgacagcgagagcgaggccagcgagaagaagtgcatccacaccagcagcaccatcagcagaagaaccgacatcatcagaagaagcatcctggccagctag

SEQ ID NO: 12588 - DNA, 402 bp, Artificial Sequence
  Description of Artificial Sequence: Synthetic coding sequence
atggccagcgaggacatcgccaagctggccgagaccctggccaagacccaggtggccggcggccagctgagcttcaagggcaagagcctgaagctgaacaccgccgaggacgccaaggacgtgatcaaggagatcgaggacttcgacagcctggaggccctgagactggagggcaacaccgtgggcgtggaggccgccagagtgatcgccaaggccctggagaagaagagcgagctgaagagatgccactggagcgacatgttcaccggcagactgagaaccgagatcccccccgccctgatcagcctgggcgagggcctgatcaccgccggcgcccagctggtggagctggacctgagcgacaacgccttcggccccgacggcgtgcagggcttcgagtag

SEQ ID NO: 12589 - DNA, 390 bp, Artificial Sequence
  Description of Artificial Sequence: Synthetic coding sequence
atgagccccggcagcggcgtgaagagcgagtacatgaagagataccaggagcccagatgggaggagtacggcccctgctacagagagctgctgcactacagactgggcagaagactgctggagcaggcccacgccccctggctgtgggacgactggggccccgccggcagcagcgaggacagcgccagcagcgagagcagcggcgccggcggccccgcccccagatgcgccccccccagcccccccccccccgtggagcccgccacccaggaggaggccgagagaagagccagaggcgcccccgaggagcaggacgccgaggccggcgacgccgaggccgaggacgccgaggacgccgccctgcccggcaacgcctggctgagaacctag

SEQ ID NO: 12590 - DNA, 390 bp, Artificial Sequence; identical to SEQ ID NO: 10956
  Description of Artificial Sequence: Synthetic coding sequence

SEQ ID NO: 12591 - DNA, 402 bp, Artificial Sequence
  Description of Artificial Sequence: Synthetic coding sequence
atggccgagaagctgatcacccagaccttcagccaccacaaccagctggcccagaagaccagaagagagaagagagccagacaggaggccgagagaagagagaaggccgagagagccgccagactggccaaggaggccaagagcgagaccagcggcccccagatcaaggagctgaccgacgaggaggccgagagactgcagctggagatcgaccagaagaaggacgccgagaaccacgaggcccagctgaagaacggcagcctggacagccccggcaagcaggacaccgaggaggacgaggaggaggacgagaaggacaagggcaagctgaagcccaacctgggcaacggcgccgacctgcccaactacagatggacccagaccctgagcgagctggactag

SEQ ID NO: 12592 - DNA, 2373 bp, Artificial Sequence; identical to SEQ ID NO: 9490
  Description of Artificial Sequence: Synthetic coding sequence

SEQ ID NO: 12593 - DNA, 1356 bp, Artificial Sequence
  Description of Artificial Sequence: Synthetic coding sequence
atgtacggcgcccccggcgcccccgcccagagcgccagcgtgaccgtggtgagaagcctgagaagaccccccccccaggccaccggcgtgagcttcatgaacaaccagaagcagcagaagcccaccctgagcggccagagattcaagaccagaaagagagacgagaaggagagattcgaccccacccagttccaggactgcatcatccagggcctgaccgagaccggcaccgacctggaggccgtggccaagttcctggacgccagcggcgccaagctggactacagaagatacgccgagaccctgttcgacatcctggtggccggcggcatgctggcccccggcggcaccctggccgacgacatgatgagaaccgacgtgtgcgtgttcgccgcccaggaggacctggagaccatgcaggccttcgcccaggtgttcaacaagctgatcagaagatacaagtacctggagaagggcttcgaggacgaggtgaagaagctgctgctgttcctgaagggcttcagcgagagcgagagaaacaagctggccatgctgaccggcgtgctgctggccaacggcaccctgaacgccagcatcctgaacagcctgtacaacgagaacctggtgaaggagggcgtgagcgccgccttcgccgtgaagctgttcaagagctggatcaacgagaaggacatcaacgccgtggccgccagcctgagaaaggtgagcatggacaacagactgatggagctgttccccgccaacaagcagagcgtggagcacttcaccaagtacttcaccgaggccggcctgaaggagctgagcgagtacgtgagaaaccagcagaccatcggcgccagaaaggagctgcagaaggagctgcaggagcagatgagcagaggcgaccccttcaaggacatcatcctgtacgtgaaggaggagatgaagaagaacaacatccccgagcccgtggtgatcggcatcgtgtggagcagcgtgatgagcaccgtggagtggaacaagaaggaggagctggtggccgagcaggccatcaagcacctgaagcagtacagccccctgctggccgccttcaccacccagggccagagcgagctgaccctgctgctgaagatccaggagtactgctacgacaacatccacttcatgaaggccttccagaagatcgtggtgctgttctacaaggccgaggtgctgagcgaggagcccatcctgaagtggtacaaggacgcccacgtggccaagggcaagagcgtgttcctggagcagatgaagaagttcgtggagtggctgaagaacgccgaggaggagagcgagagcgaggccgaggagggcgactag

SEQ ID NO: 12594 - DNA, 948 bp, Artificial Sequence
  Description of Artificial Sequence: Synthetic coding sequence
atggccggcggcgccagagaggtgctgaccctgcagctgggccacttcgccggcttcgtgggcgcccactggtggaaccagcaggacgccgccctgggcagagccaccgacagcaaggagccccccggcgagctgtgccccgacgtgctgtacagaaccggcagaaccctgcacggccaggagacctacacccccagactgatcctgatggacctgaagggcagcctgagcagcctgaaggaggagggcggcctgtacagagacaagcagctggacgccgccatcgcctggcagggcaagctgaccacccacaaggaggagctgtaccccaagaacccctacctgcaggacttcctgagcgccgagggcgtgctgagcagcgacggcgtgtggagagtgaagagcatccccaacggcaagggcagcagccccctgcccaccgccaccacccccaagcccctgatccccaccgaggccagcatcagagtgtggagcgacttcctgagagtgcacctgcaccccagaagcatctgcatgatccagaagtacaaccacgacggcgaggccggcagactggaggccttcggccagggcgagagcgtgctgaaggagcccaagtaccaggaggagctggaggacagactgcacttctacgtggaggagtgcgactacctgcaggtggtggcctggcagtgcgccctgcagggcggcagcagcagccaccccgccaactacctgagcagcctgacccccgcccagggcttccagatcctgtgcgacctgcacgacggcttcagcggcgtgggcgccaaggccgccgagctgctgcaggacgagtacagcggcagaggcatcatcacctggggcctgctgcccggcccctaccacagaggcgtgagcggcacctggagaagcaagcacagcaaccccatcggcagagtggcctag

SEQ ID NO: 12595 - DNA, 285 bp, Artificial Sequence
  Description of Artificial Sequence: Synthetic coding sequence
tgcaccagcagctgcacccccagctgctgccagcagagcagctgccagcccgcctgctgcaccagcagcccctgccagcaggcctgctgcgtgcccgtgtgctgcaagaccgtgtgctgcaagcccagcagctgccagcccgcctgctgcatcagcagcccctgccagcagagctgctgcgtgcccgtgtgctgcaagcccatctgctgcgtgccccccgcctgctgcaccaccagctgctgcagacccagcagcagcgtgagcctgctgtgcagacccgtgtag

SEQ ID NO: 12596 - DNA, 1221 bp, Artificial Sequence
  Description of Artificial Sequence: Synthetic coding sequence
atggccgccaacctgagcagaaacggccccgccctgcaggaggcctacgtgagagtggtgaccgagaagagccccaccgactgggccctgttcacctacgagggcaacagcaacgacatcagagtggccggcaccggcgagggcggcctggaggagatggtggaggagctgaacagcggcaaggtgatgtacgccttctgcagagtgaaggaccccaacagcggcctgcccaagttcgtgctgatcaactggggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagcagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12597 - DNA, 981 bp, Artificial Sequence; identical to SEQ ID NO: 11734
  Description of Artificial Sequence: Synthetic coding sequence

SEQ ID NO: 12598 - DNA, 684 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgcggcttcatcagcgacagaagcgtgaaggaggtggcctgcggcggcaaccacagcgtgttcctgctggaggacggcgaggtgtacacctgcggcctgaacaccaagggccagctgggccacgagagagagggcaacaagcccgagcagatcggcgccctggccgaccagcacatcatccacgtggcctgcggcgagagccacagcctggccctgagcgacagaggccagctgttcagctggggcgccggcagcgacggccagctgggcctgatgaccaccgaggacagcgtggccgtgcccagactgatccagaagctgaaccagcagaccatcctgcaggtgagctgcggcaactggcactgcctggccctggccgccgacggccagttcttcacctggggcaagaacagccacggccagctgggcctgggcaaggagttccccagccaggccagcccccagagagtgagaagcctggagggcatccccctggcccaggtggccgccggcggcgcccacagcttcgccctgagcctgagcggcgccgtgttcggctggggcatgaacaacgccggccagctgggcctgagcgacgagtag

SEQ ID NO: 12599 - DNA, 624 bp, Artificial Sequence
  Description of Artificial Sequence: Synthetic coding sequence
atgagcagccccctggccagcctgagcaagaccagaaaggtgcccctgcccagcgagcccatgaaccccggcagaagaggcatcagaatctacggcgacgtgcccgccagccacgacagcgagctgatggccttcatgaccagaaagctgtgggacctggagcagcaggtgaaggcccagaccgacgagatcctgagcaaggaccagaagatcgccgccctggaggacctggtgcagaccctgagaccccaccccgccgaggccaccctgcagagacaggaggagctggagaccatgtgcgtgcagctgcagagacaggtgagagagatggagagattcctgagcgactacggcctgcagtgggtgggcgagcccatggaccaggaggacagcgagagcaagaccgtgagcgagcacggcgagagagactggatgaccgccaagaagttctggaagcccggcgacagcctggccccccccgaggtggacttcgacagactgctggccagcctgcaggacctgagcgagctggtggtggagggcgacacccaggtgacccccgtgcccggcggcgccagactgagaaccctggagcccatccccctgaagctgtacagaaactag

SEQ ID NO: 12600 - DNA, 717 bp, Artificial Sequence; identical to SEQ ID NO: 12544
  Description of Artificial Sequence: Synthetic coding sequence

SEQ ID NO: 12601 - DNA, 369 bp, Artificial Sequence
  Description of Artificial Sequence: Synthetic coding sequence
gtgagagagctggaggccgagctggacgccgagcagaagaagcacgccgaggccctgaagggcgtgagaaagcacgagagaagagtgaaggagctggcctaccaggccgaggaggacagaaagaacctggccagaatgcaggacctggtggacaagctgcagagcaaggtgaagagctacaagagacagttcgaggaggccgagcagcaggccaacaccaacctggccaagtacagaaaggcccagcacgagctggacgacgccgaggagagagccgacatggccgagacccaggccaacaagctgagagccagaaccagagacgccctgggccccaagctgagcctgagcccccagcacaaggagtag

SEQ ID NO: 12602 - DNA, 483 bp, Artificial Sequence
  Description of Artificial Sequence: Synthetic coding sequence
tgagagagcctggtgggcctgcaggagggcaagagcaccgagcagggcaaccacgaccagctgaaggagctgtacagcgccggcaacctgaccgtgctggccaccgaccccctgctgcaccaggaccccgtgcagctggacttccacttcagactgaccagccagaccagcgcccactggcacggcctgctgtgcgacagaagactgttcctggacatcccctaccaggccctggaccagggcaacagagagagcctgaccgccaccctggagtacgtggaggagaagaccaacgtggacagcgtgttcgtgaacttccagaacgacagaaacgacagaggcgccctgctgagagccttcagctacatgggcttcgaggtggtgagacccgaccaccccgccctgccccccctggacaacgtgatcttcatggtgtaccccctggagagagacgtgggccacctgcccagcgagcccccctag

SEQ ID NO: 12603 - DNA, 102 bp, Artificial Sequence
  Description of Artificial Sequence: Synthetic coding sequence
atgagcgtgacctacgacgacagcgtgggcgtggaggtgagcagcgacagcttctgggaggtgggcaactacaagagaaccgtgaagagaatcgacgactag

SEQ ID NO: 12604 - DNA, 402 bp, Artificial Sequence
  Description of Artificial Sequence: Synthetic coding sequence
atgtggagcctgaccgccagcgagggcgagagcaccaccgcccacttcttcctgggcgccggcgacgagggcctgggcaccagaggcatcggcatgagacccgaggagagcgacagcgagctgctggaggacgaggaggacgaggtgccccccgagccccagatcatcgtgggcatctgcgccatgaccaagaagagcaagagcaagcccatgacccagatcctggagagactgtgcagattcgactacctgaccgtggtgatcctgggcgaggacgtgatcctgaacgagcccgtggagaactggcccagctgccactgcctgatcagcttccacagcaagggcttccccctggacaaggccgtggcctacagcaagctgagaaaccccttcctgatctag

SEQ ID NO: 12605 - DNA, 939 bp, Artificial Sequence; identical to SEQ ID NO: 11813
  Description of Artificial Sequence: Synthetic coding sequence

SEQ ID NO: 12606 - DNA, 1308 bp, Artificial Sequence
  Description of Artificial Sequence: Synthetic coding sequence
tgaagcatcctgaacagcaacgagcacctgctgaaggagaaggagctgctgatcgacaagcagagaaagcacatcagccagctggagcagaaggtgagagagagcgagctgcaggtgcacagcgccctgctgggcagacccgcccccttcggcgacgtgtgcctgctgagactgcaggagctgcagagagagaacaccttcctgagagcccagttcgcccagaagaccgaggccctgagcagagagaagatcgacctggagaagaagctgagcgccagcgaggtggaggtgcagctgatcagagagagcctgaaggtggccctgcagaagcacagcgaggaggtgaagaagcaggaggagagagtgaagggcagagacaagcacatcaacaacctgaagaagaagtgccagaaggagagcgagcagaacagagagaagcagcagagaatcgagaccctggagagatacctggccgacctgcccaccctggaggaccaccagaagcagagccagcagctgaaggacagcgagctgaagagcaccgagctgcaggagaaggtgaccgagctggagagcctgctggaggagacccaggccatctgcagagagaaggagatccagctggagagcctgagacagagagaggccgagttcagcagcgccggccacagcctgcaggacaagcagagcgtggaggagaccagcggcgagggccccgaggtggagatggagagctggcagaagagatacgacagcctgcagaagatcgtggagaagcagcagcagaagatggaccagctgagaagccaggtgcagagcctggagcaggaggtggcccaggaggagggcaccagccaggccctgagagaggaggcccagagaagagacagcgccctgcagcagctgagaaccgccgtgaaggagctgagcgtgcagaaccaggacctgatcgagaagaacctgaccctgcaggagcacctgagacaggcccagcccggcagcccccccagccccgacaccgcccagctggccctggagctgcaccaggagctggccagctgcctgcaggacctgcaggccgtgtgcagcatcgtgacccagagagcccagggccacgaccccaacctgagcctgctgctgggcatccacagccagcaccccgagacccagctggacctgcagaagcccgacgtgatcaagagaaagctggaggaggtgcagcagctgagaagagacatcgaggacctgagaaccaccatgagcgacagatacgcccaggacatgggcgagaactgcgtgacccagtag

SEQ ID NO: 12607 - DNA, 474 bp, Artificial Sequence
  Description of Artificial Sequence: Synthetic coding sequence
atggagctgagatgcggcggcctgctgttcagcagcagattcgacagcggcaacctggcccacgtggagaaggtggagagcctgagcagcgacggcgagggcgtgggcggcggcgccagcgccctgaccagcggcatcgccagcagccccgactacgagttcaacgtgtggaccagacccgactgcgccgagaccgagttcgagaacggcaacagaagctggttctacttcagcgtgagaggcggcatgcccggcaagctgatcaagatcaacatcatgaacatgaacaagcagagcaagctgtacagccagggcatggcccccttcgtgagaaccctgcccaccagacccagatgggagagaatcagagacagacccaccttcgagatgaccgagacccagttcgtgctgagcttcgtgcacagattcgtggagggcagaggcgccaccaccttcttcgccttctgctactag

SEQ ID NO: 12608 - DNA, 1620 bp, Artificial Sequence; identical to SEQ ID NO: 10018
  Description of Artificial Sequence: Synthetic coding sequence

SEQ ID NO: 12609 - DNA, 6141 bp, Artificial Sequence
  Description of Artificial Sequence: Synthetic coding sequence
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggcggcaagagatacggcagaagaagcctgcccgagttccaggagagcgtggaggagttccccgaggtgaccgtgatcgagcccctggacgaggaggccagacccagccacatccccgccggcgactgcagcgagcactggaagacccagagaagcgaggagtacgaggccgagggccagctgagattctggaaccccgacgacctgaacgccagccagagcggcagcagccccccccaggactggatcgaggagaagctgcaggaggtgtgcgaggacctgggcatcaccagagacggccacctgaacagaaagaagctggtgagcatctgcgagcagtacggcctgcagaacgtggacggcgagatgctggaggaggtgttccacaacctggaccccgacggcaccatgagcgtggaggacttcttctacggcctgttcaagaacggcaagagcctgacccccagcgccagcaccccctacagacagctgaagagacacctgagcatgcagagcttcgacgagagcggcagaagaaccaccaccagcagcgccatgaccagcaccatcggcttcagagtgttcagctgcctggacgacggcatgggccacgccagcgtggagagaatcctggacacctggcaggaggagggcatcgagaacagccaggagatcctgaaggccctggacttcagcctggacggcaacatcaacctgaccgagctgaccctggccctggagaacgagctgctggtgaccaagaacagcatccaccaggccgccctggccagcttcaaggccgagatcagacacctgctggagagagtggaccaggtggtgagagagaaggagaagctgagaagcgacctggacaaggccgagaagctgaagagcctgatggccagcgaggtggacgaccaccacgccgccatcgagagaagaaacgagtacaacctgagaaagctggacgaggagtacaaggagagaatcgccgccctgaagaacgagctgagaaaggagagagagcagatcctgcagcaggccggcaagcagagactggagctggagcaggagatcgagaaggccaagaccgaggagaactacatcagagacagactggccctgagcctgaaggagaacagcagactggagaacgagctgctggagaacgccgagaagctggccgagtacgagaacctgaccaacaagctgcagagaaacctggagaacgtgctggccgagaagttcggcgacctggaccccagcagcgccgagttcttcctgcaggaggagagactgacccagatgagaaacgagtacgagagacagtgcagagtgctgcaggaccaggtggacgagctgcagagcgagctggaggagtacagagcccagggcagagtgctgagactgcccctgaagaacagccccagcgaggaggtggaggccaacagcggcggcatcgagcccgagcacggcctgggcagcgaggagtgcaaccccctgaacatgagcatcgaggccgagctggtgatcgagcagatgaaggagcagcaccacagagacatctgctgcctgagactggagctggaggacaaggtgagacactacgagaagcagctggacgagaccgtggtgagctgcaagaaggcccaggagaacatgaagcagagacacgagaacgagacccacaccctggagaagcagatcagcgacctgaagaacgagatcgccgagctgcagggccaggccgccgtgctgaaggaggcccaccacgaggccacctgcagacacgaggaggagaagaagcagctgcaggtgaagctggaggaggagaagacccacctgcaggagaagctgagactgcagcacgagatggagctgaaggccagactgacccaggcccaggccagcttcgagagagagagagagggcctgcagagcagcgcctggaccgaggagaaggtgagaggcctgacccaggagctggagcagttccaccaggagcagctgaccagcctggtggagaagcacaccctggagaaggaggagctgagaaaggagctgctggagaagcaccagagagagctgcaggagggcagagagaagatggagaccgagtgcaacagaagaaccagccagatcgaggcccagttccagagcgactgccagaaggtgaccgagagatgcgagagcgccctgcagagcctggagggcagatacagacaggagctgaaggacctgcaggagcagcagagagaggagaagagccagtgggagttcgagaaggacgagctgacccaggagtgcgccgaggcccaggagctgctgaaggagaccctgaagagagagaagaccaccagcctggtgctgacccaggagagagagatgctggagaagacctacaaggagcacctgaacagcatggtggtggagagacagcagctgctgcaggacctggaggacctgagaaacgtgagcgagacccagcagagcctgctgagcgaccagatcctggagctgaagagcagccacaagagagagctgagagagagagaggaggtgctgtgccaggccggcgccagcgagcagctggccagccagagactggagagactggagatggagcacgaccaggagagacaggagatgatgagcaagctgctggccatggagaacatccacaaggccacctgcgagaccgccgacagagagagagccgagatgagcaccgagatcagcagactgcagagcaagatcaaggagatgcagcaggccaccagccccctgagcatgctgcagagcggctgccaggtgatcggcgaggaggaggtggagggcgacggcgccctgagcctgctgcagcagggcgagcagctgctggaggagaacggcgacgtgctgctgagcctgcagagagcccacgagcaggccgtgaaggagaacgtgaagatggccaccgagatcagcagactgcagcagagactgcagaagctggagcccggcctggtgatgagcagctgcctggacgagcccgccaccgagttcttcggcaacaccgccgagcagaccgagcagttcctgcagcagaacagaaccaagcaggtggagggcgtgaccagaagacacgtgctgagcgacctggaggacgacgaggtgagagacctgggcagcaccggcaccagcagcgtgcagagacaggaggtgaagatcgaggagagcgaggccagcgtggagggcttcagcgagctggagaacagcgaggagaccagaaccgagagctgggagctgaagaaccagatcagccagctgcaggagcagctgatgatgctgtgcgccgactgcgacagagccagcgagaagaagcaggacctgctgttcgacgtgagcgtgctgaagaagaagctgaagatgctggagagaatccccgaggccagccccaagtacaagctgctgtacgaggacgtgagcagagagaacgactgcctgcaggaggagctgagaatgatggagaccagatacgacgaggccctggagaacaacaaggagctgaccgccgaggtgttcagactgcaggacgagctgaagaagatggaggaggtgaccgagaccttcctgagcctggagaagagctacgacgaggtgaagatcgagaacgagggcctgaacgtgctggtgctgagactgcagggcaagatcgagaagctgcaggagagcgtggtgcagagatgcgactgctgcctgtgggaggccagcctggagaacctggagatcgagcccgacggcaacatcctgcagctgaaccagaccctggaggagtgcgtgcccagagtgagaagcgtgcaccacgtgatcgaggagtgcaagcaggagaaccagtacctggagggcaacacccagctgctggagaaggtgaaggcccacgagatcgcctggctgcacggcaccatccagacccaccaggagagacccagagtgcagaaccaggtgatcctggaggagaacaccaccctgctgggcttccaggacaagcacttccagcaccaggccaccatcgccgagctggagctggagaagaccaagctgcaggagctgaccagaaagctgaaggagagagtgaccatcctggtgaagcagaaggacgtgctgagccacggcgagaaggaggaggagctgaaggccatgatgcacgacctgcagatcacctgcagcgagatgcagcagaaggtggagctgctgagatacgagagcgagaagctgcagcaggagaacagcatcctgagaaacgagatcaccaccctgaacgaggaggacagcatcagcaacctgaagctgggcaccctgaacggcagccaggaggagatgtggcagaagaccgagaccgtgaagcaggagaacgccgccgtgcagaagatggtggagaacctgaagaagcagatcagcgagctgaagatcaagaaccagcagctggacctggagaacaccgagctgagccagaagaacagccagaaccaggagaagctgcaggagctgaaccagagactgaccgagatgctgtgccagaaggagaaggagcccggcaacagcgccctggaggagagagagcaggagaagttcaacctgaaggaggagctggagagatgcaaggtgcagagcagcaccctggtgagcagcctggaggccgagctgagcgaggtgaagatccagacccacatcgtgcagcaggagaaccacctgctgaaggacgagctggagaagatgaagcagctgcacagatgccccgacctgagcgacttccagcagaagatcagcagcgtgctgagctacaacgagaagctgctgaaggagaaggaggccctgagcgaggagctgaacagctgcgtggacaagctggccaagagcagcctgctggagcacagaatcgccaccatgaagcaggagcagaagagctgggagcaccagagcgccagcctgaagagccagctggtggccagccaggagaaggtgcagaacctggaggacaccgtgcagaacgtgaacctgcagatgagcagaatgaagagcgacctgagagtgacccagcaggagaaggaggccctgaagcaggaggtgatgagcctgcacaagcagctgcagaacgccggcggcaagagctgggcccccgagatcgccacccaccccagcggcctgcacaaccagcagaagagactgagctgggacaagctggaccacctgatgaacgaggagcagcagctgctgtggcaggagaacgagagactgcagaccatggtgcagaacaccaaggccgagctgacccacagcagagagaaggtgagacagctggagagcaacctgctgcccaagcaccagaagcacctgaaccccagcggcaccatgaaccccaccgagcaggagaagctgagcctgaagagagagtgcgaccagttccagaaggagcagagccccgccaacagaaaggtgagccagatgaacagcctggagcaggagctggagaccatccacctggagaacgagggcctgaagaagaagcaggtgaagctggacgagcagctgatggagatgcagcacctgagaagcaccgccacccccagccccagcccccacgcctgggacctgcagctgctgcagcagcaggcctgccccatggtgcccagagagcagttcctgcagctgcagagacagctgctgcaggccgagagaatcaaccagcacctgcaggaggagctggagaacagaaccagcgagaccaacaccccccaggccctgctgcccgagcagagagccgtgcacgccgacagctacagaagaatcggccacctgtag

SEQ ID NO: 12610 - DNA, 1203 bp, Artificial Sequence
  Description of Artificial Sequence: Synthetic coding sequence
atggccggcgagaaccaccagtggcagggcagcatcctgtacaacatgctgatgagcgccaagcagaccagagccgcccccgaggcccccgagaccagactggtggaccagtgctggggctgcagctgcggcgacgagcccggcgtgggcagagagggcctgctgggcggcagaaacgtggccctgctgtacagatgctgcttctgcggcaaggaccaccccagacagggcagcatcctgtacagcatgctgaccagcgccaagcagacctacgccgcccccaaggcccccgaggccaccctgggcccctgctggggctgcagctgcggcagcgaccccggcgtgggcagagccggcctgcccggcggcagacccgtggccctgctgtacagatgctgcttctgcggcgaggaccaccccagacagggcagcatcctgtacagcctgctgaccagcagcaagcagacccacgtggcccccgccgcccccgaggccagacccggcggcgcctggtgggacagaagctacttcgcccagagacccggcggcaaggaggccctgcccggcggcagagccaccgccctgctgtacagatgctgcttctgcggcgaggaccacccccagcagggcagcaccctgtactgcgtgcccaccagcaccaaccaggcccaggccgcccccgaggagagacccagagccccctggtgggacaccagcagcggcgccctgagacccgtggccctgaagagcccccaggtggtgtgcgaggccgccagcgccggcctgctgaagaccctgagattcgtgaagtacctgccctgcttccaggtgctgcccctggaccagcagctggtgctggtgagaaactgctgggccagcctgctgatgctggagctggcccaggacagactgcagttcgagaccgtggaggtgagcgagcccagcatgctgcagaagatcctgaccaccagaagaagagagaccggcggcaacgagcccctgcccgtgcccaccctgcagcaccacctggccccccccgccgaggccagaaaggtgcccagcgccagccaggtgcaggccatcaagtgcttcctgagcaagtgctggagcctgaacatcagcaccaaggagtacgcctacctgaagggcaccgtgctgttcaaccccggcaagggcaaggagaacgactgcaaccaccactag

SEQ ID NO: 12611 - DNA, 627 bp, Artificial Sequence
  Description of Artificial Sequence: Synthetic coding sequence
atgaagcagctggaggaccacgaggccttcgagaccagcagcctgatcggccacagcgccagagtgtacgccctgtactacaaggacggcctgctgtgcaccggcagcgacgacctgagcgccaagctgtgggacgtgagcaccggccagtgcgtgtacggcatccagacccacacctgcgccgccgtgaagttcgacgagcagaagctggtgaccggcagcttcgacaacaccgtggcctgctgggagtggagcagcggcgccagaacccagcacttcagaggccacaccggcgccgtgttcagcgtggactacaacgacgagctggacatcctggtgagcggcagcgccgacttcaccgtgaaggtgtgggccctgagcgccggcacctgcctgaacaccctgaccggccacaccgagtgggtgaccaaggtggtgctgcagaagtgcaaggtgaagagcctgctgcacagccccggcgactacatcctgctgagcgccgacaagtacgagatcaagatctggcccatcggcagagagatcaactgcaagtgcctgaagaccctgagcgtgagcgaggacagaagcatctgcctgcagcccagactgcacttcgacggcaagtag

SEQ ID NO: 12612 - DNA, 639 bp, Artificial Sequence
  Description of Artificial Sequence: Synthetic coding sequence
atgttcggcgtgaccaagttcggcgacaacatcgaggacgagtggttcatcgtgtacgtgatcaagcagatcaccaaggagttccccgagctggtggccagaatcgaggacaacgacggcgagttcctgctgatcgaggccgccgacttcctgcccaagtggctggaccccgagaacagcaccaacagagtgttcttctgccacggcgagctgtgcatcatccccgcccccagaaagagcggcgccgagagctggctgcccaccaccccccccaccatcccccaggccctgaacatcatcaccgcccacagcgagaagatcctggccagcgagagcatcagagccgccgtgaacagaagaatcagaggctaccccgagaagatccaggccagcctgcacagagcccactgcttcctgcccgccggcatcgtggccgtgctgaagcagagacccagactggtggccgccgccgtgcaggccttctacctgagagaccccatcgacctgagagcctgcagagtgttcaagaccttcctgcccgagaccagaatcatgaccagcgtgaccttcaccaagtgcctgtacgcccagctggtgcagcagagattcgtgcccgacagaagaagcggctacagatag

SEQ ID NO: 12613 - DNA, 474 bp, Artificial Sequence; identical to SEQ ID NO: 11812
  Description of Artificial Sequence: Synthetic coding sequence

SEQ ID NO: 12614 - DNA, 4773 bp, Artificial Sequence
  Description of Artificial Sequence: Synthetic coding sequence
atgagcgccaccagctggttcctggtgagcagcagcggcgccagacacagactgcccagagagctgatcttcgtgggcagagaggagtgcgagctgatgctgcagagcagaagcgtggacaagcagcacgccgtgatcaactacgaccaggacagagacgagcactgggtgaaggacctgggcagcctgaacggcaccttcgtgaacgacatgagaatccccgaccagaagtacgtgaccctgaagctgaacgacgtgatcagattcggctacgacagcaacatgtacgtgctggagagagtgcagcacagagtgcccgaggaggccctgaagcacgagaagtacaccagccagctgcaggtgagcgtgaagggcctggcccccaagagaagcgaggccctgcccgagcacaccccctactgcgaggccagcaaccccagacccgagaagggcgacagaagacccggcaccgaggccgccagctacagaacccccctgtacggccagcccagctggtggggcgaggacgacggcagcaccctgcccgacgcccagagacagggcgagccctaccccgccgagagacccaagggccccgtgcagcaggacggcgagctgcacggcttcagagcccccgccgagccccagggctgcagcttcagaagagagcccagctacttcgagatccccaccaaggagaccccccagcccagccagccccccgaggtgcccgcccacgagatgcccaccaaggacgccgaggccggcggcggcggcgccgcccccgtggtgcagagccacgccagcttcaccatcgagttcgacgactgcagccccggcaagatgaagatcaaggaccacatcaccaagttcagcctgagacagagaagaccccccggcaaggaggccacccccggcgagatggtgagcgccgagaccaaggtggccgactggctggtgcagaacgaccccagcctgctgcacagagtgggccccggcgacgacagacacagcaccaagagcgacctgcccgtgcacaccagaaccctgaagggccacaagcacgaggacggcacccagagcgacagcgaggaccccctggccaaggccgccagcgccgccggcgtgcccctggaggccagcggcgagcaggtgagactgcagagacagatcaagagagacccccaggagctgctgcacaaccagcaggccttcgtgatcgagttcttcgacgaggacacccccagaaagaagagaagccagagcttcacccacagccccagcggcgaccccaaggccgacaagagaagaggccccacccccgccgacagagacagacccagcgtgcccgcccccgtgcaggccggcggcagaagcagcggcccccagagagccggcagcctgaagagagagaagaccgaggagagactgggcagccccagccccgccagcagaacccccgccagacccttcggcagcgtgggcagaagaagcagactggcccaggacttcatggcccagtgcctgagagagagcagccccgccgccagacccagccccgagaaggtgccccccgtgctgcccgcccccctgaccccccacggcaccagccccgtgggcccccccacccccccccccgcccccaccgacccccagctgaccaaggccagaaagcaggaggaggacgacagcctgagcgacgccggcacctacaccatcgagaccgaggcccaggacaccgaggtggaggaggccagaaagatgatcgaccaggtgttcggcgtgctggagagccccgagctgagcagagccagcagcgccaccttcagacccgtgatcagaggcgacagagacgagagcgacgacggcggcgtggcccagagaatggccctgctgcaggagttcgccagcagacccctgggcgccgccccccaggccgagcaccagggcctgcccgtgcccggcagccccggcggccagaagtgggtgagcagatgggccagcctggccgacagctacagcgaccccggcctgaccgaggacggcctgggcagaagaggcggcgagcccgagggcagcctgcccgtgagaatgagaagaagactgccccagctgcccagcgagagagccgacagccccgccggccccgagagcagcagaagaagcggccccggcccccccgagctggacagcgagcagcccagcagactgttcggccaggaggagctggaccccgacagcctgagcgacgccagcggcagcgacggcggcagaggccccgagcccggcgtggagccccaggacagcagaagaagaagcccccaggagggccccacctggagcagaggcagaagaagccccagagcccccggcgagcccacccccgccagcttcttcatcggcgaccagaacggcgacgccgtgctgagcagaaagcccctggccgcccccggcgacggcgagggcctgggccagaccgcccagcccagcccccccgccagagacggcgtgtacgtgagcgccaacggcagaatggtgatccagctgagacccggcagaagccccgagcccgacggccccgcccccgccttcctgagacaggagagcttcaccaaggagcccgccagcggcccccccgcccccggcaagcccccccacatcagcagccaccccctgctgcaggacctggccgccaccagagccgccagaatggacttccacagccaggacacccacctgatcctgaaggagaccgagaccgccctggccgccctggaggccagactgctgagcaacagcgtggacgccgagtgcgagggcggcagcacccccagaccccccgaggacgccctgagcggcgacagcgacgtggacaccgccagcaccgtgagcctgagaagcggcaagagcggccccagccccaccaccccccagcccctgagagcccagaaggagatgagccccagcccccccgccgcccaggaccccggcggcaccgccctggtgagcgccagagagcagagcagcgagagacagcaccaccccctgggccccaccgacatgggcagaggcgagcccgtgagaagaagcgccatcagaagaggccacagacccagaggcagcctggactggcccagcgaggagagaggccccgtgctggcccacctgcccagcagcgacgtgatggccagcaaccacgagacccccgaggccaccggcgccggcagactgggcagcagaagaaagcccgccgcccccccccccagccccgccgccagagaggagcagagcagaagcagcgccagcagccagaagggcccccaggccctgaccagaagcaacagcctgagcacccccagacccaccagagccagcagactgagaagagccagactgggcgacgccagcgacaccgaggccgccgacggcgagagaggcagcctgggcaaccccgagcccgtgggcagacccgccgccgagcaggccaagaagctgagcagactggacatcctggccatgcccagaaagagagccggcagcttcaccggcaccagcgaccccgaggccgcccccgccagaaccagcttcagcggcagaagcgtggagctgtgctgcgccagcagaaagcccaccatggccgaggccagagccgtgagcagaaaggccgccaacaccgccaccaccaccggccccagacagcccttcagcagagccagaagcggcagcgccagatacaccagcaacaccagaagaagacagcagggcagcgactacaccagcaccagcgaggaggagtacggcagcagacacggcagccccaagcacaccagaagccacaccagcaccgccacccagacccccagagccggcagcagcagcagagccagaagcagagcccccggccccagagacaccgacgacgacgaggaggagcccgacccctacggcttcatcgtgcagaccgccgagatcgccgagatcgccagactgagccagaccctggtgaaggacgtggccatcctggcccaggagatccacgacgtggccggcgacggcgacaccctgggcagcagcgagcccgcccacagcgccagcctgagcaacatgcccagcacccccgccagcaccatcagcgccagagaggagctggtgcagagaatccccgaggccagcctgaacttccagaaggtgccccccggcagcctgaacagcagagacttcgaccagaacatgaacgacagctgcgaggacgccctggccaacaagaccagacccagaaacagagaggaggtgatcttcgacaacctgatgctgaaccccgtgagccagctgagccaggccatcagagagaacaccgagcacctggccgagaagatgaagatcctgttccagaacaccggcagagcctgggaggacctggaggccagaatcaacgccgagaacgaggtgcccatcctgaagaccagcaacaaggagatcagcagcatcctgaaggagctgagaagagtgcagaagcagctggaggtgatcaacgccatcgtggaccccagcggcagcctggacctgctgaccggcaacagaagcctggccagcagcgcccagcccggcctgggcaagggcagagtggccgcccagagcccccccagccccgccagcgccgaggccctgctgcccgccctgcccctgagaaacttcccccagagagccagctgcggcccccccagcctgcccgaccccaccttcctgcccgacgccgagagattcctgatctag

SEQ ID NO: 12615 - DNA, 1452 bp, Artificial Sequence
  Description of Artificial Sequence: Synthetic coding sequence
atgagcggcggcggccccagcggcggcggccccggcggcagcggcagagccagaaccagcagcttcgccgagcccggcggcggcggcggcggcggcggcggcggccccggcggcagcgccagcggccccggcggcaccggcggcggcaaggccagcgtgggcgccatgggcggcggcgtgggcgccagcagcagcggcggcggccccggcggcagcggcggcggcggcagcggcggccccggcgccggcaccagcttccccccccccggcgtgaagctgggcagagacagcggcaaggtgaccaccgtggtggccaccctgggccagggccccgagagaagccaggaggtggcctacaccgacatcaaggtgatcggcaacggcagcttcggcgtggtgtaccaggccagactggccgagaccagagagctggtggccatcaagaaggtgctgcaggacaagagattcaagaacagagagctgcagatcatgagaaagctggaccactgcaacatcgtgagactgagatacttcttctacagcagcggcgagaagaaggacgagctgtacctgaacctggtgctggagtacgtgcccgagaccgtgtacagagtggccagacacttcaccaaggccaagctgaccatccccatcctgtacgtgaaggtgtacatgtaccagctgttcagaagcctggcctacatccacagccagggcgtgtgccacagagacatcaagccccagaacctgctggtggaccccgacaccgccgtgctgaagctgtgcgacttcggcagcgccaagcagctggtgagaggcgagcccaacgtgagctacatctgcagcagatactacagagcccccgagctgatcttcggcgccaccgactacaccagcagcatcgacgtgtggagcgccggctgcgtgctggccgagctgctgctgggccagcccatcttccccggcgacagcggcgtggaccagctggtggagatcatcaaggtgctgggcacccccaccagagagcagatcagagagatgaaccccaactacaccgagttcaagttcccccagatcaaggcccacccctggaccaaggtgttcaagagcagaaccccccccgaggccatcgccctgtgcagcagcctgctggagtacacccccagcagcagactgagccccctggaggcctgcgcccacagcttcttcgacgagctgagatgcctgggcacccagctgcccaacaacagacccctgccccccctgttcaacttcagcgccggcgagctgagcatccagcccagcctgaacgccatcctgatccccccccacctgagaagccccgccggcaccaccaccctgacccccagcagccaggccctgaccgagacccccaccagcagcgactggcagagcaccgacgccacccccaccctgaccaacagcagctag

SEQ ID NO: 12616 - DNA, 1389 bp, Artificial Sequence
  Description of Artificial Sequence: Synthetic coding sequence
atgggcggcgccgaggccgagccctggggcagagcccccggccccgccatcggcggcagaagagccggcgacagctgccccggctggagaagaagaagcagaagcagaggcagaggccagagactgagccacggccccagaagaagaccccagctgctgaccgccgccccccccctgcaggccagaggcgccttcagaagcttcccccacagctggggcgaggacttcctggccagcctgatgttcaagatccagctggagcccctgaagctgagagcctggaccctgaacggcttcgtgaagttcagaaacaaggagaccagcgccggccccgtggccgtgatgggcaaggactactacaagatcctgggcatccccagcggcgccaacgaggacgagatcaagaaggcctacagaaagatggccctgaagtaccaccccgacaagaacaaggagcccaacgccgaggagaagttcaaggagatcgccgaggcctacgacgtgctgagcgaccccaagaagagaggcctgtacgaccagtacggcgaggagggcctgaagaccggcggcggcaccagcggcggcagcagcggcagcttccactacaccttccacggcgacccccacgccaccttcgccagcttcttcggcggcagcaaccccttcgacatcttcttcgccagcagcagaagcaccagacccttcagcggcttcgaccccgacgacatggacgtggacgaggacgaggaccccttcggcgccttcggcagattcggcttcaacggcctgagcagaggccccagaagagcccccgagcccctgtaccccagaagaaaggtgcaggacccccccgtggtgcacgagctgagagtgagcctggaggagatctaccacggcagcaccaagagaatgaagatcaccagaagaagactgaaccccgacggcagaaccgtgagaaccgaggacaagatcctgcacatcgtgatcaagagaggctggaaggagggcaccaagatcaccttccccaaggagggcgacgccacccccgacaacatccccgccgacatcgtgttcgtgctgaaggacaagccccacgcccacttcagaagagacggcaccaacgtgctgtacagcgccctgatcagcctgaaggaggccctgtgcggctgcaccgtgaacatccccaccatcgacggcagagtgatccccctgccctgcaacgacgtgatcaagcccggcaccgtgaagagactgagaggcgagggcctgcccttccccaaggtgcccacccagagaggcgacctgatcgtggagttcaaggtgagattccccgacagactgaccccccagaccagacagatcctgaagcagcacctgccctgcagctag

SEQ ID NO: 12617 - DNA, 279 bp, Artificial Sequence
  Description of Artificial Sequence: Synthetic coding sequence
gtgtacggcgccaaggacatcgagctgagccccgaggcccaggccaagatcgacagatacacccagcagggcttcggcaacctgcccatctgcatggccaagacccacctgagcctgagccaccagcccgacaagaagggcgtgcccagagacttcatcctgcccatcagcgacgtgagagccagcatcggcgccggcttcatctaccccctggtgggcaccagaagcagccccctggccctggtgggcgagagccagcccaagcaggtgcacccctag

SEQ ID NO: 12618 - DNA, 468 bp, Artificial Sequence
  Description of Artificial Sequence: Synthetic coding sequence
atgagcgtgacctacgacgacagcgtgggcgtggaggtgagcagcgacagcttctgggaggtgggcaactacaagagaaccgtgaagagaatcgacgacggccacagactgtgcagcgacctgatgaactgcctgcacgagagagccagaatcgagaaggcctacgcccagcagctgaccgagtgggccagaagatggagacagctggtggagaagggcccccagtacggcaccgtggagaaggcctggatggccttcatgagcgaggccgagagagtgagcgagctgcacctggaggtgaaggccagcctgatgaacgacgacttcgagaagatcaagaactggcagaaggaggccttccacaagcagatgatgggcggcttcaaggagaccaaggaggccgaggacggcttcagaaaggcccagaagccctgggccaagaagctgaaggaggtgcacctgagctag

SEQ ID NO: 12619 - DNA, 483 bp, Artificial Sequence; identical to SEQ ID NO: 10977
  Description of Artificial Sequence: Synthetic coding sequence

SEQ ID NO: 12620 - DNA, 660 bp, Artificial Sequence; identical to SEQ ID NO: 12147
  Description of Artificial Sequence: Synthetic coding sequence

SEQ ID NO: 12621 - DNA, 318 bp, Artificial Sequence
  Description of Artificial Sequence: Synthetic coding sequence
atgaacatgatctggagaaacagcatcagctgcctgagactgggcaaggtgccccacagataccagagcggctaccaccccgtggcccccctgggcagcagaatcctgaccgaccccgccaaggtgttcgagcacaacatgtgggaccacatgcagtggagcaaggaggaggaggccgccgccagaaagaaggtgaaggagaacagcgccgtgagagtgctgctggaggagcaggtgaagtacgagagagaggccagcaagtactgggacaccttctacaagatccacaagaacaagttcttcaaggacagaaactag

SEQ ID NO: 12622 - DNA, 366 bp, Artificial Sequence
  Description of Artificial Sequence: Synthetic coding sequence
tgagagggcgagagccccaccgccagcccccacagcagcgccaccgacgacctgcaccacagcgacagataccagaccttcctgagagtgagagccaacagacagaccagactgaacgccagaatcggcaagatgaagagaagaaagcaggacgagggccaggtgtgccccctgtgcaacagacccctggccggcagcgagcaggagatgagcagacacgtggagcactgcctgagcaagagagagggcagctgcatggccgaggacgacgccgtggacatcgagcacgagaacaacaacagattcgaggagtacgagtggtgcggccagaagagaatcagagccaccaccctgctggagggctag

SEQ ID NO: 12623 - DNA, 1701 bp, Artificial Sequence; identical to SEQ ID NO: 10391
  Description of Artificial Sequence: Synthetic coding sequence

SEQ ID NO: 12624 - DNA, 4719 bp, Artificial Sequence
  Description of Artificial Sequence: Synthetic coding sequence
atgctgctgcacctgtgcagcgtgaagaacctgtaccagaacagattcctgggcctggccgccatggccagccccagcagaaacagccagagcagaagaagatgcaaggagcccctgagatacagctacaaccccgaccagttccacaacatggacctgagaggcggcccccacgacggcgtgaccatccccagaagcaccagcgacaccgacctggtgaccagcgacagcagaagcaccctgatggtgagcagcagctactacagcatcggccacagccaggacctggtgatccactgggacatcaaggaggaggtggacgccggcgactggatcggcatgtacctgatcgacgaggtgctgagcgagaacttcctggactacaagaacagaggcgtgaacggcagccacagaggccagatcatctggaagatcgacgccagcagctacttcgtggagcccgagaccaagatctgcttcaagtactaccacggcgtgagcggcgccctgagagccaccacccccagcgtgaccgtgaagaacagcgccgcccccatcttcaagagcatcggcgccgacgagaccgtgcagggccagggcagcagaagactgatcagcttcagcctgagcgacttccaggccatgggcctgaagaagggcatgttcttcaaccccgacccctacctgaagatcagcatccagcccggcaagcacagcatcttccccgccctgccccaccacggccaggagagaagaagcaagatcatcggcaacaccgtgaaccccatctggcaggccgagcagttcagcttcgtgagcctgcccaccgacgtgctggagatcgaggtgaaggacaagttcgccaagagcagacccatcatcaagagattcctgggcaagctgagcatgcccgtgcagagactgctggagagacacgccatcggcgacagagtggtgagctacaccctgggcagaagactgcccaccgaccacgtgagcggccagctgcagttcagattcgagatcaccagcagcatccaccccgacgacgaggagatcagcctgagcaccgagcccgagagcgcccagatccaggacagccccatgaacaacctgatggagagcggcagcggcgagcccagaagcgaggcccccgagagcagcgagagctggaagcccgagcagctgggcgagggcagcgtgcccgacggccccggcaaccagagcatcgagctgagcagacccgccgaggaggccgccgtgatcaccgaggccggcgaccagggcatggtgagcgtgggccccgagggcgccggcgagctgctggcccaggtgcagaaggacatccagcccgcccccagcgccgaggagctggccgagcagctggacctgggcgaggaggccagcgccctgctgctggaggacggcgaggcccccgccagcaccaaggaggagcccctggaggaggaggccaccacccagagcagagccggcagagaggaggaggagaaggagcaggaggaggagggcgacgtgagcaccctggagcagggcgagggcagactgcagctgagagccagcgtgaagagaaagagcagaccctgcagcctgcccgtgagcgagctggagaccgtgatcgccagcgcctgcggcgaccccgagacccccagaacccactacatcagaatccacaccctgctgcacagcatgcccagcgcccagggcggcagcgccgccgaggaggaggacggcgccgaggaggagagcaccctgaaggacagcagcgagaaggacggcctgagcgaggtggacaccgtggccgccgaccccagcgccctggaggaggacagagaggagcccgagggcgccacccccggcaccgcccaccccggccacagcggcggccacttccccagcctggccaacggcgccgcccaggacggcgacacccaccccagcaccggcagcgagagcgacagcagccccagacagggcggcgaccacagctgcgagggctgcgacgccagctgctgcagccccagctgctacagcagcagctgctacagcaccagctgctacagcagcagctgctacagcgccagctgctacagccccagctgctacaacggcaacagattcgccagccacaccagattcagcagcgtggacagcgccaagatcagcgagagcaccgtgttcagcagccaggacgacgaggaggaggagaacagcgccttcgagagcgtgcccgacagcatgcagagccccgagctggaccccgagagcaccaacggcgccggcccctggcaggacgagctggccgcccccagcggccacgtggagagaagccccgagggcctggagagccccgtggccggccccagcaacagaagagaggactgggaggccagaatcgacagccacggcagagtgttctacgtggaccacgtgaacagaaccaccacctggcagagacccaccgccgccgccacccccgacggcatgagaagaagcggcagcatccagcagatggagcagctgaacagaagataccagaacatccagagaaccatcgccaccgagagaagcgaggaggacagcggcagccagagctgcgagcaggcccccgccggcggcggcggcggcggcggcagcgacagcgaggccgagagcagccagagcagcctggacctgagaagagagggcagcctgagccccgtgaacagccagaagatcaccctgctgctgcagagccccgccgtgaagttcatcaccaaccccgagttcttcaccgtgctgcacgccaactacagcgcctacagagtgttcaccagcagcacctgcctgaagcacatgatcctgaaggtgagaagagacgccagaaacttcgagagataccagcacaacagagacctggtgaacttcatcaacatgttcgccgacaccagactggagctgcccagaggctgggagatcaagaccgaccagcagggcaagagcttcttcgtggaccacaacagcagagccaccaccttcatcgaccccagaatccccctgcagaacggcagactgcccaaccacctgacccacagacagcacctgcagagactgagaagctacagcgccggcgaggccagcgaggtgagcagaaacagaggcgccagcctgctggccagacccggccacagcctggtggccgccatcagaagccagcaccagcacgagagcctgcccctggcctacaacgacaagatcgtggccttcctgagacagcccaacatcttcgagatgctgcaggagagacagcccagcctggccagaaaccacaccctgagagagaagatccactacatcagaaccgagggcaaccacggcctggagaagctgagctgcgacgccgacctggtgatcctgctgagcctgttcgaggaggagatcatgagctacgtgcccctgcaggccgccttccaccccggctacagcttcagccccagatgcagcccctgcagcagcccccagaacagccccggcctgcagagagccagcgccagagcccccagcccctacagaagagacttcgaggccaagctgagaaacttctacagaaagctggaggccaagggcttcggccagggccccggcaagatcaagctgatcatcagaagagaccacctgctggagggcaccttcaaccaggtgatggcctacagcagaaaggagctgcagagaaacaagctgtacgtgaccttcgtgggcgaggagggcctggactacagcggccccagcagagagttcttcttcctgctgagccaggagctgttcaacccctactacggcctgttcgagtacagcgccaacgacacctacaccgtgcagatcagccccatgagcgccttcgtggagaaccacctggagtggttcagattcagcggcagaatcctgggcctggccctgatccaccagtacctgctggacgccttcttcaccagacccttctacaaggccctgctgagactgccctgcgacctgagcgacctggagtacctggacgaggagttccaccagagcctgcagtggatgaaggacaacaacatcaccgacatcctggacctgaccttcaccgtgaacgaggaggtgttcggccaggtgaccgagagagagctgaagagcggcggcgccaacacccaggtgaccgagaagaacaagaaggagtacatcgagagaatggtgaagtggagagtggagagaggcgtggtgcagcagaccgaggccctggtgagaggcttctacgaggtggtggacagcagactggtgagcgtgttcgacgccagagagctggagctggtgatcgccggcaccgccgagatcgacctgaacgactggagaaacaacaccgagtacagaggcggctaccacgacggccacctggtgatcagatggttctgggccgccgtggagagattcaacaacgagcagagactgagactgctgcagttcgtgaccggcaccagcagcgtgccctacgagggcttcgccgccctgagaggcagcaacggcctgagaagattctgcatcgagaagtggggcaagatcaccagcctgcccagagcccacacctgcttcaacagactggacctgcccccctaccccagctacagcatgctgtacgagaagctgctgaccgccgtggaggagaccagcaccttcggcctggagtag

SEQ ID NO: 12625 - DNA, 1629 bp, Artificial Sequence
  Description of Artificial Sequence: Synthetic coding sequence
atgagcggcctggtgctgggccagagagacgagcccgccggccacagactgagccaggaggagatcctgggcagcaccagactggtgagccagggcctggaggccctgagaagcgagcaccaggccgtgctgcagagcctgagccagaccatcgagtgcctgcagcagggcggccacgaggagggcctggtgcacgagaaggccagacagctgagaagaagcatggagaacatcgagctgggcctgagcgaggcccaggaggagaaggagggcgacgccaccaaggacagcctggacgacctgttccccaacgaggaggaggaggaccccagcaacggcctgagcagaggccagggcgccaccgccgcccagcagggcggctacgagatccccgccagactgagaaccctgcacaacctggtgatccagtacgccgcccagggcagatacgaggtggccgtgcccctgtgcaagcaggccctggaggacctggagagaaccagcggcagaggccaccccgacgtggccaccatgctgaacatcctggccctggtgtacagagaccagaacaagtacaaggaggccgcccacctgctgaacgacgccctgagcatcagagagagcaccctgggccccgaccaccccgccgtggccgccaccctgaacaacctggccgtgctgtacggcaagagaggcaagtacaaggaggccgagcccctgtgccagagagccctggagatcagagagaaggtgctgggcaccaaccaccccgacgtggccaagcagctgaacaacctggccctgctgtgccagaaccagggcaagtacgaggccgtggagagatactaccagagagccctggccatctacgagggccagctgggccccgacaaccccaacgtggccagaaccaagaacaacctggccagctgctacctgaagcagggcaagtacgccgaggccgagaccctgtacaaggagatcctgaccagagcccacgtgcaggagttcggcagcgtggacgacgaccacaagcccatctggatgcacgccgaggagagagaggagatgagcaagagcagacaccacgagggcggcaccccctacgccgagtacggcggctggtacaaggcctgcaaggtgagcagccccaccgtgaacaccaccctgagaaacctgggcgccctgtacagaagacagggcaagctggaggccgccgagaccctggaggagtgcgccctgagaagcagaagacagggcaccgaccccatcagccagaccaaggtggccgagctgctgggcgagagcgacggcagaagaaccagccaggagggccccggcgacagcgtgaagttcgagggcggcgaggacgccagcgtggccgtggagtggagcggcgacggcagcggcaccctgcagagaagcggcagcctgggcaagatcagagacgtgctgagaagaagcagcgagctgctggtgagaaagctgcagggcaccgagcccagacccagcagcagcaacatgaagagagccgccagcctgaactacctgaaccagcccagcgccgcccccctgcaggtgagcagaggcctgagcgccagcaccatggacctgagcagcagcagctag

SEQ ID NO: 12626 - DNA, 1548 bp, Artificial Sequence
  Description of Artificial Sequence: Synthetic coding sequence
atgtgccaggtgggcgaggactacggcgagcccgcccccgaggagcccccccccgcccccagacccagcagagagcagaagtgcgtgaagtgcaaggaggcccagcccgtggtggtgatcagagccggcgacgccttctgcagagactgcttcaaggccttctacgtgcacaagttcagagccatgctgggcaagaacagactgatcttccccggcgagaaggtgctgctggcctggagcggcggccccagcagcagcagcatggtgtggcaggtgctggagggcctgagccaggacagcgccaagagactgagattcgtggccggcgtgatcttcgtggacgagggcgccgcctgcggccagagcctggaggagagaagcaagaccctggccgaggtgaagcccatcctgcaggccaccggcttcccctggcacgtggtggccctggaggaggtgttcagcctgccccccagcgtgctgtggtgcagcgcccaggagctggtgggcagcgagggcgcctacaaggccgccgtggacagcttcctgcagcagcagcacgtgctgggcgccggcggcggccccggccccacccagggcgaggagcagcccccccagccccccctggacccccagaacctggccagaccccccgcccccgcccagaccgaggccctgagccagctgttctgcagcgtgagaaccctgaccgccaaggaggagctgctgcagaccctgagaacccacctgatcctgcacatggccagagcccacggctacagcaaggtgatgaccggcgacagctgcaccagactggccatcaagctgatgaccaacctggccctgggcagaggcgccttcctggcctgggacaccggcttcagcgacgagagacacggcgacgtggtggtggtgagacccatgagagaccacaccctgaaggaggtggccttctacaacagactgttcagcgtgcccagcgtgttcacccccgccgtggacaccaaggcccccgagaaggccagcatccacagactgatggaggccttcatcctgagactgcagacccagttccccagcaccgtgagcaccgtgtacagaaccagcgagaagctggtgaagggccccagagacggccccgccgccggcgacagcggccccagatgcctgctgtgcatgtgcgccctggacgtggacgccgccgacagcgccaccgccttcggcgcccagaccagcagcagactgagccagatgcagagccccatccccctgaccgagaccagaaccccccccggcccctgctgcagccccggcgtgggctgggcccagagatgcggccagggcgcctgcagaagagaggacccccaggcctgcatcgaggagcagctgtgctacagctgcagagtgaacatgaaggacctgcccagcctggaccccctgcccccctacatcctggccgaggcccagctgagaacccagagagcctggggcctgcaggagatcagagactgcctgatcgaggacagcgacgacgaggccggccagagctag

SEQ ID NO: 12627 - DNA, 1263 bp, Artificial Sequence
  Description of Artificial Sequence: Synthetic coding sequence
atgttcaagagaaccgtgctgagctgccccccccccgccgccccccccctgcaggccagaggcgccttcagaagcttcccccacagctggggcgaggacttcctggccagcctgatgttcaagatccagctggagcccctgaagctgagagcctggaccctgaacggcttcgtgaagttcagaaacaaggagaccagcgccggccccgtggccgtgatgggcaaggactactacaagatcctgggcatccccagcggcgccaacgaggacgagatcaagaaggcctacagaaagatggccctgaagtaccaccccgacaagaacaaggagcccaacgccgaggagaagttcaaggagatcgccgaggcctacgacgtgctgagcgaccccaagaagagaggcctgtacgaccagtacggcgaggagggcctgaagaccggcggcggcaccagcggcggcagcagcggcagcttccactacaccttccacggcgacccccacgccaccttcgccagcttcttcggcggcagcaaccccttcgacatcttcttcgccagcagcagaagcaccagacccttcagcggcttcgaccccgacgacatggacgtggacgaggacgaggaccccttcggcgccttcggcagattcggcttcaacggcctgagcagaggccccagaagagcccccgagcccctgtaccccagaagaaaggtgcaggacccccccgtggtgcacgagctgagagtgagcctggaggagatctaccacggcagcaccaagagaatgaagatcaccagaagaagactgaaccccgacggcagaaccgtgagaaccgaggacaagatcctgcacatcgtgatcaagagaggctggaaggagggcaccaagatcaccttccccaaggagggcgacgccacccccgacaacatccccgccgacatcgtgttcgtgctgaaggacaagccccacgcccacttcagaagagacggcaccaacgtgctgtacagcgccctgatcagcctgaaggaggccctgtgcggctgcaccgtgaacatccccaccatcgacggcagagtgatccccctgccctgcaacgacgtgatcaagcccggcaccgtgaagagactgagaggcgagggcctgcccttccccaaggtgcccacccagagaggcgacctgatcgtggagttcaaggtgagattccccgacagactgaccccccagaccagacagatcctgaagcagcacctgccctgcagctag

SEQ ID NO: 12628 - DNA, 2979 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccagcacatgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagcctgttcagcagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggacagcctgagaaagaaggacgacagaatcgaggagctggaggaggccctgagagagagcgtgcagatcaccgccgagagagagatggtgctggcccaggaggagagcgccagaaccaacgccgagaagcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccaggacgaggaggagggcatctgggcctag

SEQ ID NO: 12629 - DNA, 180 bp, Artificial Sequence
  Description of Artificial Sequence: Synthetic coding sequence
atggagcccagcgcccagcagctgcagctggccgccagcctgcccgccaacctgagcaacttctgccagggcagcgagatgcccaccaccagcagacccgccctggacgtgaagggcggcaccagccccgccaaggaggacgccaaccaggagatgagcagcgtggcctacagcaactag

SEQ ID NO: 12630 - DNA, 6978 bp, Artificial Sequence
  Description of Artificial Sequence: Synthetic coding sequence
atgaagaagggcagccagcagaagatcttcagcaaggccaagatccccagcagcagccacagccccatccccagcagcatgagcaacatgagaagcagaagcctgagccccctgatcggcagcgagaccctgcccttccacagcggcggccagtggtgcgagcaggtggagatcgccgacgagaacaacatgctgctggactaccaggaccacaagggcgccgacagccacgccggcgtgagatacatcaccgaggccctgatcaagaagctgaccaagcaggacaacctggccctgatcaagagcctgaacctgagcctgagcaaggacggcggcaagaagttcaagtacatcgagaacctggagaagtgcgtgaagctggaggtgctgaacctgagctacaacctgatcggcaagatcgagaagctggacaagctgctgaagctgagagagctgaacctgagctacaacaagatcagcaagatcgagggcatcgagaacatgtgcaacctgcagaagctgaacctggccggcaacgagatcgagcacatccccgtgtggctgggcaagaagctgaagagcctgagagtgctgaacctgaagggcaacaagatcagcagcctgcaggacatcagcaagctgaagcccctgcaggacctgatcagcctgatcctggtggagaaccccgtggtgaccctgccccactacctgcagttcaccatcttccacctgagaagcctggagagcctggagggccagcccgtgaccacccaggacagacaggaggccttcgagagattcagcctggaggaggtggagagactggagagagacctggagaagaagatgatcgagaccgaggagctgaagagcaagcagaccagattcctggaggagatcaagaaccaggacaagctgaacaagagcctgaaggaggaggccatgctgcagaagcagagctgcgaggagctgaagagcgacctgaacaccaagaacgagctgctgaagcagaagaccatcgagctgaccagagcctgccagaagcagtacgagctggagcaggagctggccttctacaagatcgacgccaagttcgagcccctgaactactaccccagcgagtacgccgagatcgacaaggcccccgacgagagcccctacatcggcaagagcagatacaagagaaacatgttcgccaccgagagctacatcatcgacagcgcccaggccgtgcagatcaagaagatggagcccgacgagcagctgagaaacgaccacatgaacctgagaggccacacccccctggacacccagctggaggacaaggagaagaagatcagcgccgcccagaccagactgagcgagctgcacgacgagatcgagaaggccgagcagcagatcctgagagccaccgaggagttcaagcagctggaggaggccatccagctgaagaagatcagcgaggccggcaaggacctgctgtacaagcagctgagcggcagactgcagctggtgaacaagctgagacaggaggccctggacctggagctgcagatggagaagcagaagcaggagatcgccggcaagcagaaggagatcaaggacctgcagatcgccatcgacagcctggacagcaaggaccccaagcacagccacatgaaggcccagaagagcggcaaggagcagcagctggacatcatgaacaagcagtaccagcagctggagagcagactggacgagatcctgagcagaatcgccaaggagaccgaggagatcaaggacctggaggagcagctgaccgagggccagatcgccgccaacgaggccctgaagaaggacctggagggcgtgatcagcggcctgcaggagtacctgggcaccatcaagggccaggccacccaggcccagaacgagtgcagaaagctgagagacgagaaggagaccctgctgcagagactgaccgaggtggagcaggagagagaccagctggagatcgtggccatggacgccgagaacatgagaaaggagctggccgagctggagagcgccctgcaggagcagcacgaggtgaacgccagcctgcagcagacccagggcgacctgagcgcctacgaggccgagctggaggccagactgaacctgagagacgccgaggccaaccagctgaaggaggagctggagaaggtgaccagactgacccagctggagcagagcgccctgcaggccgagctggagaaggagagacaggccctgaagaacgccctgggcaaggcccagttcagcgaggagaaggagcaggagaacagcgagctgcacgccaagctgaagcacctgcaggacgacaacaacctgctgaagcagcagctgaaggacttccagaaccacctgaaccacgtggtggacggcctggtgagacccgaggaggtggccgccagagtggacgagctgagaagaaagctgaagctgggcaccggcgagatgaacatccacagccccagcgacgtgctgggcaagagcctggccgacctgcagaagcagttcagcgagatcctggccagaagcaagtgggagagagacgaggcccaggtgagagagagaaagctgcaggaggagatggccctgcagcaggagaagctggccaccggccaggaggagttcagacaggcctgcgagagagccctggaggccagaatgaacttcgacaagagacagcacgaggccagaatccagcagatggagaacgagatccactacctgcaggagaacctgaagagcatggaggagatccagggcctgaccgacctgcagctgcaggaggccgacgaggagaaggagagaatcctggcccagctgagagagctggagaagaagaagaagctggaggacgccaagagccaggagcaggtgttcggcctggacaaggagctgaagaagctgaagaaggccgtggccaccagcgacaagctggccaccgccgagctgaccatcgccaaggaccagctgaagagcctgcacggcaccgtgatgaagatcaaccaggagagagccgaggagctgcaggaggccgagagattcagcagaaaggccgcccaggccgccagagacctgaccagagccgaggccgagatcgagctgctgcagaacctgctgagacagaagggcgagcagttcagactggagatggagaagaccggcgtgggcaccggcgccaacagccaggtgctggagatcgagaagctgaacgagaccatggagagacagagaaccgagatcgccagactgcagaacgtgctggacctgaccggcagcgacaacaagggcggcttcgagaacgtgctggaggagatcgccgagctgagaagagaggtgagctaccagaacgactacatcagcagcatggccgaccccttcaagagaagaggctactggtacttcatgccccccccccccagcagcaaggtgagcagccacagcagccaggccaccaaggacagcggcgtgggcctgaagtacagcgccagcacccccgtgagaaagcccagacccggccagcaggacggcaaggagggcagccagcccccccccgccagcggctactgggtgtacagccccatcagaagcggcctgcacaagctgttccccagcagagacgccgacagcggcggcgacagccaggaggagagcgagctggacgaccaggaggagccccccttcgtgcccccccccggctacatgatgtacaccgtgctgcccgacggcagccccgtgccccagggcatggccctgtacgccccccccccccccctgcccaacaacagcagacccctgacccccggcaccgtggtgtacggccccccccccgccggcgcccccatggtgtacggcccccccccccccaacttcagcatccccttcatccccatgggcgtgctgcactgcaacgtgcccgagcaccacaacctggagaacgaggtgagcagactggaggacatcatgcagcacctgaagagcaagaagagagaggagagatggatgagagccagcaagagacagagcgagaaggagatggaggagctgcaccacaacatcgacgacctgctgcaggagaagaagagcctggagtgcgaggtggaggagctgcacagaaccgtgcagaagagacagcagcagaaggacttcatcgacggcaacgtggagagcctgatgaccgagctggagatcgagaagagcctgaagcaccacgaggacatcgtggacgagatcgagtgcatcgagaagaccctgctgaagagaagaagcgagctgagagaggccgacagactgctggccgaggccgagagcgagctgagctgcaccaaggagaagaccaagaacgccgtggagaagttcaccgacgccaagagaagcctgctgcagaccgagagcgacgccgaggagctggagagaagagcccaggagaccgccgtgaacctggtgaaggccgaccagcagctgagaagcctgcaggccgacgccaaggacctggagcagcacaagatcaagcaggaggagatcctgaaggagatcaacaagatcgtggccgccaaggacagcgacttccagtgcctgagcaagaagaaggagaagctgaccgaggagctgcagaagctgcagaaggacatcgagatggccgagagaaacgaggaccaccacctgcaggtgctgaaggagagcgaggtgctgctgcaggccaagagagccgagctggagaagctgaagagccaggtgaccagccagcagcaggagatggccgtgctggacagacagctgggccacaagaaggaggagctgcacctgctgcagggcagcatggtgcaggccaaggccgacctgcaggaggccctgagactgggcgagaccgaggtgaccgagaagtgcaaccacatcagagaggtgaagagcctgctggaggagctgagcttccagaagggcgagctgaacgtgcagatcagcgagagaaagacccagctgaccctgatcaagcaggagatcgagaaggaggaggagaacctgcaggtggtgctgagacagatgagcaagcacaagaccgagctgaagaacatcctggacatgctgcagctggagaaccacgagctgcagggcctgaagctgcagcacgaccagagagtgagcgagctggagaagacccaggtggccgtgctggaggagaagctggagctggagaacctgcagcagatcagccagcagcagaagggcgagatcgagtggcagaagcagctgctggagagagacaagagagagatcgagagaatgaccgccgagagcagagccctgcagagctgcgtggagtgcctgagcaaggagaaggaggacctgcaggagaagtgcgacatctgggagaagaagctggcccagaccaagagagtgctggccgccgccgaggagaacagcaagatggagcagagcaacctggagaagctggagctgaacgtgagaaagctgcagcaggagctggaccagctgaacagagacaagctgagcctgcacaacgacatcagcgccatgcagcagcagctgcaggagaagagagaggccgtgaacagcctgcaggaggagctggccaacgtgcaggaccacctgaacctggccaagcaggacctgctgcacaccaccaagcaccaggacgtgctgctgagcgagcagaccagactgcagaaggacatcagcgagtgggccaacagattcgaggactgccagaaggaggaggagaccaagcagcagcagctgcaggtgctgcagaacgagatcgaggagaacaagctgaagctggtgcagcaggagatgatgttccagagactgcagaaggagagagagagcgaggagagcaagctggagaccagcaaggtgaccctgaaggagcagcagcaccagctggagaaggagctgaccgaccagaagagcaagctggaccaggtgctgagcaaggtgctggccgccgaggagagagtgagaaccctgcaggaggaggagagatggtgcgagagcctggagaagaccctgagccagaccaagagacagctgagcgagagagagcagcagctggtggagaagagcggcgagctgctggccctgcagaaggaggccgacagcatgagagccgacttcagcctgctgagaaaccagttcctgaccgagagaaagaaggccgagaagcaggtggccagcctgaaggaggccctgaagatccagagaagccagctggagaagaacctgctggagcagaagcaggagaacagctgcatccagaaggagatggccaccatcgagctggtggcccaggacaaccacgagagagccagaagactgatgaaggagctgaaccagatgcagtacgagtacaccgagctgaagaagcagatggccaaccagaaggacctggagagaagacagatggagatcagcgacgccatgagaaccctgaagagcgaggtgaaggacgagatcagaaccagcctgaagaacctgaaccagttcctgcccgagctgcccgccgacctggaggccatcctggagagaaacgagaacctggagggcgagctggagagcctgaaggagaacctgcccttcaccatgaacgagggccccttcgaggagaagctgaacttcagccaggtgcacatcatggacgagcactggagaggcgaggccctgagagagaagctgagacacagagaggacagactgaaggcccagctgagacactgcatgagcaagcaggccgaggtgctgatcaagggcaagagacagaccgagggcaccctgcacagcctgagaagacaggtggacgccctgggcgagctggtgaccagcaccagcgccgacagcgccagcagccccagcctgagccagctggagagcagcctgaccgaggacagccagctgggccagaaccagaagcagaacaacagcctgagatag

SEQ ID NO: 12631 - DNA, 657 bp, Artificial Sequence
  Description of Artificial Sequence: Synthetic coding sequence
atggacgagctggtgaccctggaggaggccgacggcggcagcgacatcctgctggtggtgcccaaggccaccgtgctgcagaaccagctggacgagagccagcaggagagaaacgacctgatgcagctgaagctgcagctggagggccaggtgaccgagctgagaagcagagtgcaggagctggagagagccctggccaccgccagacaggagcacaccgagctgatggagcagtacaagggcatcagcagaagccacggcgagatcaccgaggagagagacatcctgagcagacagcagggcgaccacgtggccagaatcctggagctggaggacgacatccagaccatcagcgagaaggtgctgaccaaggaggtggagctggacagactgagagacaccgtgaaggccctgaccagagagcaggagaagctgctgggccagctgaaggaggtgcaggccgacaaggagcagagcgaggccgagctgcaggtggcccagcaggagaaccaccacctgaacctggacctgaaggaggccaagagctggcaggaggagcagagcgcccaggcccagagactgaaggacaaggtggcccagatgaaggacaccctgggccaggcccagcagagagtgagacccagctggagcccctag

SEQ ID NO: 12632 - DNA, 693 bp, Artificial Sequence
  Description of Artificial Sequence: Synthetic coding sequence
atgaagaagcccagacccgccgccgccgcccccagccccagaccccccgcctgcagcagaggcgcccaccccggcaccgccagcgagctgagagtgcccgccctgagaagaggcggctgcggcgacagaagactgagagaggaggccgcccccgagcaggccgccgccggccccagaagaagcaccgtgggcgccctgctggccagcgagctgggctggaagttctacgacgccgacgactaccaccccgaggagaacagaagaaagatgggcaagggcatccccctgaacgaccaggacagaatcccctggctgtgcaacctgcacgacatcctgctgagagacgtggccagcggccagagagtggtgctggcctgcagcgccctgaagaagacctacagagacatcctgacccagggcaaggacggcgtggccctgaagtgcgaggagagcggcaaggaggccaagcaggccgagatgcagctgctggtggtgcacctgagcggcagcttcgaggtgatcagcggcagactgctgaagagagagggccacttcatgccccccgagctgctgcagagccagttcgagaccctggagccccccgccgcccccgagaacttcatccagatcagcgtggacaagaacgtgagcgagatcatcgccaccatcatggagaccctgaagatgaagtag

SEQ ID NO: 12633 - DNA, 957 bp, Artificial Sequence
  Description of Artificial Sequence: Synthetic coding sequence
atgtgcagaaccgccctgggcgtgaccaccctgcaggacctgggcgtgtgctggagaaaggagcacgaccccgccgagatgctgagagtgggcagagccgagctgggcggctggaagcccagctgggaggccatcgtgaaggaggtggccgccgccaccggccacaccgtggtgctggtggaccagaccgaggacatcctggccaagagcaagaagggcatcgaggagagcctgagaaaggtggccaagaagaagttcgccgagaacctgaaggccggcgacgagttcgtggagaagaccctgagcaccatcgccaccagcaccgacgccgccagcgtggtgcacagcaccgacctggtggtggaggccatcgtggagaacctgaaggtgaagaacgagctgttcaagagactggacaagttcgccgccgagcacaccatcttcgccagcaacaccagcagcctgcagatcaccagcatcgccaacgccaccaccagacaggacagattcgccggcctgcacttcttcaaccccgtgcccgtgatgaagctggtggaggtgatcaagacccccatgaccagccagaagaccttcgagagcctggtggacttcagcaaggccctgggcaagcaccccgtgagctgcaaggacacccccggcttcatcgtgaacagactgctggtgccctacctgatggaggccatcagactgtacgagagaggcgacgccagcaaggaggacatcgacaccgccatgaagctgggcgccggctaccccatgggccccttcgagctgctggactacgtgggcctggacaccaccaagttcatcgtggacggctggcacgagatggacgccgagaaccccctgcaccagcccagccccagcctgaacaagctggtggccgagaacaagttcggcaagaagaccggcgagggcttctacaagtacaagtag

SEQ ID NO: 12634 - DNA, 666 bp, Artificial Sequence
  Description of Artificial Sequence: Synthetic coding sequence
atggccatcgtgcagaccctgcccgtgcccctggagcccgcccccgaggccgccaccgccccccaggcccccgtgatgggcagcgtgagcagcctgatcagcggcagaccctgccccggcggccccgccccccccagacaccacggcccccccggccccaccttcttcagacagcaggacggcctgctgagaggcggctacgaggcccaggagcccctgtgccccgccgtgccccccagaaaggccgtgcccgtgaccagcttcacctacatcaacgaggacttcagaaccgagagcccccccagccccagcagcgacgtggaggacgccagagagcagagagcccacaacgcccacctgagaggccccccccccaagctgatccccgtgagcggcaagctggagaagaacatggagaagatcctgatcagacccaccgccttcaagcccgtgctgcccaagcccagaggcgcccccagcctgcccagcttcatgggccccagagccaccggcctgagcggcagccagggcagcctgacccagctgttcggcggccccgccagcagcagcagcagcagcagcagcagcagcgccgccgacaagcccctggccttcagcggctgggccagcggctgccccagcggcaccctgagcgacagcggctag

SEQ ID NO: 12635 - DNA, 585 bp, Artificial Sequence
  Description of Artificial Sequence: Synthetic coding sequence
atgagagagctggccgccgtggtgagcagagacatctacctgcacaaccccaacatcaagtggaacgacatcatcggcctggacgccgccaagcagctggtgaaggaggccgtggtgtaccccatcagatacccccagctgttcaccggcatcctgagcccctggaagggcctgctgctgtacggcccccccggcaccggcaagaccctgctggccaaggccgtggccaccgagtgcaagaccaccttcttcaacatcagcgccagcaccatcgtgagcaagtggagaggcgacagcgagaagctggtgagagtgctgttcgagctggccagataccacgcccccagcaccatcttcctggacgagctggagagcgtgatgagccagagaggcaccgccagcggcggcgagcacgagggcagcctgagaatgaagaccgagctgctggtgcagatggacggcctggccagaagcgaggacctggtgttcgtgctggccgccagcaacctgccctgcctgaaggccatcgccctgcagcccggcgacagagccagactgagactgaagaagaagaagtgcacctag

SEQ ID NO: 12636 - DNA, 555 bp, Artificial Sequence
  Description of Artificial Sequence: Synthetic coding sequence
atgaccttccagttcaacttcaccatcgaggaccacctggagaacgagctgacccccatcagagacggcgccctgaccctggacagcagcaaggagctgagcgtgagcgagagccagaagggcgaggagagagacagaaagtgcagcgccgagcagttcgacctgccccaggaccacctgtgggagcacaagagcatggagaacgccgcccccagccaggacaccgacagccccctgagcgccgccagcagcagcagaaacctggagccccacggcaagcagcccagcctgagagccgccaaggagcacgccatgcccaaggacctgaagaagatgctggagaacaaggtgatcgagaccctgcccggcttccagcacgtgaagctgagcgtggtgaagaccatcctgctgaaggagaacttccccggcgagaacatcgtgagcaagagcttcagcagccacagcgacctgatcaccggcgtgtacgagggcggcctgaagatctgggagtgcaccttcgacctgctggcctacttcaccaaggccaaggtgtag

SEQ ID NO: 12637 - DNA, 354 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctgccacagagccgtgctgagcgcctgcagcagctacttcagagccatgttctgcaacgaccacagagagagcagagagatgctggtggagatcaacggcatcctggccgaggccatgtag

SEQ ID NO: 12638 - DNA, 498 bp, Artificial Sequence
  Description of Artificial Sequence: Synthetic coding sequence
atgatcctgaacgtgctggagtacggcagccagcaggtggccgacctgaccctgaacctggacgactacatcgacgccgagcacctgggcgacttccacagaacctacaagaacagcgaggagctgagaagcagaatcgtgagcggcatcatcacccccatccacgagcagtgggagaaggccaacgtgagcagcccccacagagagttcccccccgccaccgccagagaggtggaccccctgagaatccccccccaccacccccacaccagcagacagcccccctggcccagaagaggcggcatgatcgtggaccccctgagaagcggcttccccagagccctgatcgaccccagcagcggcctgcccaacagactgccccccggcgccgtgccccccggcgccagattcgaccccttcggccccatcggcaccagcccccccggccccaaccccgaccacctgcccccccccggctacgacgacatgtacctgtag

SEQ ID NO: 12639 - DNA, 369 bp, Artificial Sequence
  Description of Artificial Sequence: Synthetic coding sequence
gccctgaccttcagcctgagagccggcgccgccagcgcccaggacggcagatgcccctgcggcgccagaagacccgacagcagactgctgcagctgcacatcaccatgcccttcagcagccccatggaggccgagctggtgagaagaatcctgagcagagacgccgcccccctgcccagacccggcgccgtgctgaaggacttcaccgtgagcggcaacctgctgttcatcagactgaccgccgccgaccacagacagctgcagctgagcatcagcagctgcctgcagcagctgagcctgctgatgtggatcacccagtgcttcctgcccgtgttcctggcccaggcccccagcggccagagaagatag

SEQ ID NO: 12640 - DNA, 2415 bp, Artificial Sequence
  Description of Artificial Sequence: Synthetic coding sequence
atgaagagcatcggcgtgaagaccgtgaaggtgtgcggcagcaagagcagcgtgagaatcgagggccagccctgcagcctgggccagagcagaagaaaggtgaagctgatgggcgagagaagctacaccctgagcatcggcaacggcgactacttctgggccaacaaggagatgctgtgggactacgtgcagaccctgagcgaccagggcgccgagaagcacgagggcaccggccagagcagcggcatcaccgaccaggagaaggagctgagcaccaacgccttccaggccttcaccagcggcaactacgacgcctgcctgcagcacctggcctgcctgcaggacatcaacaaggacgactacaagatcatcctgaacaccgccgtggccgagttcttcaagagcaaccagaccaccaccgacaacctgagacagaccctgaaccagctgaagaaccaggtgcacagcgccgtggaggagatggacggcctggacgacgtggagaacagcatgctgtactacaaccaggccgtgatcctgtaccacctgagacagtacaccgaggccatcagcgtgggcgagaagctgtaccagttcatcgagcccttcgaggagaagttcgcccaggccgtgtgcttcctgctggtggacctgtacatcctgacctaccaggccgagaaggccctgcacctgctggccgtgctggagaagatgatcagccagggcaacaacaacaagaacggcaagaacgagaccggcaacaacaacaacaaggacggcagcaaccacaaggccgagagcggcgccctgatcgaggccgccaagagcaagatccaccagtacaaggtgagagcctacatccagatgaagagcctgaaggcctgcaagagagagatcaagagcgtgatgaacaccgccggcaacagcgcccccagcctgttcctgaagagcaacttcgagtacctgagaggcaactacagaaaggccgtgaagctgctgaacagcagcaacatcgccgagcaccccggcttcatgaagaccggcgagtgcctgagatgcatgttctggaacaacctgggctgcatccacttcgccatgagcaagcacaacctgggcatcttctacttcaagaaggccctgcaggagaacgacaacgtgtgcgcccagctgagcgccggcagcaccgaccccggcaagaagttcagcggcagacccatgtgcaccctgctgaccaacaagagatacgagctgctgtacaactgcggcatccagctgctgcacatcggcagacccctggccgccttcgagtgcctgatcgaggccgtgcaggtgtaccacgccaaccccagactgtggctgagactggccgagtgctgcatcgccgccaacaagggcaccagcgagcaggagaccaagggcctgcccagcaagaagggcatcgtgcagagcatcgtgggccagggctaccacagaaagatcgtgctggccagccagagcatccagaacaccgtgtacaacgacggccagagcagcgccatccccgtggccagcatggagttcgccgccatctgcctgagaaacgccctgctgctgctgcccgaggagcagcaggaccccaagcaggagaacggcgccaagaacagcaaccagctgggcggcaacaccgagagcagcgagagcagcgagacctgcagcagcaagagccacgacggcgacaagttcatccccgccccccccagcagccccctgagaaagcaggagctggagaacctgaagtgcagcatcctggcctgcagcgcctacgtggccctggccctgggcgacaacctgatggccctgaaccacgccgacaagctgctgcagcagcccaagctgagcggcagcctgaagttcctgggccacctgtacgccgccgaggccctgatcagcctggacagaatcagcgacgccatcacccacctgaaccccgagaacgtgaccgacgtgagcctgggcatcagcagcaacgagcaggaccagggcagcgacaagggcgagaacgaggccatggagagcagcggcaagagagccccccagtgctaccccagcagcgtgaacagcgccagaaccgtgatgctgttcaacctgggcagcgcctactgcctgagaagcgagtacgacaaggccagaaagtgcctgcaccaggccgccagcatgatccaccccaaggaggtgccccccgaggccatcctgctggccgtgtacctggagctgcagaacggcaacacccagctggccctgcagatcatcaagagaaaccagctgctgcccgccgtgaagacccacagcgaggtgagaaagaagcccgtgttccagcccgtgcaccccatccagcccatccagatgcccgccttcaccaccgtgcagagaaagtag

SEQ ID NO: 12641 - DNA, 1899 bp, Artificial Sequence; identical to SEQ ID NO: 9855
  Description of Artificial Sequence: Synthetic coding sequence

SEQ ID NO: 12642 - DNA, 585 bp, Artificial Sequence
  Description of Artificial Sequence: Synthetic coding sequence
atggaggacctgttcgagaccttccaggacgagatgggcttcagcaacatggaggacgacggccccgaggaggaggagagagtggccgagccccaggccaacttcaacaccccccaggccctgagattcgaggagctgctggccaacctgctgaacgagcagcaccagatcgccaaggagctgttcgagcagctgaagatgaagaagcccagcgccaagcagcagaaggaggtggagaaggtgaagccccagtgcaaggaggtgcaccagaccctgatcctggaccccgcccagagaaagagactgcagcagcagatgcagcagcacgtgcagctgctgacccagatccacctgctggccacctgcaaccccaacctgaaccccgaggccagcagcaccagaatctgcctgaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagacctag

SEQ ID NO: 12643 - DNA, 1803 bp, Artificial Sequence; identical to SEQ ID NO: 9298
  Description of Artificial Sequence: Synthetic coding sequence

SEQ ID NO: 12644 - DNA, 1620 bp, Artificial Sequence; identical to SEQ ID NO: 10018
  Description of Artificial Sequence: Synthetic coding sequence

SEQ ID NO: 12645 - DNA, 567 bp, Artificial Sequence
  Description of Artificial Sequence: Synthetic coding sequence
tgatacgtgaacgccgtggacagcagatggagcagctacggcaacgaggccaccagcagcgcccactacgtggagagagacagattcatcgtgaccgacctgagcggccacagaaagcacagcagcaccggcgacctgctgagcctggagctgcagcaggccaagagcaacagcctgctgctgcagagagaggccaacgccctggccatgcagcagaagtggaacagcctggacgagggcagacacctgaccctgaacctgctgagcaaggagatcgagctgagaaacggcgagctgcagagcgactacaccgaggacgccaccgacaccaagcccgacagagacatcgagctggagctgagcgccctggacaccgacgagcccgacggccagagcgagcccatcgaggagatcctggacatccagctgggcatcagcagccagaacgaccagctgctgaacggcatggccgtggagaacggccaccccgtgcagcagcaccagaaggagccccccaagcagaagaagcagagcctgggcagaagcaagaagcagttctgcagatag

SEQ ID NO: 12646 - DNA, 1806 bp, Artificial Sequence
  Description of Artificial Sequence: Synthetic coding sequence
atggaggagaccatgaagctggccaccatggaggacaccgtggagtactgcctgttcctgatccccgacgagagcagagacagcgacaagcacaaggagatcctgcagaagtacatcgagagaatcatcaccagattcgcccccatgctggtgccctacatctggcagaaccagcccttcaacctgaagtacaagcccggcaagggcggcgtgcccgcccacatgttcggcgtgaccaagttcggcgacaacatcgaggacgagtggttcatcgtgtacgtgatcaagcagatcaccaaggagttccccgagctggtggccagaatcgaggacaacgacggcgagttcctgctgatcgaggccgccgacttcctgcccaagtggctggaccccgagaacagcaccaacagagtgttcttctgccacggcgagctgtgcatcatccccgcccccagaaagagcggcgccgagagctggctgcccaccaccccccccaccatcccccaggccctgaacatcatcaccgcccacagcgagaagatcctggccagcgagagcatcagagccgccgtgaacagaagaatcagaggctaccccgagaagatccaggccagcctgcacagagcccactgcttcctgcccgccggcatcgtggccgtgctgaagcagagacccagactggtggccgccgccgtgcaggccttctacctgagagaccccatcgacctgagagcctgcagagtgttcaagaccttcctgcccgagaccagaatcatgaccagcgcccacggcttcgagatcctgtgcagcaagtgcagcccccacttcagcgactgcaagaagagcctggtgaccgccagccccctgtgggccagcttcctggagagcctgaagaagaacgactacttcaagggcctgatcgagggcagcgcccagtacagagagagactggagatggccgagaactacttccagctgagcgtggactggcccgagagcagcctggccatgagccccggcgaggagatcctgaccctgctgcagaccatccccttcgacatcgaggacctgaagaaggaggccgccaacctgccccccgaggacgacgaccagtggctggacctgagccccgaccagctggaccagctgctgcaggaggccgtgggcaagaaggagagcgagagcgtgagcaaggaggagaaggagcagaactacgacctgaccgaggtgagcgagagcatgaaggccttcatcagcaaggtgagcacccacaagggcgccgagctgcccagagagcccagcgaggcccccatcaccttcgacgccgacagcttcctgaactacttcgacaagatcctgggccccagacccaacgagagcgacagcgacgacctggacgacgaggacttcgagtgcctggacagcgacgacgacctggacttcgagacccacgagcccggcgaggaggccagcctgaagggcaccctggacaacctgaagagctacatggcccagatggaccaggagctggcccacacctgcatcagcaagagcttcaccaccagaaaccaggtggagcccgtgagccagaccaccgacaacaacagcgacgaggaggacagcggcaccggcgagagcgtgatggcccccgtggacgtggacctgaacctggtgagcaacatcctggagagctacagcagccaggccggcctggccggccccgccagcaacctgctgcagagcatgggcgtgcagctgcccgacaacaccgaccacagacccaccagcaagcccaccaagaactag

SEQ ID NO: 12647 - DNA, 405 bp, Artificial Sequence
  Description of Artificial Sequence: Synthetic coding sequence
atgaagaagaagcacgacggcatcgtgtacgagaccaaggaggtgctgaaccccagccccaaggtgacccactgctgcaagagcctgtggctgaagtacagcttccagaaggcctacatgacccagctggtgagcagccagcccgtgcccgccatgagcagaaaccccgaccacaacctgctgagccagcccaaggagcacagcatcgtgcagaagcaccaccaggaggagatcatccacaagctggccatgcagctgagacacatcggcgacaacatcgaccacagaatggtgagagaggacctgcagcaggacggcagagacgccctggaccacttcgtgttcttcttcttcagaagagtgcaggtgctgctgcacttcttctggaacaaccacctgctgtag

SEQ ID NO: 12648 - DNA, 1791 bp, Artificial Sequence
  Description of Artificial Sequence: Synthetic coding sequence
atggaggacgccccccagagactgagatggcaggcccacctggagttcacccacaaccacgacgtgggcgacctgacctgggacaagatcgccgtgagcctgcccagaagcgagaagctgagaagcctggtgctggccggcatcccccacggcatgagaccccagctgtggatgagactgagcggcgccctgcagaagaagagaaacagcgagctgagctacagagagatcgtgaagaacagcagcaacgacgagaccatcgccgccaagcagatcgagaaggacctgctgagaaccatgcccagcaacgcctgcttcgccagcatgggcagcatcggcgtgcccagactgagaagagtgctgagagccctggcctggctgtaccccgagatcggctactgccagggcaccggcatggtggccgcctgcctgctgctgttcctggaggaggaggacgccttctggatgatgagcgccatcatcgaggacctgctgcccgccagctacttcagcaccaccctgctgggcgtgcagaccgaccagagagtgctgagacacctgatcgtgcagtacctgcccagactggacaagctgctgcaggagcacgacatcgagctgagcctgatcaccctgcactggttcctgaccgccttcgccagcgtggtggacatcaagctgctgctgagaatctgggacctgttcttctacgagggcagcagagtgctgttccagctgaccctgggcatgctgcacctgaaggaggaggagctgatccagagcgagaacagcgccagcatcttcaacaccctgagcgacatccccagccagatggaggacgccgagctgctgctgggcgtggccatgagactggccggcagcctgaccgacgtggccgtggagacccagagaagaaagcacctggcctacctgatcgccgaccagggccagctgctgggcgccggcaccctgaccaacctgagccaggtggtgagaagaagaacccagagaagaaagagcaccatcaccgccctgctgttcggcgaggacgacctggaggccctgaaggccaagaacatcaagcagaccgagctggtggccgacctgagagaggccatcctgagagtggccagacacttccagtgcaccgaccccaagaactgcagcgtggagctgacccccgactacagcatggagagccaccagagagaccacgagaactacgtggcctgcagcagaagccacagaagaagagccaaggccctgctggacttcgagagacacgacgacgacgagctgggcttcagaaagaacgacatcatcaccatcgtgagccagaaggacgagcactgctgggtgggcgagctgaacggcctgagaggctggttccccgccaagttcgtggaggtgctggacgagagaagcaaggagtacagcatcgccggcgacgacagcgtgaccgagggcgtgaccgacctggtgagaggcaccctgtgccccgccctgaaggccctgttcgagcacggcctgaagaagcccagcctgctgggcggcgcctgccacccctggctgttcatcgaggaggccgccggcagagaggtggagagagacttcgccagcgtgtacagcagactggtgctgtgcaagaccttcagactggacgaggacggcaaggtgctgacccccgaggagctgctgtacagagccgtgcagagcgtgaacgtgacccacgacgccgtgcacgcccagatggacgtgaagctgagaagcctgatctgcgtgggcctgaagtag

SEQ ID NO: 12649 - DNA, 399 bp, Artificial Sequence
  Description of Artificial Sequence: Synthetic coding sequence
atggagagcagagtggccgacgccggcaccggcgagaccgccagagccgccggcggcagccccgccgtgggctgcaccaccagaggccccgtggtgagcgcccccctgggcgccgccagatggaagctgctgagacaggtgctgaagcagaagcacctggacgactgcctgagacacgtgagcgtgagaagattcgagagcttcaacctgttcagcgtgaccgagggcaaggagagagagaccgaggaggaggtgggcgcctgggtgcagtacaccagcatcttctgccccgagtacagcatcagcctgagacacaacagcggcagcctgaacgtggaggacgtgctgaccagcttcgacaacaccggcaacgtgtggagcttcagcagaggcaagtag

SEQ ID NO: 12650 - DNA, 1620 bp, Artificial Sequence; identical to SEQ ID NO: 10018
  Description of Artificial Sequence: Synthetic coding sequence

SEQ ID NO: 12651 - DNA, 2193 bp, Artificial Sequence
  Description of Artificial Sequence: Synthetic coding sequence
atgaacaacagcagcagcgagaccagaggccacccccacagcgccagcagccccagcgagagagtgttccccatgcccctgcccagaaaggcccccctgaacatccccggcacccccgtgctggaggacttcccccagaacgacgacgagaaggagagactgcagagaagaagaagcagagtgttcgacctgcagttcagcaccgacagccccagactgctggccagccccagcagcagaagcatcgacatcagcgccaccatccccaagttcaccaacacccagatcaccgagcactacagcacctgcatcaagctgagcaccgagaacaagatcaccaccaagaacgccttcggcctgcacctgatcgacttcatgagcgagatcctgaagcagaaggacaccgagcccaccaacttcaaggtggccgccggcaccctggacgccagcaccaagatctacgccgtgagagtggacgccgtgcacgccgacgtgtacagagtgctgggcggcctgggcaaggacgcccccagcctggaggaggtggagggccacgtggccgacggcagcgccaccgagatgggcaccaccaagaaggccgtgaagcccaagaagaagcacctgcacagaaccatcgagcagaacatcaacaacctgaacgtgagcgaggccgacagaaagtgcgagatcgaccccatgttccagaagaccgccgccagcttcgacgagtgcagcaccgccggcgtgttcctgagcaccctgcactgccaggactacagaagcgagctgctgttccccagcgacgtgcagaccctgagcaccggcgagcccctggagctgcccgagctgggctgcgtggagatgaccgacctgaaggcccccctgcagcagtgcgccgaggacagacagatctgccccagcctggccggcttccagttcacccagtgggacagcgagacccacaacgagagcgtgagcgccctggtggacaagttcaagaagaacgaccaggtgttcgacatcaacgccgaggtggacgagagcgactgcggcgacttccccgacggcagcctgggcgacgacttcgacgccaacgacgagcccgaccacaccgccgtgggcgaccacgaggagttcagaagctggaaggagccctgccaggtgcagagctgccaggaggagatgatcagcctgggcgacggcgacatcagaaccatgtgccccctgctgagcatgaagcccggcgagtacagctacttcagccccagaaccatgagcatgtgggccggccccgaccactggagattcagacccagaagaaagcaggacgcccccagccagagcgagaacaagaagaagagcaccaagaaggacttcgagatcgacttcgaggacgacatcgacttcgacgtgtacttcagaaagaccaaggccgccaccatcctgaccaagagcaccctggagaaccagaactggagagccaccaccctgcccaccgacttcaactacaacgtggacaccctggtgcagctgcacctgaagcccggcaccagactgctgaagatggcccagggccacagagtggagaccgagcactacgaggagatcgaggactacgactacaacaaccccaacgacaccagcaacttctgccccggcctgcaggccgccgacagcgacgacgaggacctggacgacctgttcgtgggccccgtgggcaacagcgacctgagcccctacccctgccacccccccaagaccgcccagcagaacggcgacacccccgaggcccagggcctggacatcaccacctacggcgagagcaacctggtggccgagccccagaaggtgaacaagatcgagatccactacgccaagaccgccaagaagatggacatgaagaagctgaagcagagcatgtggagcctgctgaccgccctgagcggcaaggaggccgacgccgaggccaaccacagagaggccggcaaggaggccgccctggccgaggtggccgacgagaagatgctgagcggcctgaccaaggacctgcagagaagcctgccccccgtgatggcccagaacctgagcatccccctggccttcgcctgcctgctgcacctggccaacgagaagaacctgaagctggagggcaccgaggacctgagcgacgtgctggtgagacagggcgactag

SEQ ID NO: 12652 - DNA, 900 bp, Artificial Sequence
  Description of Artificial Sequence: Synthetic coding sequence
atggagacccagttccccgtgagcgagggcaaggtggacccctacagaagctgcggcttcagctacgagcaggaccccaccctgagagaccccgaggccgtggccagaagatggccctggatggtgagcgtgagagccaacggcacccacatctgcgccggcaccatcatcgccagccagtgggtgctgaccgtggcccactgcctgatctggagagacgtgatctacagcgtgagagtgggcagcccctggatcgaccagatgacccagaccgccagcgacgtgcccgtgctgcaggtgatcatgcacagcagatacagagcccagagattctggagctgggtgggccaggccaacgacatcggcctgctgaagctgaagcaggagctgaagtacagcaactacgtgagacccatctgcctgcccggcaccgactacgtgctgaaggaccacagcagatgcaccgtgaccggctggggcctgagcaaggccgacggcatgtggccccagttcagaaccatccaggagaaggaggtgatcatcctgaacaacaaggagtgcgacaacttctaccacaacttcaccaagatccccaccctggtgcagatcatcaagagccagatgatgtgcgccgaggacacccacagagagaagttctgctacgagctgaccggcgagcccctggtgtgcagcatggagggcacctggtacctggtgggcctggtgagctggggcgccggctgccagaagagcgaggccccccccatctacctgcaggtgagcagctaccagcactggatctgggactgcctgaacggccaggccctggccctgcccgcccccagcagaaccctgctgctggccctgcccctgcccctgagcctgctggccgccctgtag

SEQ ID NO: 12653 - DNA, 1089 bp, Artificial Sequence
  Description of Artificial Sequence: Synthetic coding sequence
atgctggtgcccggcagcaccagaccctacagcaagaagagacagaacagcaagagcgcccagggcctggccggcctgagaaacctgggcaacacctgcttcatgaacagcatcctgcagtgcctgagcaacaccagagagctgagagactactgcctgcagagactgtacatgagagacctgcaccacggcagcaacgcccacaccgccctggtggaggagttcgccaagctgatccagaccatctggaccagcagccccaacgacgtggtgagccccagcgagttcaagacccagatccagagatacgcccccagattcgtgggctacaaccagcaggacgcccaggagttcctgagattcctgctggacggcctgcacaacgaggtgaacagagtgaccctgagacccaagagcaaccccgagaacctggaccacctgcccgacgacgagaagggcagacagatgtggagaaagtacctggagagagaggacagcagaatcggcgacctgttcgtgggccagctgaagagcagcctgacctgcaccgactgcggctactgcagcaccgtgttcgaccccttctgggacctgagcctgcccatcgccaagagaggctaccccgaggtgaccctgatggactgcatgagactgttcaccaaggaggacgtgctggacggcgacgagaagcccacctgctgcagatgcagaggcagaaagagatgcatcaagaagttcagcatccagagattccccaagatcctggtgctgcacctgaagagattcagcgagagcagaatcagaaccagcaagctgaccaccttcgtgaacttccccctgagagacctggacctgagagagttcgccagcgagaacaccaaccacgccgtgtacaacctgtacgccgtgagcaaccacagcggcaccaccatgggcggccactacaccgcctactgcagaagccccggcaccggcgagtggcacaccttcaacgacagcagcgtgacccccatgagcagcagccaggtgagaaccagcgacgcctacctgctgttctacgagctggccagcccccccagcagaatgtag

SEQ ID NO: 12654 - DNA, 1800 bp, Artificial Sequence
  Description of Artificial Sequence: Synthetic coding sequence
atggaccccggcgacgccgccatcctggagagcagcctgagaatcctgtacagactgttcgagagcgtgctgccccccctgcccgccgccctgcagagcagaatgaacgtgatcgaccacgtgagagacatggccgccgccggcctgcacagcaacgtgagactgctgagcagcctgctgctgaccatgagcaacaacaaccccgagctgttcagccccccccagaagtaccagctgctggtgtaccacgccgacagcctgttccacgacaaggagtacagaaacgccgtgagcaagtacaccatggccctgcagcagaagaaggccctgagcaagaccagcaaggtgagacccagcaccggcaacagcgccagcaccccccagagccagtgcctgcccagcgagatcgaggtgaagtacaagatggccgagtgctacaccatgctgaagcaggacaaggacgccatcgccatcctggacggcatccccagcagacagagaacccccaagatcaacatgatgctggccaacctgtacaagaaggccggccaggagagacccagcgtgaccagctacaaggaggtgctgagacagtgccccctggccctggacgccatcctgggcctgctgagcctgagcgtgaagggcgccgaggtggccagcatgaccatgaacgtgatccagaccgtgcccaacctggactggctgagcgtgtggatcaaggcctacgccttcgtgcacaccggcgacaacagcagagccatcagcaccatctgcagcctggagaagaagagcctgctgagagacaacgtggacctgctgggcagcctggccgacctgtacttcagagccggcgacaacaagaacagcgtgctgaagttcgagcaggcccagatgctggacccctacctgatcaagggcatggacgtgtacggctacctgctggccagagagggcagactggaggacgtggagaacctgggctgcagactgttcaacatcagcgaccagcacgccgagccctgggtggtgagcggctgccacagcttctacagcaagagatacagcagagccctgtacctgggcgccaaggccatccagctgaacagcaacagcgtgcaggccctgctgctgaagggcgccgccctgagaaacatgggcagagtgcaggaggccatcatccacttcagagaggccatcagactggccccctgcagactggactgctacgagggcctgatcgagtgctacctggccagcaacagcatcagagaggccatggtgatggccaacaacgtgtacaagaccctgggcgccaacgcccagaccctgaccctgctggccaccgtgtgcctggaggaccccgtgacccaggagaaggccaagaccctgctggacaaggccctgacccagagacccgactacatcaaggccgtggtgaagaaggccgagctgctgagcagagagcagaagtacgaggacggcatcgccctgctgagaaacgccctggccaaccagagcgactgcgtgctgcacagaatcctgggcgacttcctggtggccgtgaacgagtaccaggaggccatggaccagtacagcatcgccctgagcctggaccccaacgaccagaagagcctggagggcatgcagaagatggagaaggaggagagccccaccgacgccacccaggaggaggacgtggacgacatggagggcagcggcgaggagggcgacctggagggcagcgacagcgaggccgcccagtgggccgaccaggagcagtggttcggcatgcagtag

SEQ ID NO: 12655 - DNA, 507 bp, Artificial Sequence
  Description of Artificial Sequence: Synthetic coding sequence
atgcccgccaccagaaagcccatgagatacggccacaccgagggccacaccgaggtgtgcttcgacgacagcggcagcttcatcgtgacctgcggcagcgacggcgacgtgagaatctgggaggacctggacgacgacgaccccaagttcatcaacgtgggcgagaaggcctacagctgcgccctgaagagcggcaagctggtgaccgccgtgagcaacaacaccatccaggtgcacaccttccccgagggcgtgcccgacggcatcctgaccagattcaccaccaacgccaaccacgtggtgttcaacggcgacggcaccaagatcgccgccggcagcagcgacttcctggtgaagatcgtggacgtgatggacagcagccagcagaagaccttcagaggccacgacgcccccgtgctgagcctgagcttcgaccccaaggacatcttcctggccagcgccagctgcgacggcagcgtgagagtgtggcagatcagcgaccagtag

SEQ ID NO: 12656 - DNA, 141 bp, Artificial Sequence
  Description of Artificial Sequence: Synthetic coding sequence
atggtgaacagctgctgcggcagcgtgtgcagcgaccagggctgcggcctggagaactgctgcagacccagctgctgccagaccacctgctgcagaaccacctgctgcagacccctgtgctgcgccagcagctgctgctag

SEQ ID NO: 12657 - DNA, 669 bp, Artificial Sequence
  Description of Artificial Sequence: Synthetic coding sequence
atggccagcgtggtggagtacaagggcctgagagccggctaccactgcggctactgcgacagcaaggagggcaaggccagctgcggcatgtgggcccacagcatgaccgtgcaggactaccaggacctgatcgacagaggctggagaagaagcggcaagtacgtgtacaagcccgtgatgaaccagacctgctgcccccagtacaccatcagatgcagacccctgcagttccagcccagcaagagccacaagaaggtgctgaagaagatgctgaagttcctggccaagggcgaggtgcccaagggcagctgcgaggacgagcccatggacagcaccatggacgacgccgtggccggcgacttcgccctgatcaacaagctggacatccagtgcgacctgaagaccctgagcgacgacatcaaggagagcctggagagcgagggcaagaacagcaagaaggaggagccccaggagctgctgcagagccaggacttcgtgggcgagaagctgggcagcggcgagcccagccacagcgtgaaggtgcacaccgtgcccaagcccggcaagggcgccgacctgagcaagcccccctgcagaaaggccaaggagatcagaaaggagagaaagagactgaagctgatgcagcagaaccccgccggcgagctgtag

SEQ ID NO: 12658 - DNA, 495 bp, Artificial Sequence
  Description of Artificial Sequence: Synthetic coding sequence
atgctgaaggccgtgatcctgatcggcggcccccagaagggcaccagattcagacccctgagcttcgaggtgcccaagcccctgttccccgtggccggcgtgcccatgatccagcaccacatcgaggcctgcgcccaggtgcccggcatgcaggagatcctgctgatcggcttctaccagcccgacgagcccctgacccagttcctggaggccgcccagcaggagttcaacctgcccgtgagatacctgcaggagttcgcccccctgggcaccggcggcggcctgtaccacttcagagaccagatcctggccggcagccccgaggccttcttcgtgctgaacgccgacgtgtgcagcgacttccccctgagcgccatgctggaggcccacagaagacagagacaccccttcctgctgctgggcaccaccgccaacagaacccagagcctgaactacggctgcatcgtggagaacccccagacccacgaggtgtag

SEQ ID NO: 12659 - DNA, 339 bp, Artificial Sequence
  Description of Artificial Sequence: Synthetic coding sequence
atgttcgtgagcgacttcagaaaggagttctacgaggtggtgcagagccagagagtgctgctgttcgtggccagcgacgtggacgccctgtgcgcctgcaagatcctgcaggccctgttccagtgcgaccacgtgcagtacaccctggtgcccgtgagcggctggcaggagctggagaccgccttcctggagcacaaggagcagttccactacttcatcctgatcaactgcggcgccaacgtggacctgctggacatcctgcagcccgacgaggacaccatcttcttcgtgtgcgacacccacagacccgtgaacgtggtgaacgtgtacaacgactag

SEQ ID NO: 12660 - DNA, 942 bp, Artificial Sequence
  Description of Artificial Sequence: Synthetic coding sequence
accctggtggtgagcggcagagacgacccccccacccacagccagcccgacagcgacgacgaggccgaggagatccagtggagcgacgacgagaacaccgccaccctgaccgcccccgagttccccgagttcgccaccaaggtgcaggaggccatcaacagcctgggcggcagcgtgttccccaagctgaactggagcgcccccagagacgcctactggatcgccatgaacagcagcctgaagtgcaagaccctgagcgacatcttcctgctgttcaagagcagcgacttcatcaccagagacttcacccagcccttcatccactgcaccgacgacagccccgacccctgcatcgagtacgagctggtgctgagaaagtggtgcgagctgatccccggcgccgagttcagatgcttcgtgaaggagaacaagctgatcggcatcagccagagagactacacccagtactacgaccacatcagcaagcagaaggaggagatcagaagatgcatccaggacttcttcaagaagcacatccagtacaagttcctggacgaggacttcgtgttcgacatctacagagacagcagagacagccccgccttcagatgcaccaacagcgaggtgaccgtgcagcccagcccctacctgagctacagactgcccaaggacttcgtggacctgagcaccggcgaggacgcccacaagctgatcgacaagagcgccggcggcagactgatgagcgtgctggagctggagaagagaagacccagacccaccgcccccggcgccgcccaccagccccagctgcccgccgaccccgacgccggcggccccagcagcgtggacatcagccacttcctgtacagctgcaccttcacctggggcaagaagagaagagacttcgccacctgcaagaacaacatcatcaacagaagctag

SEQ ID NO: 12661 - DNA, 1017 bp, Artificial Sequence; identical to SEQ ID NO: 12207
  Description of Artificial Sequence: Synthetic coding sequence

SEQ ID NO: 12662 - DNA, 1119 bp, Artificial Sequence; identical to SEQ ID NO: 10871
  Description of Artificial Sequence: Synthetic coding sequence

SEQ ID NO: 12663 - DNA, 408 bp, Artificial Sequence
  Description of Artificial Sequence: Synthetic coding sequence
tgacagctggccagcatggtgtggaacaaccccagccagcagcagttcatgcagttcggcggcagcagcggcagccagctgccccagatccagaccgacgtggtgctgcccagctgcaagaagaaggcccccgccgagacccccgtgaaggagagactgttcatcgtgttcaacccccaccccctgcccctggacgtgctggaggacatcttctgcagattcggcaacctgatcgaggtgtacctggtgagcggcaagaacgtgggctacgccaagtacgccgacagaatcagcgccaacgacgccatcgccaccctgcacggcaagatcctgaacggcgtgagactgaaggtgatgctggccgacagccccagagaggagagcaacaagagacagagaacctactag

SEQ ID NO: 12664 - DNA, 1764 bp, Artificial Sequence; identical to SEQ ID NO: 10411
  Description of Artificial Sequence: Synthetic coding sequence

SEQ ID NO: 12665 - DNA, 1842 bp, Artificial Sequence; identical to SEQ ID NO: 9548
  Description of Artificial Sequence: Synthetic coding sequence

SEQ ID NO: 12666 - DNA, 477 bp, Artificial Sequence
  Description of Artificial Sequence: Synthetic coding sequence
atgacccactgctgcagcccctgctgccagcccacctgctgcagaaccacctgctgcagaaccacctgctggaagcccaccaccgtgaccacctgcagcagcaccccctgctgccagcccgcctgctgcgtgagcagctgctgccagccctgctgcagacccacctgctgccagaacacctgctgcagaaccacctgctgccagcccacctgccccacctgctgcggcagcagctgctgcggccagaccagctgcggcagcagctgcggccagagcagcagctgcgcccccgtgtactgcagaagaacctgctactaccccaccaccgtgtgcctgcccggctgcctgaaccagagctgcggcagcaactgctgccagccctgctgcagacccgcctgctgcgagaccacctgctgcagaaccacctgcttccagcccacctgcgtgagcagctgctgccagcccagctgctgctag

SEQ ID NO: 12667 - DNA, 1620 bp, Artificial Sequence; identical to SEQ ID NO: 10018
  Description of Artificial Sequence: Synthetic coding sequence

SEQ ID NO: 12668 - DNA, 2511 bp, Artificial Sequence
  Description of Artificial Sequence: Synthetic coding sequence
atggccgccgccctgggcccccccgaggtgatcgcccagctggagaacgccgccaaggtgctgatgcagaccctggcctgcagcatcctgaccgccctgctgagcgagttcagcagcagcagcaagaccagcaacatcggcctgagcatggagttccacggcaactgcaagagagtgttccaggaggaggacctgagacagatcttcatgctgaccgtggaggtgctgcaggagttcagcagaagagagaacctgaacgcccagatgagcagcgtgttccagagatacctggccctggccaaccaggtgctgagctggaacttcctgccccccaagctgggcagacactacatcgccatgttcgagagcagccagaacgtgctgctgaagcccaccgagagctggagagagaccctgctggacagcagagtgatggagctgttcttcaccgtgcacagaaagatcagagaggacagcgacatggcccaggacagcctgcagtgcctggcccagctggccagcctgcacggccccatcttccccgacgagggcagccaggtggactacctggcccacttcatcgagggcctgctgaacaccatcaacggcatcgagatcgaggacagcgaggccgtgggcatcagcagcatcatcagcaacctgatcaccgtgttccccagaaacgtgctgaccgccatccccagcgagctgttcagcagcttcgtgaactgcctgacccacctgacctgcagcttcggcagaagcgccgccctggaggaggtgctggacaaggacgacatggtgtacatggaggcctacgacaagctgctggagagctggctgaccctggtgcaggacgacaagcacttccacaagggcttcttcacccagcacgccgtgcaggtgttcaacagctacatccagtgccacctggccgcccccgacggcaccagaaacctgaccgccaacggcgtggccagcagagaggaggaggagatcagcgagctgcaggaggacgacagagaccagttcagcgaccagctggccagcgtgggcatgctgggcagaatcgccgccgagcactgcatccccctgctgaccagcctgctggaggagagagtgaccagactgcacggccagctgcagagacaccagcagcagctgctggccagccccggcagcagcaccgtggacaacaagatgctggacgacctgtacgaggacatccactggctgatcctggtgaccggctacctgctggccgacgacacccagggcgagacccccctgatcccccccgagatcatggagtacagcatcaagcacagcagcgaggtggacatcaacaccaccctgcagatcctgggcagccccggcgagaaggccagcagcatccccggctacaacagaaccgacagcgtgatcagactgctgagcgccatcctgagagtgagcgaggtggagagcagagccatcagagccgacctgacccacctgctgagcccccagatgggcaaggacatcgtgtggttcctgaagagatgggccaagacctacctgctggtggacgagaagctgtacgaccagatcagcctgcccttcagcaccgccttcggcgccgacaccgagggcagccagtggatcatcggctacctgctgcagaaggtgatcagcaacctgagcgtgtggagcagcgagcaggacctggccaacgacaccgtgcagctgctggtgaccctggtggagagaagagagagagccaacctggtgatccagtgcgagaactggtggaacctggccaagcagttcgccagcagaagcccccccctgaacttcctgagcagccccgtgcagagaaccctgatgaaggccctggtgctgggcggcttcgcccacatggacaccgagaccaagcagcagtactggaccgaggtgctgcagcccctgcagcagagattcctgagagtgatcaaccaggagaacttccagcagatgtgccagcaggaggaggtgaagcaggagatcaccgccaccctggaggccctgtgcggcatcgccgaggccacccagatcgacaacgtggccatcctgttcaacttcctgatggacttcctgaccaactgcatcggcctgatggaggtgtacaagaacacccccgagaccgtgaacctgatcatcgaggtgttcgtggaggtggcccacaagcagatctgctacctgggcgagagcaaggccatgaacctgtacgaggcctgcctgaccctgctgcaggtgtacagcaagaacaacctgggcagacagagaatcgacgtgaccgccgaggaggagcagtaccaggacctgctgctgatcatggagctgctgaccaacctgctgagcaaggagttcatcgacttcagcgacaccgacgaggtgttcagaggccacgagcccggccaggccgccaacagaagcgtgagcgccgccgacgtggtgctgtacggcgtgaacctgatcctgcccctgatgtag

SEQ ID NO: 12669 - DNA, 1008 bp, Artificial Sequence
  Description of Artificial Sequence: Synthetic coding sequence
atggacttcctgctgggcaaccccttcagcagccccgtgggccagagaatcgagaaggccaccgacggcagcctgcagagcgaggactgggccctgaacatggagatctgcgacatcatcaacgagaccgaggagggccccaaggacgccctgagagccgtgaagaagagaatcgtgggcaacaagaacttccacgaggtgctggagacctgcgtgaagaactgcggccacagattccacgtgctggtggccagccaggacttcgtggagagcgtgctggtgagaaccatcctgcccaagaacaacccccccaccatcgtgcacgacaaggtgctgaacctgatccagagctgggccgacgccttcagaagcagccccgacctgaccggcgtggtgaccatctacgaggacctgagaagaaagggcctggagttccccatgaccgacctggacatgctgagccccatccacaccccccagagaaccgtgttcaacagcgagacccagagcggccaggacagcgtgggcaccgacagcagccagcaggaggacagcggccagcacgccgcccccctgcccgccccccccatcctgagcggcgacacccccatcgcccccacccccgagcagatcggcaagctgagaagcgagctggagatggtgagcggcaacgtgagagtgatgagcgagatgctgaccgagctggtgcccacccaggccgagcccgccgacctggagctgctgcaggagctgaacagaacctgcagagccatgcagcagagagtgctggagctgatcccccagatcgccaacgagcagctgaccgaggagctgctgatcgtgaacgacaacctgaacaacgtgttcctgagacacgagagattcgagagattcagaaccggccagaccaccaaggcccccagcgaggccgagcccgccgccgacctgatcgacatgggccccgaccccgccgccaccggcaacctgagcagccagctggccggctag

SEQ ID NO: 12670 - DNA, 5193 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgagcagaggcgtggcctacagcacccacagaaccaacgcccccggcaaggacttccagggcatcagcgccgccttcagcaccgagaacggcttccacagcgtgggccacgagctggccgacaaccacatcaccagcagagactgcaacggccacctgctgaactgctacggcagaaacgagagcatcgccagcaccccccccggcgaggacagaaagagccccagagtgctgatcaagaccctgggcaagctggacggctgcctgagagtggagttccacaacggcggcaaccccagcaaggtgcccgccgaggactgcagcgagcccgtgcagctgctgagatacagccccaccctggccagcgagaccagccccgtgcccgaggccagaagaggcagcagcgccgacagcctgcccagccacagacccagccccaccgacagcagactgagaagcagcaagggcagcagcctgagcagcgagagcagctggtacgacagcccctggggcaacgccggcgagctgagcgaggccgagggcagcttcctggcccccggcatgcccgaccccagcctgcacgccagcttcccccccggcgacgccaagaagcccttcaaccagagcagcagcctgagcagcctgagagagctgtacaaggacgccaacctgggcagcctgagccccagcggcatcagactgagcgacgagtacatgggcacccacgccagcctgagcaacagagtgagcttcgccagcgacatcgacgtgcccagcagagtggcccacggcgaccccatccagtacagcagcttcaccctgccctgcagaaagcccaaggccttcgtggaggacaccgccaagaaggacagcctgaaggccagaatgagaagaatcagcgactggaccggcagcctgagcagaaagaagagaaagctgcaggagcccagaagcaaggagggcagcgactacttcgacagcagaagcgacggcctgaacaccgacgtgcagggcagcagccaggccagcgccttcctgtggagcggcggcagcacccagatcctgagccagagaagcgagagcacccacgccatcggcagcgaccccctgagacagaacatctacgagaacttcatgagagagctggagatgagcagaaccaacaccgagaacatcgagaccagcaccgagaccgccgagagcagcagcgagagcctgagcagcctggagcagctggacctgctgttcgagaaggagcagggcgtggtgagaaaggccggctggctgttcttcaagcccctggtgaccgtgcagaaggagagaaagctggagctggtggccagaagaaagtggaagcagtactgggtgaccctgaagggctgcaccctgctgttctacgagacctacggcaagaacagcatggaccagagcagcgcccccagatgcgccctgttcgccgaggacagcatcgtgcagagcgtgcccgagcaccccaagaaggagaacgtgttctgcctgagcaacagcttcggcgacgtgtacctgttccaggccaccagccagaccgacctggagaactgggtgaccgccgtgcacagcgcctgcgccagcctgttcgccaagaagcacggcaaggaggacaccctgagactgctgaagaaccagaccaagaacctgctgcagaagatcgacatggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggagcagcccgagtggagcagcgaggtgatggacgtgctggaccccagaggcaagctgaccaagggcaccctggaggagcccagaaccctggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 12671 - DNA, 348 bp, Artificial Sequence
  Description of Artificial Sequence: Synthetic coding sequence
atggcccccgccaagaagggcggcgagaagaagaagggcagaagcgccatcaacgaggtggtgaccagagagtacaccatcaacatccacaagagaatccacggcgtgggcttcaagaagagagcccccagagccctgaaggagatcagaaagttcgccatgaaggagatgggcacccccgacgtgagaatcgacaccagactgaacaaggccgtgtgggccaagggcatcagaaacgtgccctacagaatcagagtgagactgagcagaaagagaaacgaggacgaggacagccccaacaagctgtacaccctggtgacctacgtgcccgtgaccaccttcaagtag

SEQ ID NO: 12672 - DNA, 747 bp, Artificial Sequence
  Description of Artificial Sequence: Synthetic coding sequence
atggccctggaggtgggcgacatggaggacggccagctgagcgacagcgacagcgacatgaccgtggcccccagcgacagacccctgcagctgcccaaggtgctgggcggcgacagcgccatgagagccttccagaacaccgccaccgcctgcgcccccgtgagccactacagagccgtggagagcgtggacagcagcgaggagagcttcagcgacagcgacgacgacagctgcctgtggaagagaaagagacagaagtgcttcaaccccccccccaagcccgagcccttccagttcggccagagcagccagaagccccccgtggccggcggcaagaagatcaacaacatctggggcgccgtgctgcagaagctgagaaaggagagccaggagcacaccaaggacctggacaaggagctggacgagtacatgcacggcggcaagaagatgggcagcaaggaggaggagaacggccagggccacctgaagagaaagagacccgtgaaggacagactgggcaacagacccgagatgaactacaagggcagatacgagatcaccgccgaggacagccaggagaaggtggccgacgagatcagcttcagactgcaggagcccaagaaggacctgatcgccagagtggtgagaaacaagctgagaaccttcagcaccctgaagaccaagagaaacatgaagatcaagaagctgctgggcagaggcgagcacaagtgctggggcaagagatag

SEQ ID NO: 12673 - DNA, 78 bp, Artificial Sequence
  Description of Artificial Sequence: Synthetic coding sequence
atggccatggcccccagccccagcctggtgcaggtgtacaccagccccgccgccgtggccgtgtgggagtggcagtag

SEQ ID NO: 12674 - DNA, 171 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagatag

SEQ ID NO: 12675 - DNA, 450 bp, Artificial Sequence
  Description of Artificial Sequence: Synthetic coding sequence
gtgagagagctggaggccgagctggacgccgagcagaagaagcacgccgaggccctgaagggcgtgagaaagcacgagagaagagtgaaggagctggcctaccaggccgaggaggacagaaagaacctggccagaatgcaggacctggtggacaagctgcagagcaaggtgaagagctacaagagacagttcgaggaggccgagcagcaggccaacaccaacctggccaagtacagaaaggcccagcacgagctggacgacgccgaggagagagccgacatggccgagacccaggccaacaagctgagagccagaaccagagacgccctgggccccaaggtgagaagcggcagaggcatcgccctgtgcgccggcggcctgtggggcctgaccggcagcaccgcccacagcgccatccccttcagcagcgcccagggcgtgaccgcctag

SEQ ID NO: 12676 - DNA, 468 bp, Artificial Sequence
  Description of Artificial Sequence: Synthetic coding sequence
agcaacgtgatggaggccaacgccgccagacaggccacccccgccgagtggagccaggacgacagcaacgacatgtgggaggaccaggaggaggaggaggaggaggaggaggacggcctggccggccagctgctgagcgacatcctggccaccagcaagtacgaggaggactactacgaggacgacgaggaggacgaccccgacgccctgaaggaccccctgtaccagatcgacctgcaggccaccctgatgaccatgagaggcgagttctacagacccagcgccagcaagaagggcagcctgagcaccttcgcccccagcggccccgccgccaaccacttcgccgccctgaccggcctggagatgcacttcctgctgaacctgaagtggcacctggacccctggcccctggccagcgccgtgaccctgatgaccatccagaccagactgaccggcgccgtgacctag

SEQ ID NO: 12677 - DNA, 1620 bp, Artificial Sequence; identical to SEQ ID NO: 10018
  Description of Artificial Sequence: Synthetic coding sequence

SEQ ID NO: 12678 - DNA, 645 bp, Artificial Sequence
  Description of Artificial Sequence: Synthetic coding sequence
atgcccagcccctggggctggttcgccgtgaccgcctgcggcgcccagagaaacaacttcgaggagcccgtggccctgcaggagatggacaccagcaacggcgtgctgctgcccttctacgaccccgacagcagcatcgtgtacctgtgcggcaagggcgacagcagcatcagatacttcgagatcaccgacgagccccccttcgtgcactacctgaacaccttcagcagcaaggagccccagagaggcatgggcttcatgcccaagagaggcctggacgtgagcaagtgcgagatcgccagattctacaagctgcacgagagaaagtgcgagcccatcatcatgaccgtgcccagaaagagcgacctgttccaggacgccgagcccgtgctgatcagcctgagagacggctacgtgccccccaagcacagagagctgagagtgaccaagagaaacatcctggacgtgagaccccccagcggccccagaagaagccagagcgccagcgacgcccccctgagccagcacaccctggagaccctgctggaggagatcaaggccctgagagagagagtgcaggcccaggagcagagaatcaccgccctggagaacatgctgtgcgagctggtggacggcaccgactag

SEQ ID NO: 12679 - DNA, 690 bp, Artificial Sequence
  Description of Artificial Sequence: Synthetic coding sequence
atgctgcagctgagagacagcgtggacagcgccggcaccagccccaccgccgtgctggccgccggcgaggagcccggcagcatcgagcaggccgtggaggagatcagagtggtggtgagacccgtggaggacggcgagatccagggcgtgtggctgctgaccgaggtggaccactggaacaacgagaaggagagactggtgctggtgaccgagcagagcctgctgatctgcaagtacgacttcatcagcctgcagtgccagcaggtggtgagaatcgccctgaacgccgtggacaccatcagctacggcgagttccagttcccccccaagagcctgaacaagagagagggcttcggcatcagaatccagtgggacaagcagagcagacccagcttcatcaacagatggaacccctggagcaccaacgtgccctacgccaccttcaccgagcaccccatggccggcgccgacgagaagaccgccagcctgtgccagctggagagcttcaaggccctgctgatccaggccgtgaagaaggcccagaaggagagccccctgcccggccaggccaacggcgtgctgatcctggagagacccctgctgatcgagacctacgtgggcctgatgagcttcatcaacaacgaggccaagctgggctacagcatgaccagaggcaagatcggcttctag

SEQ ID NO: 12680 - DNA, 390 bp, Artificial Sequence
  Description of Artificial Sequence: Synthetic coding sequence
atgtgcgaggtgagcagaggctggaagccctgcaccgagggcatcctgaaggtgagacccaccagaaagatcagctacgagggcaacatcacccccaccgtggagctgaacgccctgtgcatgaagctgggcaagaagcccatgtacaagcccgtggacccctacagcagaatgcagagcacctacaactacaacatgagaggcggcgcctacccccccagatacttctaccccttccccgtgccccccctgctgtaccaggtggagctgagcgtgggcggccagcagttcaacggcaagggcaagaccagacaggccgccaagcacgacgccgccgccaaggccctgagaatcctgcagaacgagcccctgcccgagagactggagtag

SEQ ID NO: 12681 - DNA, 3042 bp, Artificial Sequence
  Description of Artificial Sequence: Synthetic coding sequence
atggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 12682 - DNA, 1149 bp, Artificial Sequence
  Description of Artificial Sequence: Synthetic coding sequence
atggccgccaacctgagcagaaacggccccgccctgcaggaggcctacgtgagagtggtgaccgagaagagccccaccgactgggccctgttcacctacgagggcaacagcaacgacatcagagtggccggcaccggcgagggcggcctggaggagatggtggaggagctgaacagcggcaaggtgatgtacgccttctgcagagtgaaggaccccaacagcggcctgcccaagttcgtgctgatcaactggaccggcgagggcgtgaacgacgtgagaaagggcgcctgcgccagccacgtgagcaccatggccagcttcctgaagggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagcagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12683 - DNA, 660 bp, Artificial Sequence
  Description of Artificial Sequence: Synthetic coding sequence
atggtggtgctgagcgtgcccgccgaggtgaccgtgatcctgctggacatcgagggcaccaccacccccatcgccttcgtgaaggacatcctgttcccctacatcgaggagaacgtgaaggagtacctgcagacccactgggaggaggaggagtgccagcaggacgtgagcctgctgagaaagcaggccgaggaggacgcccacctggacggcgccgtgcccatccccgccgccagcggcaacggcgtggacgacctgcagcagatgatccaggccgtggtggacaacgtgtgctggcagatgagcctggacagaaagaccaccgccctgaagcagctgcagggccacatgtggagagccgccttcaccgccggcagaatgaaggccgagttcttcgccgacgtggtgcccgccgtgagaaagtggagagaggccggcatgaaggtgtacatctacagcagcggcagcgtggaggcccagaagctgctgttcggccacagcaccgagggcgacatcctggagctggtggacggccacttcgacaccaagatcggccacaaggtggagagcgagagctacaaggactgcagacagcactgggtgctgaaccagcagcacttcgtgagcgacagatgctacagcagaggccagtgctgctag

SEQ ID NO: 12684 - DNA, 1446 bp, Artificial Sequence; identical to SEQ ID NO: 12062
  Description of Artificial Sequence: Synthetic coding sequence

SEQ ID NO: 12685 - DNA, 1644 bp, Artificial Sequence; identical to SEQ ID NO: 10555
  Description of Artificial Sequence: Synthetic coding sequence

SEQ ID NO: 12686 - DNA, 1887 bp, Artificial Sequence; identical to SEQ ID NO: 12474
  Description of Artificial Sequence: Synthetic coding sequence

SEQ ID NO: 12687 - DNA, 474 bp, Artificial Sequence
  Description of Artificial Sequence: Synthetic coding sequence
atgagaagcggcttcagatgcgacgagcccgccgaggccgtggcccccgagagacagaccgtgagcggcgccgtggccctggccagcttcaccagcccccacacccaccccgtggacgacggcggcagacactacagctggggcagccccaagagaatcctgggcctgggccccggcgacgccgccaaggaggccggcctggtgagacccctgcagggccagagcgagaagatcctgctgagaaccagaaacagacagcccatggagccccccatggagcccagcggcggcgagcaggagcccggcgccgtgagattcctggacctgccctgggaggacgtgctgctgccccacgtgctgaacagagtgcccctgagacagctgctgagactgcagagagtgagcagagccttcagaagcctggtgcagctgcacctggccggcctgagaagattcgacgccgcccaggtgtag

SEQ ID NO: 12688 - DNA, 483 bp, Artificial Sequence; identical to SEQ ID NO: 10977
  Description of Artificial Sequence: Synthetic coding sequence

SEQ ID NO: 12689 - DNA, 402 bp, Artificial Sequence
  Description of Artificial Sequence: Synthetic coding sequence
atggccgccctgagacccctggtgaagcccaagatcgtgaagaagagaaccaagaagttcatcagacaccagagcgacagatacgtgaagatcaagagaaactggagaaagcccagaggcatcgacaacagagtgagaagaagattcaagggccagatcctgatgcccaacatcggctacggcagcaacaagaagaccaagcacatgctgcccagcggcttcagaaagttcctggtgcacaacgtgaaggagctggaggtgctgctgatgtgcaacaagagctactgcgccgagatcgcccacaacgtgagcagcaagaacagaaaggccatcgtggagagagccgcccagctggccatcagagtgaccaaccccaacgccagactgagaagcgaggagtag

SEQ ID NO: 12690 - DNA, 639 bp, Artificial Sequence
  Description of Artificial Sequence: Synthetic coding sequence
atggacctgttcggcgacctgcccgagcccgagagaagccccagacccgccgccggcaaggaggcccagaagggccccctgctgttcgacgacctgccccccgccagcagcaccgacagcggcagcggcggccccctgctgttcgacgacctgccccccgccagcagcggcgacagcggcagcctggccaccagcatcagccagatggtgaagaccgagggcaagggcgccaagagaaagaccagcgaggaggagaagaacggcagcgaggagctggtggagaagaaggtgagcagcagcgtgatcttcggcctgaagggctacgtggccgagagaaagggcgagagagaggagatgcaggacgcccacgtgatcctgaacgacatcaccgaggagtgcagaccccccagcagcctgatcaccagagtgagctacttcgccgtgttcgacggccacggcggcatcagagccagcaagttcgccgcccagaacctgcaccagaacctgatcagaaagttccccaagggcgacgtgatcagcgtggagaagaccgtgaagagatgcctgctggacaccttcaagcacaccgacgaggagttcctgaagcaggccagcagccagaagcccgcctggaagtag

SEQ ID NO: 12691 - DNA, 1131 bp, Artificial Sequence; identical to SEQ ID NO: 10331
  Description of Artificial Sequence: Synthetic coding sequence

SEQ ID NO: 12692 - DNA, 1485 bp, Artificial Sequence
  Description of Artificial Sequence: Synthetic coding sequence
atggccgccgccgccgagtgcgacgtggtgatggccgccaccgagcccgagctgctggacgaccaggaggccaagagagaggccgagaccttcaaggagcagggcaacgcctactacgccaagaaggactacaacgaggcctacaactactacaccaaggccatcgacatgtgccccaagaacgccagctactacggcaacagagccgccaccctgatgatgctgggcagattcagagaggccctgggcgacgcccagcagagcgtgagactggacgacagcttcgtgagaggccacctgagagagggcaagtgccacctgagcctgggcaacgccatggccgcctgcagaagcttccagagagccctggagctggaccacaagaacgcccaggcccagcaggagttcaagaacgccaacgccgtgatggagtacgagaagatcgccgagaccgacttcgagaagagagacttcagaaaggtggtgttctgcatggacagagccctggagttcgcccccgcctgccacagattcaagatcctgaaggccgagtgcctggccatgctgggcagataccccgaggcccagagcgtggccagcgacatcctgagaatggacagcaccaacgccgacgccctgtacgtgagaggcctgtgcctgtactacgaggactgcatcgagaaggccgtgcagttcttcgtgcaggccctgagaatggcccccgaccacgagaaggcctgcatcgcctgcagaaacgccaaggccctgaaggccaagaaggaggacggcaacaaggccttcaaggagggcaactacaagctggcctacgagctgtacaccgaggccctgggcatcgaccccaacaacatcaagaccaacgccaagctgtactgcaacagaggcaccgtgaacagcaagctgagaaagctggacgacgccatcgaggactgcaccaacgccgtgaagctggacgacacctacatcaaggcctacctgagaagagcccagtgctacatggacaccgagcagtacgaggaggccgtgagagactacgagaaggtgtaccagaccgagaagaccaaggagcacaagcagctgctgaagaacgcccagctggagctgaagaagagcaagagaaaggactactacaagatcctgggcgtggacaagaacgccagcgaggacgagatcaagaaggcctacagaaagagagccctgatgcaccaccccgacagacacagcggcgccagcgccgaggtgcagaaggaggaggagaagaagttcaaggaggtgggcgaggccttcaccatcctgagcgaccccaagaagaagaccagatacgacagcggccaggacctggacgaggagggcatgaacatgggcgacttcgaccccaacaacatcttcaaggccttcttcggcggccccggcggcttcagcttcgaggccagcggccccggcaacttcttcttccagttcggctag

SEQ ID NO: 12693 - DNA, 1329 bp, Artificial Sequence
  Description of Artificial Sequence: Synthetic coding sequence
aacgaggtgtacaacctgacccaggagttcttcagacacgacaagcccgtgaacgccgagagccagaacagcgtgggcgtgttcaccagagaggaggtgagaaacagaatcagaaacgaccccgacgaccccgaggccaccaagagactgaagctggccatgatccagcagtacctgaaggtggagagctgcgagagcagcagccacagcatggacgaggtgagcctgagcgccttcggcgagtggaccgagatccccggcgcccaccacatcatccccagcggcttcatgagagtggtggagctgctggccgagggcatccccgcccacgtgatccagctgggcaagcccgtgagatgcatccactgggaccaggccagcgccagacccagaggccccgagatcgagcccagaggcgagggcgaccacaaccacgacaccggcgagggcggccagggcggcgaggagcccagaggcggcagatgggacgaggacgagcagtggagcgtggtggtggagtgcgaggactgcgagctgatccccgccgaccacgtgatcgtgaccgtgagcctgggcgtgctgaagagacagtacaccagcttcttcagacccggcctgcccaccgagaaggtggccgccatccacagactgggcatcggcaccaccgacaagatcttcctggagttcgaggagcccttctggggccccgagtgcaacagcctgcagttcgtgtgggaggacgaggccgagagccacaccctgacctacccccccgagctgtggtacagaaagatctgcggcttcgacgtgctgtacccccccgagagatacggccacgtgctgagcggctggatctgcggcgaggaggccctggtgatggagaagtgcgacgacgaggccgtggccgagatctgcaccgagatgctgagacagttcaccggcaaccccaacatccccaagcccagaagaatcctgagaagcgcctggggcagcaacccctacttcagaggcagctacagctacacccaggtgggcagcagcggcgccgacgtggagaagctggccaagcccctgccctacaccgagagcagcaagaccgcccacggcagcagcaccaagcagcagcccggccacctgttcagcagcaagtgccccgagcagcccctggacgccaacagaggcgccgtgaagcccatgcaggtgctgttcagcggcgaggccacccacagaaagtactacagcaccacccacggcgccctgctgagcggccagagagaggccgccagactgatcgagatgtacagagacctgttccagcagggcacctag

SEQ ID NO: 12694 - DNA, 180 bp, Artificial Sequence
  Description of Artificial Sequence: Synthetic coding sequence
atgagctactaccagagacccttcagccccagcgcctacagcctgcccgccagcctgaacagcagcatcgtgatgcagcacggcaccagcctggacagcaccgacacctacccccagcacgcccagagcctggacggcaccaccagcagcagcatccccctgtacagaagcagcgagtag

SEQ ID NO: 12695 - DNA, 837 bp, Artificial Sequence
  Description of Artificial Sequence: Synthetic coding sequence
atgaagtgcgagcactgcaccagaaaggagtgcagcaagaagaccaagaccgacgaccaggagaacgtgagcgccgacgcccccagccccgcccaggagaacggcgagaagggcgagttccacaagctggccgacgccaagatcttcctgagcgactgcctggcctgcgacagctgcatgaccgccgaggagggcgtgcagctgagccagcagaacgccaaggacttcttcagagtgctgaacctgaacaagaagtgcgacaccagcaagcacaaggtgctggtggtgagcgtgtgcccccagagcctgccctacttcgccgccaagttcaacctgagcgtgaccgacgccagcagaagactgtgcggcttcctgaagagcctgggctgggtgagatacgccgagagagtgctgggcagacccatcaccgcccacctgtgcaccgccaagagcccccagcaggtgatgggcagcctggtgaaggactacttcgccagacagcagaacctgagccccgagaagatcttccacgtgatcgtggccccctgctacgacaagaagctggaggccctgcaggagagcctgccccccgccctgcacggcagcagaggcgccgactgcgtgctgaccagcggcaccggcagcctgtgggagtgcacccccgtgatcaccgccacccaggaggccgccgccagagagagcctggagcccggcagacagagactgcagagagacaagatcgcccccctggacagcagcctgggcggcggcggcgagatcgcccagatcatggagcagggcgacctgagcgtgagagacgccgccgtggacacctag

SEQ ID NO: 12696 - DNA, 471 bp, Artificial Sequence
  Description of Artificial Sequence: Synthetic coding sequence
tgaggcaaggcccagagaaagatcagcgccatccacatcctggacgtgctggtgctgaacggcaccgacgtgagagagcagcacttcaaccagagaatccagctggccgagaagttcgtgaaggccgtgagcaagcccagcagacccgacatgaaccccatcagagtgaaggaggtgtacagactggaggagatggagaagatcttcgtgagactggagatgaagatcatcaagggcagcagcggcacccccaagctgagctacaccggcagagacgacagacacttcgtgcccatgggcctgtacatcgtgagaaccgtgaacgagccctggaccatgggcttcagcaagagcttcaagaagaagttcttctacaacaagaagaccaaggacagcaccttcgacctgcccgccgacagcatcgcccccttccacctgcccagcctggcctgcctgagcaagatggactag

SEQ ID NO: 12697 - DNA, 1200 bp, Artificial Sequence; identical to SEQ ID NO: 12045
  Description of Artificial Sequence: Synthetic coding sequence

SEQ ID NO: 12698 - DNA, 819 bp, Artificial Sequence
  Description of Artificial Sequence: Synthetic coding sequence
atggccagcctgctgcaggaccagctgaccaccgaccaggacctgctgctgatgcaggagggcatgcccatgagaaaggtgagaagcaagagctggaagaagctgagatacttcagactgcagaacgacggcatgaccgtgtggcacgccagacaggccagaggcagcgccaagcccagcttcagcatcagcgacgtggagaccatcagaaacggccacgacagcgagctgctgagaagcctggccgaggagctgcccctggagcagggcttcaccatcgtgttccacggcagaagaagcaacctggacctgatggccaacagcgtggaggaggcccagatctggatgagaggcctgcagctgctggtggacctggtgaccagcatggaccaccaggagagactggacagatggctgagcgactggttccagagaggcgacaagaaccaggacggcaagatgagcttccaggaggtgcagagactgctgcacctgatgaacgtggagatggaccaggagtacgccttcagcctgttccaggccgccgacaccagccagagcggcaccctggagggcgaggagttcgtgcagttctacaaggccctgaccaagagagccgaggtgcaggagctgttcgagagcttcagcgccgacggccagaagctgaccctgctggagttcctggacttcctgcaggaggagcagaaggagagagactgcaccagcgagctggccctggagctgatcgacagatacgagcccagcgacagcggcgccagcgaggaggaccccggcgagggcgaggaggtgaacacctag

SEQ ID NO: 12699 - DNA, 360 bp, Artificial Sequence; identical to SEQ ID NO: 11623
  Description of Artificial Sequence: Synthetic coding sequence

SEQ ID NO: 12700 - DNA, 1881 bp, Artificial Sequence; identical to SEQ ID NO: 10843
  Description of Artificial Sequence: Synthetic coding sequence

SEQ ID NO: 12701 - DNA, 189 bp, Artificial Sequence
  Description of Artificial Sequence: Synthetic coding sequence
atggccatggcccccagccccagcctggtgcaggtgtacaccagccccgccgccgtggccgtgtgggagtggcaggacggcctgggcacctggcacccctacagcgccaccgtgtgcagcttcatcgagcagcagttcgtgcagcagaagggccagagattcggcctgggcagcctggcccacagctag

SEQ ID NO: 12702 - DNA, 228 bp, Artificial Sequence
  Description of Artificial Sequence: Synthetic coding sequence
atgagactgagcctgcccctgctgctgctgctgctgggcgcctgggccatccccggcggcctgggcgacagagcccccctgaccgccaccgccccccagctggacgacgaggagatgtacagcgcccacatgcccgcccacctgagatgcgacgcctgcagagccgtggcctaccagagactgtgcagctaccccccccacctgcccctgaccgagcagcagagctag

SEQ ID NO: 12703 - DNA, 2619 bp, Artificial Sequence
  Description of Artificial Sequence: Synthetic coding sequence
atgggcgacagcgacgacgagtacgacagaagaagaagagacaagttcagaagagagagaagcgactacgacagaagcagagagagagacgagagaagaagaggcgacgactggaacgacagagagtgggacagaggcagagagagaagaagcagaggcgagtacagagactacgacagaaacagaagagagagattcagcccccccagacacgagctgagccccccccagaagagaatgagaagagactgggacgagcacagcagcgacccctaccacagcggctacgagatgccctacgccggcggcggcggcggccccacctacggccccccccagccctggggccaccccgacgtgcacatcatgcagcaccacgtgctgcccatccaggccagactgggcagcatcgccgagatcgacctgggcgtgcccccccccgtgatgaagaccttcaaggagttcctgctgagcctggacgacagcgtggacgagaccgaggccgtgaagagatacaacgactacaagctggacttcagaagacagcagatgcaggacttcttcctggcccacaaggacgaggagtggttcagaagcaagtaccaccccgacgaggtgggcaagagaagacaggaggccagaggcgccctgcagaacagactgagagtgttcctgagcctgatggagaccggctggttcgacaacctgctgctggacatcgacaaggccgacgccatcgtgaagatgctggacgccgccgtgatcaagatggagggcggcaccgagaacgacctgagaatcctggagcaggaggaggaggaggagcaggccggcaagcccggcgagcccagcaagaaggaggagggcagagccggcgccggcctgggcgacggcgagagaaagaccaacgacaaggacgagaagaaggaggacggcaagcaggccgagaacgacagcagcaacgacgacaagaccaagaagagcgagggcgacggcgacaaggaggagaagaaggaggacagcgagaaggaggccaagaagagcagcaagaagagaaacagaaagcacagcggcgacgacagcttcgacgagggcagcgtgagcgagagcgagagcgagagcgagagcggccaggccgaggaggagaaggaggaggccgaggaggccctgaaggagaaggagaagcccaaggaggaggagtgggagaagcccaaggacgccgccggcctggagtgcaagcccagacccctgcacaagacctgcagcctgttcatgagaaacatcgcccccaacatcagcagagccgagatcatcagcctgtgcaagagataccccggcttcatgagagtggccctgagcgagccccagcccgagagaagattcttcagaagaggctgggtgaccttcgacagaagcgtgaacatcaaggagatctgctggaacctgcagaacatcagactgagagagtgcgagctgagccccggcgtgaacagagacctgaccagaagagtgagaaacatcaacggcatcacccagcacaagcagatcgtgagaaacgacatcaagctggccgccaagctgatccacaccctggacgacagaacccagctgtgggccagcgagcccggcaccccccccctgcccaccagcctgcccagccagaaccccatcctgaagaacatcaccgactacctgatcgaggaggtgagcgccgaggaggaggagctgctgggcagcagcggcggcgccccccccgaggagccccccaaggagggcaaccccgccgagatcaacgtggagagagacgagaagctgatcaaggtgctggacaagctgctgctgtacctgagaatcgtgcacagcctggactactacaacacctgcgagtaccccaacgaggacgagatgcccaacagatgcggcatcatccacgtgagaggccccatgccccccaacagaatcagccacggcgaggtgctggagtggcagaagaccttcgaggagaagctgacccccctgctgagcgtgagagagagcctgagcgaggaggaggcccagaagatgggcagaaaggaccccgagcaggaggtggagaagttcgtgaccagcaacacccaggagctgggcaaggacaagtggctgtgccccctgagcggcaagaagttcaagggccccgagttcgtgagaaagcacatcttcaacaagcacgccgagaagatcgaggaggtgaagaaggaggtggccttcttcaacaacttcctgaccgacgccaagagacccgccctgcccgagatcaagcccgcccagccccccggccccgcccagagcctgacccccggcctgccctacccccaccagaccccccagggcctgatgccctacggccagcccagaccccccatcctgggctacggcgccggcgccgtgagacccgccgtgcccaccggcggccccccctacccccacgccccctacggcgccggcagaggcaactacgacgccttcagaggccagggcggctaccccggcaagcccagaaacagaatggtgagaggcgaccccagagccatcgtggagtacagagacctggacgcccccgacgacgtggacttcttctag

SEQ ID NO: 12704 - DNA, 483 bp, Artificial Sequence
  Description of Artificial Sequence: Synthetic coding sequence
tgacccgaggacgtgcaggccctggtgagcggcaagctggccctgagatacgccggcagacagaccgaggccctgaagtgcgtggcccaggccagcaagaacagaagcctggccgacttcgagaaggccctgaccgactacagagccgagctgagagacgaccccatcatcagcacccacctggccaagctgtacgacaacctgctggagcagaacctgatcagagtgatcgagcccttcagcagagtgcagatcgagcacatcagcagcctgatcaagctgagcaaggccgacgtggagagaaagctgagccagatgatcctggacaagaagttccacggcatcctggaccagggcgagggcgtgctgatcatcttcgacgagccccccgtggacaagacctacgaggccgccctggagaccatccagaacatgagcaaggtggtggacagcctgtacaacaaggccaagaagctgacctag

SEQ ID NO: 12705 - DNA, 3906 bp, Artificial Sequence
  Description of Artificial Sequence: Synthetic coding sequence
atgtggagaagaaagcaccccagaaccagcggcggcaccagaggcgtgctgagcggcaacagaggcgtggagtacggcagcggcagaggccacctgggcaccttcgagggcagatggagaaagctgcccaagatgcccgaggccgtgggcaccgaccccagcaccagcagaaagatggccgagctggaggaggtgaccctggacggcaagcccctgcaggccctgagagtgaccgacctgaaggccgccctggagcagagaggcctggccaagagcggccagaagagcgccctggtgaagagactgaagggcgccctgatgctggagaacctgcagaagcacagcaccccccacgccgccttccagcccaacagccagatcggcgaggagatgagccagaacagcttcatcaagcagtacctggagaagcagcaggagctgctgagacagagactggagagagaggccagagaggccgccgagctggagggcaagagcagcagcatcagcgaggagaagggcgacagcgacgacgagaagcccagaaagggcgagagaagaagcagcagagtgagacaggccagagccgccaagctgagcgagggcagccagcccgccgaggaggaggaggaccaggagacccccagcagaaacctgagagtgagagccgacagaaacctgaagaccgaggaggaggaggaggaggaggaggaggaggaggaggacgacgaggaggaggagggcgacgacgagggccagaagagcagagaggcccccatcctgaaggagttcaaggaggagggcgaggagatccccagagtgaagcccgaggagatgatggacgagagacccaagaccagaagccaggagcaggaggtgctggagagaggcggcagattcaccagaagccaggaggaggccagaaagagccacctggccagacagcagcaggagaaggagatgaagaccaccagccccctggaggaggaggagagagagatcaagagcagccagggcctgaaggagaagagcaagagccccagcccccccagactgaccgaggacagaaagaaggccagcctggtggccctgcccgagcagaccgccagcgaggaggagacccccccccccctgctgaccaaggaggccagcagcccccccccccacccccagctgcacagcgaggaggagatcgagcccatggagggccccgcccccgccgtgctgatccagctgagcccccccaacaccgacgccgacaccagagagctgctggtgagccagcacaccgtgcagctggtgggcggcctgagccccctgagcagccccagcgacaccaaggccgagagccccgccgagaaggtgcccgaggagagcgtgctgcccctggtgcagaagagcaccctggccgactacagcgcccagaaggacctggagcccgagagcgacagaagcgcccagcccctgcccctgaagatcgaggagctggccctggccaagggcatcaccgaggagtgcctgaagcagcccagcctggagcagaaggagggcagaagagccagccacaccctgctgcccagccacagactgaagcagagcgccgacagcagcagcagcagaagcagcagcagcagcagcagcagcagcagaagcagaagcagaagccccgacagcagcggcagcagaagccacagccccctgagaagcaagcagagagacgtggcccaggccagaacccacgccaaccccagaggcagacccaagatgggcagcagaagcaccagcgagagcagaagcagaagcagaagcagaagcagaagcgccagcagcaacagcagaaagagcctgagccccggcgtgagcagagacagcagcaccagctacaccgagaccaaggaccccagcagcggccaggaggtggccaccccccccgtgccccagctgcaggtgtgcgagcccaaggagagaaccagcaccagcagcagcagcgtgcaggccagaagactgagccagcccgagagcgccgagaagcacgtgacccagagactgcagcccgagagaggcagccccaagaagtgcgaggccgaggaggccgagccccccgccgccacccagccccagaccagcgagacccagaccagccacctgcccgagagcgagagaatccaccacaccgtggaggagaaggaggaggtgaccatggacaccagcgagaacagacccgagaacgacgtgcccgagccccccatgcccatcgccgaccaggtgagcaacgacgacagacccgagggcagcgtggaggacgaggagaagaaggagagcagcctgcccaagagcttcaagagaaagatcagcgtggtgagcgccaccaagggcgtgcccgccggcaacagcgacaccgagggcggccagcccggcagaaagagaagatggggcgccagcaccgccaccacccagaagaagcccagcatcagcatcaccaccgagagcctgaagagcctgatccccgacatcaagcccctggccggccaggaggccgtggtggacctgcacgccgacgacagcagaatcagcgaggacgagaccgagagaaacggcgacgacggcacccacgacaagggcctgaagatctgcagaaccgtgacccaggtggtgcccgccgagggccaggagaacggccagagagaggaggaggaggaggagaaggagcccgaggccgagccccccgtgcccccccaggtgagcgtggaggtggccctgcccccccccgccgagcacgaggtgaagaaggtgaccctgggcgacaccctgaccagaagaagcatcagccagcagaagagcggcgtgagcatcaccatcgacgaccccgtgagaaccgcccaggtgcccagcccccccagaggcaagatcagcaacatcgtgcacatcagcaacctggtgagacccttcaccctgggccagctgaaggagctgctgggcagaaccggcaccctggtggaggaggccttctggatcgacaagatcaagagccactgcttcgtgacctacagcaccgtggaggaggccgtggccaccagaaccgccctgcacggcgtgaagtggccccagagcaaccccaagttcctgtgcgccgactacgccgagcaggacgagctggactaccacagaggcctgctggtggacagacccagcgagaccaagaccgaggagcagggcatccccagacccctgcacccccccccccccccccccgtgcagcccccccagcaccccagagccgagcagagagagcaggagagagccgtgagagagcagtgggccgagagagagagagagatggagagaagagagagaaccagaagcgagagagagtgggacagagacaaggtgagagagggccccagaagcagaagcagaagcagagacagaagaagaaaggagagagccaagagcaaggagaagaagagcgagaagaaggagaaggcccaggaggagccccccgccaagctgctggacgacctgttcagaaagaccaaggccgccccctgcatctactggctgcccctgaccgacagccagatcgtgcagaaggaggccgagagagccgagagagccaaggagagagagaagagaagaaaggagcaggaggaggaggagcagaaggagagagagaaggaggccgagagagagagaaacagacagctggagagagagaagagaagagagcacagcagagagagagacagagagagagagagagagagagagagagacagaggcgacagagacagagacagagagagagacagagagagaggcagagagagagacagaagagacaccaagagacacagcagaagcagaagcagaagcacccccgtgagagacagaggcggcagaagatag

SEQ ID NO: 12706 - DNA, 231 bp, Artificial Sequence
  Description of Artificial Sequence: Synthetic coding sequence
atgctgctggagaacctgaccgacaacgagagcgagaacaccaacctgaagaagaaggtgttcgagaaggaggcccacatccaggagctgagctgcctgttccagagcgagaagagcctggagaccaagatcgccaagtggaacctgcagagcagaatgaacaagaacgaggccatcgtgatgaaggaggccagcagacagaagaccgtggccctgaagaaggccagctag

SEQ ID NO: 12707 - DNA, 1749 bp, Artificial Sequence
  Description of Artificial Sequence: Synthetic coding sequence
atggaggtgagagccagcctgcagaaggtgagcggcagcagcgacagcgtggccaccatgaacagcgaggagttcgtgctggtgccccagtacgccgacgacaacagcaccaagcacgaggagaagccccagctgaagatcgtgagcaacggcgacgagcagctggagaaggccatggaggagatcctgagagacagcgagaagagacccagcagcctgctggtggactgccagagcagcagcgagatcagcgaccacagcttcggcgacatccccgccagccagaccaacaagcccagcctgcagctgatcctggaccccagcaacaccgagatcagcacccccagacccagcagccccggcggcctgcccgaggaggacagcgtgctgttcaacaagctgacctacctgggctgcatgaaggtgagcagccccagaaacgaggtggaggccctgagagccatggccaccatgaagagcagcagccagtaccccttccccgtgaccctgtacgtgcccaacgtgcccgagggcagcgtgagaatcatcgaccagagcagcaacgtggagatcgccagcttccccatctacaaggtgctgttctgcgccagaggccacgacggcaccaccgagagcaactgcttcgccttcaccgagagcagccacggcagcgaggagttccagatccacgtgttcagctgcgagatcaaggaggccgtgagcagaatcctgtacagcttctgcaccgccttcaagagaagcagcagacaggtgagcgacgtgaaggacagcgtgatccccacccccgacagcgacgtgttcaccttcagcgtgagcctggaggtgaaggaggacgacggcaagggcaacttcagactgctggtgatccccatccccttcgagtacttcagccccgtgcccaaggacagagacaagttctacttcaagctgaagcagggcatcgagaagaaggtggtgatcaccgtgcagcagctgagcaacaaggagctggccatcgagagatgcttcggcatgctgctgagccccggcagaaacgtgaagaacagcgacatgcacctgctggacatggagagcatgggcaagagctacgacggcagagcctacgtgatcaccggcatgtggaaccccaacgcccccgtgttcctggccctgaacgaggagacccccaaggacaagcaggtgtacatgaccgtggccgtggacatggtggtgaccgaggtggtggagcccgtgagattcctgctggagaccgtggtgagagtgtaccccgccaacgagagattctggtacttcagcagaaagaccttcaccgagaccttcttcatgagactgaagcagagcgagggcaagggccacaccaacgccggcgacgccatctacgaggtggtgagcctgcagagagagagcgacaaggaggagcccgtgacccccaccagcggcggcggccccatgagcccccaggacgacgaggccgaggaggagagcgacaacgagctgagcagcggcaccggcgacgtgagcaaggactgccccgagaagatcctgtacagctggggcgagctgctgggcaagtggcacagcaacctgggcgccagacccaagggcctgagcaccctggtgaagagcggcgtgcccgaggccctgagagccgaggtgtggcagctgctggccggctgccacgacaaccaggccatgctggacagatacagaatcctgatcaccaagtag

SEQ ID NO: 12708 - DNA, 138 bp, Artificial Sequence
  Description of Artificial Sequence: Synthetic coding sequence
atggacgccgacagcgacgtggccctggacatcctgatcaccaacgtggtgtgcgtgttcagaaccagatgccacctgaacctgagaaagatcgccctggagggcgccaacgtgatctacaagagagacgtgggctag

SEQ ID NO: 12709 - DNA, 762 bp, Artificial Sequence
  Description of Artificial Sequence: Synthetic coding sequence
atggaggacgccccccagagactgagatggcaggcccacctggagttcacccacaaccacgacgtgggcgacctgacctgggacaagatcgccgtgagcctgcccagaagcgagaagctgagaagcctggtgctggccggcatcccccacggcatgagaccccagctgtggatgagactgagcggcgccctgcagaagaagagaaacagcgagctgagctacagagagatcgtgaagaacagcagcaacgacgagaccatcgccgccaagcagatcgagaaggacctgctgagaaccatgcccagcaacgcctgcttcgccagcatgggcagcatcggcgtgcccagactgagaagagtgctgagagccctggcctggctgtaccccgagatcggctactgccagggcaccggcatggtggccgcctgcctgctgctgttcctggaggaggaggacgccttctggatgatgagcgccatcatcgaggacctgctgcccgccagctacttcagcaccaccctgctgggcgtgcagaccgaccagagagtgctgagacacctgatcgtgcagtacctgcccagactggacaagctgctgcaggagcacgacatcgagctgagcctgatcaccctgcactggttcctgaccgccttcgccagcgtggtggacatcaagctgctgctgagaatctgggacctgttcttctacgagggcagcagagtgctgttccagctgaccctgggcatgctgcacctgaagtag

SEQ ID NO: 12710 - DNA, 336 bp, Artificial Sequence
  Description of Artificial Sequence: Synthetic coding sequence
tgacccctggtgaaggtgcagatcttcggcgtgagactggacaccgccagacaggagaccaactacgtggagaacaacggcttcaacccctactggggccagaccctgtgcttcagagtgctggtgcccgagctggccatgctgagattcgtggtgatggactacgactggaagagcagaaacgacttcatcggccagtacaccctgccctggacctgcatgcagcagggctacagacacatccacctgctgagcaaggacggcatcagcctgagacccgccagcatcttcgtgtacatctgcatccaggagggcctggagggcgacgagagctag

SEQ ID NO: 12711 - DNA, 552 bp, Artificial Sequence; identical to SEQ ID NO: 10168
  Description of Artificial Sequence: Synthetic coding sequence

SEQ ID NO: 12712 - DNA, 1215 bp, Artificial Sequence
  Description of Artificial Sequence: Synthetic coding sequence
atgatgctgagcaccgagggcagagagggcttcgtggtgaaggtgagaggcctgccctggagctgcagcgccgacgaggtgatgagattcttcagcgactgcaagatccagaacggcaccagcggcatcagattcatctacaccagagagggcagacccagcggcgaggccttcgtggagctggagagcgaggaggaggtgaagctggccctgaagaaggacagagagaccatgggccacagatacgtggaggtgttcaagagcaacagcgtggagatggactggatgaccctgcccgtggacttccagggcagaagcaccggcgaggccttcgtgcagttcgccagccaggagatcgccgagaaggccctgaagaagcacaaggagagaatcggccacagatacatcgagatcttcaagagcagcagagccgaggtgagaacccactacgacccccccagaaagctgatggccatgcagagacccggcccctacgacagacccggcgccggcagaggctacaacagcatcggcagaggcgccggcttcgagagaatgagaagaggcgcctacggcggcggctacggcggctacgacgactacggcggctacaacgacggctacggcttcggcagcgacagattcggcagagacctgaactactgcttcagcggcatgagcgaccacagatacggcgacggcggcagcagcttccagagcaccaccggccactgcgtgcacatgagaggcctgccctacagagccaccgagaacgacatctacaacttcttcagccccctgaaccccatgagagtgcacatcgagatcggccccgacggcagagtgaccggcgaggccgacgtggagttcgccacccacgaggacgccgtggccgccatggccaaggacaaggccaacatgcagcacagatacgtggagctgttcctgaacagcaccgccggcaccagcggcggcgcctacgaccacagctacgtggagctgttcctgaacagcaccgccggcgccagcggcggcgcctacggcagccagatgatgggcggcatgggcctgagcaaccagagcagctacggcggccccgccagccagcagctgagcggcggctacggcggcggctacggcggccagagcagcatgagcggctacgaccaggtgctgcaggagaacagcagcgactaccagagcaacctggcctag

SEQ ID NO: 12713 - DNA, 1545 bp, Artificial Sequence; identical to SEQ ID NO: 12127
  Description of Artificial Sequence: Synthetic coding sequence

SEQ ID NO: 12714 - DNA, 2928 bp, Artificial Sequence
  Description of Artificial Sequence: Synthetic coding sequence
atgaagttcgtgagcgaggacctgcacagatgcgccctgctgaccgccgacagcttcggcgaccccttcttccccagaaccacccagatcctgctggagtaccagctgggcagatgggtgcccagactgagagagcccagagacctgtacggcgtgagcagcagcggccccctgagccccaccagatggccctaccactgcgaggtgatcgacgagaaggtgcagcacatcgactggacccccagctgccccgagcccgtgtacatccccaccggcctggagaccgagcccctgtaccccgacagcaaggaggccaccgtggtgtacctggccgaggacgcctacaaggagccctgcttcgtgtacagcagagtgggcggcaacagaacccccctgaagcagcccgtggactacagagacaacaccctgatgttcgaggccagattcgagagcggcaacctgcagaaggtggtgaaggtggccgagtacgagtaccagctgaccgtgagacccgacctgttcaccaacaagcacacccagtggtactacttccaggtgaccaacatgagagccggcatcgtgtacagattcaccatcgtgaacttcaccaagcccgccagcctgtacagcagaggcatgagacccctgttctacagcgagaaggaggccaaggcccaccacatcggctggcagagaatcggcgaccagatcaagtactacagaaacaaccccggccaggacggcagacactacttcagcctgacctggaccttccagttcccccacaacaaggacacctgctacttcgcccactgctacccctacacctacaccaacctgcaggagtacctgagcggcatcaacaacgaccccgtgagaagcaagttctgcaagatcagagtgctgtgccacaccctggccagaaacatggtgtacatcctgaccatcaccacccccctgaagaacagcgacagcagaaagagaaaggccgtgatcctgaccgccagagtgcaccccggcgagaccaacagcagctggatcatgaagggcttcctggactacatcctgggcaacagcagcgacgcccagctgctgagagacaccttcgtgttcaaggtggtgcccatgctgaaccccgacggcgtgatcgtgggcaactacagatgcagcctggccggcagagacctgaacagaaactacaccagcctgctgaaggagagcttccccagcgtgtggtacaccagaaacatggtgcacagactgatggagaagagagaggtgatcctgtactgcgacctgcacggccacagcagaaaggagaacatcttcatgtacggctgcgacggcagcgacagaagcaagaccctgtacctgcagcagagaatcttccccctgatgctgagcaagaactgccccgacaagttcagcttcagcgcctgcaagttcaacgtgcagaagagcaaggagggcaccggcagagtggtgatgtggaagatgggcatcagaaacagcttcaccatggaggccaccttctgcggcagcaccctgggcaacaagagaggcacccacttcagcaccaaggacctggagagcatgggctaccacttctgcgacagcctgctggactactgcgaccccgacagaaccaagtactacagatgcctgaaggagctggaggagatggagagacacatcaccctggagaaggtgttcgaggacagcgacacccccgtgatcgacatcaccctggacgtggagagcagcagcagaggcagcgacagcagcgagagcatcgacagcctgacctacctgctgaagctgaccagccagaagaagcacctgaagaccaagaaggagagaaacagcaccatcgccagccaccagaacgccagaggccaggaggtgtacgacagaggccacctgctgcagagacacacccagagcaacagcgacgtgaaggacaccagacccaacgagcccgacgactacatggtggactacttcagaagacagctgcccaaccagggcctggcccactgcaagctgagactgcccggcagcagacacagccccgccagcgccagcagagtggccggcaccaccggcaccagacaccacacctggctgatcttcgtgttcctggtggagatgggcaagaagatccccctgaagggcaccgacctgtacggcaactgcttcaaggtgaccagcctgcagagccccatgggcaagcagaccagcacctggaccgagaagaccagaatccccaccgaggacctgcaccacaacctgaagagcaagatcaaggagtgcatcagcttccagagcaagaagaccggcatcaactggaccgacgacgagaagagaagctacaaggacaagggcatcgtgcagacccaggagatcctgcagtacctgctgcccatcgtgcacagcaccaagaacatgcagaccacccagatcaagcagctgttcaaccccagaaccaacttccagatccagcaccagctgaaccccgccacctgcagaaacatcaagaagtacagcaccagctggaccgcccccagaaaccaccccttcgtgatccagggcgacgtgatggccaacagcagcgagtgggtgcagagcaagccccacagaagcctggagagcctgagccccctgaagggccccaagaagaacaagcacagccagatctgggccatcaagaacgaggacatcaagcccctgagcagcaagtgggagaccgccagcagcagcttcggcatggacgccaacgtgctgaagtacaagagcctgcaggccgaggagaccaaccagcagagcagcaagcacaccgccctgcacctgaccaagaacaaggacgagcaggccaacaagaacgacggccagcccaccctgtacctgaagttccagagagagagctag

SEQ ID NO: 12715 - DNA, 1626 bp, Artificial Sequence
  Description of Artificial Sequence: Synthetic coding sequence
atgagcagcagcggctacccccccaaccagggcgccttcagcaccgagcagagcagataccccccccacagcgtgcagtacaccttccccaacaccagacaccagcaggagttcgccgtgcccgactacagaagcagccacctggaggtgagccaggccagccagctgctgcagcagcagcagcagcagcagctgagaagaagacccagcctgctgagcgagttccaccccggcagcgacagaccccaggagagaagaaccagctacgagcccttccaccccggccccagccccgtggaccacgacagcctggagagcaagagacccagactggagcaggtgagcgacagccacttccagagagtgagcgccgccgtgctgcccctggtgcaccccctgcccgagggcctgagagccagcgccgacgccaagaaggaccccgccttcggcggcaagcacgaggcccccagcagccccatcagcggccagccctgcggcgacgaccagaacgccagccccagcaagctgagcaaggaggagctgatccagagcatggacagagtggacagagagatcgccaaggtggagcagcagatcctgaagctgaagaagaagcagcagcagctggaggaggaggccgccaagccccccgagcccgagaagcccgtgagccccccccccgtggagcagaagcacagaagcatcgtgcagatcatctacgacgagaacagaaagaaggccgaggaggcccacaagatcttcgagggcctgggccccaaggtggagctgcccctgtacaaccagcccagcgacaccaaggtgtaccacgagaacatcaagaccggcgtgcccgccagaagaatgatgaagaaccaggtgatgagaaagaagctgatcctgttcttcaagagaagaaaccacgccagaaagcagagagagcagaagatctgccagagatacgaccagctgatggaggcctgggagaagaaggtggacagaatcgagaacaaccccagaagaaaggccaaggagagcaagaccagagagtactacgagaagcagttccccgagatcagaaagcagagagagcagcaggagagattccagagagtgggccagagaggcgccggcctgagcgccaccatcgccagaagcgagcacgagatcagcgagatcatcgacggcctgagcgagcaggagaacaacgagaagcagatgagacagctgagcgtgatcccccccatgatgttcgacgccgagcagagaagagtgaagttcatcaacatgaacggcctgatggaggaccccatgaaggtgtacaaggacagacagttcatgaacgtgtggaccgaccacgagaaggagatcttcaaggacaagttcatccagcaccccaagaacttcggcctgatcgccagctacctggagagaaagagcgtgcccgactgcgtgctgtactactacctgaccaagaagaacgagaactacaaggccctggtgagaagaaactacggcaagagaagaggcagaaaccagcagatcgccagacccagccaggaggagaaggtggaggagaaggaggaggacaaggccgagaagaccgagaagaaggaggaggagaagtag

SEQ ID NO: 12716 - DNA, 840 bp, Artificial Sequence
  Description of Artificial Sequence: Synthetic coding sequence
atgaagttccccttcctgcccatcctggtgatgaagttcatcgagaaggcccagaacatgagcaagtacgtgctgatcgacacccccggccagatcgaggtgttcacctggagcgccagcggcaccatcatcaccgaggccctggccagcagcttccccaccgtggtgatctacgtgatggacaccagcagaagcaccaaccccgtgaccttcatgagcaacatgctgtacgcctgcagcatcctgtacaagaccaagctgcccttcatcgtggtgatgaacaagaccgacatcatcgaccacagcttcgccgtggagtggatgcaggacttcgaggccttccaggacgccctgaaccaggagaccacctacgtgagcaacctgaccagaagcatgagcctggtgctggacgagttctacagcagcctgagagtggtgggcgtgagcgccgtgctgggcaccggcctggacgagctgttcgtgcaggtgaccagcgccgccgaggagtacgagagagagtacagacccgagtacgagagactgaagaagagcctggccaacgccgagagccagcagcagagagagcagctggagagactgagaaaggacatgggcagcgtggccctggacgccggcaccgccaaggacagcctgagccccgtgctgcaccccagcgacctgatcctgaccagaggcaccctggacgaggaggacgaggaggccgacagcgacaccgacgacatcgaccacagagtgaccgaggagagccacgaggagcccgccttccagaacttcatgcaggagagcatggcccagtactggaagagaaacaacaagtag

SEQ ID NO: 12717 - DNA, 1230 bp, Artificial Sequence
  Description of Artificial Sequence: Synthetic coding sequence
atgaaggacacccaggacatccaggaggccagcaaggccatgcagaacaaggtgcacgagcaggaggacaagaacgagaagcagaagcagagagaggacaagctgggcgtgtacagcctggtgcacttcagccccaagatgctgggcagcgtggccaccaccctgcccctgagcagcagcaacagcagcggcatgcccctgggctactacctgagcagcccccagatcagcagagtgaccatcagcaccaccggccagctgaccagcaaggccaccgtgggcagctgcagcagagtggagaacagcctggacgccagccccttcagcgtgcccaagaagcaggacgagagccccatgatcggcgacggcgaggactacttcctgagcctgttcggcgacagcaagaagctgaccgcccacagcaactacacccagaagaccctgaagtacttcagcatgatcctggaggaggtgggccagttcaccagcagcagcctgggcgacgtggagatcgccgaggtgaacgtgaagggcctgttcgtgaagctgatcaacagcagcctggacaaggagatggccatcggcgaccacatcctgcagcagaacgtgaacggccagaccatcagcctgtacagattcctgcccaacatcgtgatgcaggccaacagcaccgtgaccgtgtgggccgccgccagcgaggccaagcaccagccccccagcgacttcctgtggaaggagcaggacaagttcagagccagccccgactgcatcaccatcctgtgcaagcccaacggccaggccatcgcctggtacacccccatccactggaagcaggcctgggagaagctggacgccgacgtggagttcaacagatgcagcgtggtgagccccaccttcagaaagagagtgttccagtggaccgccagcaccgccaccatcaccaaggagaagcaggaccagcccaagaaggacatcagcaactaccaggtggagcaggcccaggtgctgctgaagagagagaaggagatcccccccaccgtgttccccaacagaagcccctggtgccagaacccctacgtgagcgcccacccctactgccccctgatcgagccccacaacaccagcaccgccggcggcagactggacagacagcccagaaccagaagcaccagacccaacagagccagcggcagcaagaagaagaagaccagcgagagccagaagcagtag

SEQ ID NO: 12718 - DNA, 2442 bp, Artificial Sequence; identical to SEQ ID NO: 11863
  Description of Artificial Sequence: Synthetic coding sequence

SEQ ID NO: 12719 - DNA, 1773 bp, Artificial Sequence
  Description of Artificial Sequence: Synthetic coding sequence
atgcccagcccccagctgctggtgctgttcggcagccagaccggcaccgcccaggacgtgagcgagagactgggcagagaggccagaagaagaagactgggctgcagagtgcaggccctggacagctaccccgtggtgaacctgatcaacgagcccctggtgatcttcgtgtgcgccaccaccggccagggcgacccccccgacaacatgaagaacttctggagattcatcttcagaaagaacctgcccagcaccgccctgtgccagatggacttcgccgtgctgggcctgggcgacagcagctacgccaagttcaacttcgtggccaagaagctgcacagaagactgctgcagctgggcggcagcgccctgctgcccgtgtgcctgggcgacgaccagcacgagctgggccccgacgccgccgtggacccctggctgagagacctgtgggacagagtgctgggcctgtacccccccccccccggcctgaccgagatcccccccggcgtgcccctgcccagcaagttcaccctgctgttcctgcaggaggcccccagcaccggcagcgagggccagagagtggcccaccccggcagccaggagccccccagcgagagcaagcccttcctggcccccatgatcagcaaccagagagtgaccggccccagccacttccaggacgtgagactgatcgagttcgacatcctgggcagcggcatcagcttcgccgccggcgacgtggtgctgatccagcccagcaacagcgccgcccacgtgcagagattctgccaggtgctgggcctggaccccgaccagctgttcatgctgcagcccagagagcccgacgtgagcagccccaccagactgccccagccctgcagcatgagacacctggtgagccactacctggacatcgccagcgtgcccagaagaagcttcttcgagctgctggcctgcctgagcctgcacgagctggagagagagaagctgctggagttcagcagcgcccagggccaggaggagctgttcgagtactgcaacagacccagaagaaccatcctggaggtgctgtgcgacttcccccacaccgccgccgccatcccccccgactacctgctggacctgatccccgtgatcagacccagagccttcagcatcgccagcagcctgctgatcctggtggccgtggtgcagttccagaccagactgaaggagcccagaagaggcctgtgcagcagctggctggccagcctggaccccggccagggccccgtgagagtgcccctgtgggtgagacccggcagcctggccttccccgagacccccgacacccccgtgatcatggtgggccccggcaccggcgtggcccccttcagagccgccatccaggagagagtggcccagggccagaccggcaacttcctgttcttcggctgcagatggagagaccaggacttctactgggaggccgagtggcaggagctggagaagagagactgcctgaccctgatccccgccttcagcagagagcaggagcagaaggtgtacgtgcagcacagactgagagagctgggcagcctggtgtgggagctgctggacagacagggcgcctacttctacctggccggcaacgccaagagcatgcccgccgacgtgagcgaggccctgatgagcatcttccaggaggagggcggcctgtgcagccccgacgccgccgcctacctggccagactgcagcagaccagaagattccagaccgagacctgggcctag

SEQ ID NO: 12720 - DNA, 2436 bp, Artificial Sequence; identical to SEQ ID NO: 10003
  Description of Artificial Sequence: Synthetic coding sequence

SEQ ID NO: 12721 - DNA, 189 bp, Artificial Sequence
  Description of Artificial Sequence: Synthetic coding sequence
atgcccgagatcagagtgacccccctgggcgcctgccccgtgctgagctggaacctggtgctgccccccggcagaggcagcagagcccccagcagcaccgacaccagaaccggcttccacgtgctgccccacggcgtgagcgccagcagcgagggcgcccccagacccggcgtggacaccgtgctgtag

SEQ ID NO: 12722 - DNA, 948 bp, Artificial Sequence
  Description of Artificial Sequence: Synthetic coding sequence
atgagcggcctggtgctgggccagagagacgagcccgccggccacagactgagccaggaggagatcctgggcagcaccagactggtgagccagggcctggaggccctgagaagcgagcaccaggccgtgctgcagagcctgagccagaccatcgagtgcctgcagcagggcggccacgaggagggcctggtgcacgagaaggccagacagctgagaagaagcatggagaacatcgagctgggcctgagcgaggcccaggtgatgctggccctggccagccacctgagcaccgtggagagcgagaagcagaagctgagagcccaggtgagaagactgtgccaggagaaccagtggctgagagacgagctggccggcacccagcagagactgcagagaagcgagcaggccgtggcccagctggaggaggagaagaagcacctggagttcctgggccagctgagacagtacgacgaggacggccacaccagcgaggagaaggagggcgacgccaccaaggacagcctggacgacctgttccccaacgaggaggaggaggaccccagcaacggcctgagcagaggccagggcgccaccgccgcccagcagggcggctacgagatccccgccagactgagaaccctgcacaacctggtgatccagtacgccgcccagggcagatacgaggtggccgtgcccctgtgcaagcaggccctggaggacctggagagaaccagcggcagaggccaccccgacgtggccaccatgctgaacatcctggccctggtgtacagagaccagaacaagtacaaggaggccgcccacctgctgaacgacgccctgagcatcagagagagcaccctgggccccgaccaccccgccgtgagcatcccctgccccccccaccccacccccagaaccccccaccactgctgcttcggcctgagctag

SEQ ID NO: 12723 - DNA, 2055 bp, Artificial Sequence; identical to SEQ ID NO: 9385
  Description of Artificial Sequence: Synthetic coding sequence

SEQ ID NO: 12724 - DNA, 4050 bp, Artificial Sequence
  Description of Artificial Sequence: Synthetic coding sequence
atggaggagaacgagagccagaagtgcgagccctgcctgccctacagcgccgacagaagacagatgcaggagcagggcaagggcaacctgcacgtgaccagccccgaggacgccgagtgcagaagaaccaaggagagactgagcaacggcaacagcagaggcagcgtgagcaagagcagcagaaacatccccagaagacacaccctgggcggccccagaagcagcaaggagatcctgggcatgcagaccagcgagatggacagaaagagagaggccttcctggagcacctgaagcagaagtacccccaccacgccagcgccatcatgggccaccaggagagactgagagaccagaccagaagccccaagctgagccacagcccccagccccccagcctgggcgaccccgtggagcacctgagcgagaccagcgccgacagcctggaggccatgagcgagggcgacgcccccacccccttcagcagaggcagcagaaccagagccagcctgcccgtggtgagaagcaccaaccagaccaaggagagaagcctgggcgtgctgtacctgcagtacggcgacgagaccaagcagctgagaatgcccaacgagatcaccagcgccgacaccatcagagccctgttcgtgagcgccttcccccagcagctgaccatgaagatgctggagagccccagcgtggccatctacatcaaggacgagagcagaaacgtgtactacgagctgaacgacgtgagaaacatccaggacagaagcctgctgaaggtgtacaacaaggaccccgcccacgccttcaaccacacccccaagaccatgaacggcgacatgagaatgcagagagagctggtgtacgccagaggcgacggccccggcgcccccagacccggcagcaccgcccaccccccccacgccatccccaacagcccccccagcacccccgtgccccacagcatgccccccagccccagcagaatcccctacggcggcaccagaagcatggtggtgcccggcaacgccaccatccccagagacagaatcagcagcctgcccgtgagcagacccatcagccccagccccagcgccatcctggagagaagagacgtgaagcccgacgaggacatgagcggcaagaacatcgccatgtacagaaacgagggcttctacgccgacccctacctgtaccacgagggcagaatgagcatcgccagcagccacggcggccaccccctggacgtgcccgaccacatcatcgcctaccacagaaccgccatcagaagcgccagcgcctactgcaaccccagcatgcaggccgagatgcacatggagcagagcctgtacagacagaagagcagaaagtaccccgacagccacctgcccaccctgggcagcaagaccccccccgccagcccccacagagtgagcgacctgagaatgatcgacatgcacgcccactacaacgcccacggccccccccacaccatgcagcccgacagagccagccccagcagacaggccttcaagaaggagcccggcaccctggtgtacatcgagaagcccagaagcgccgccggcctgagcagcctggtggacctgggcccccccctgatggagaagcaggtgttcgcctacagcaccgccaccatccccaaggacagagagaccagcgagaagatgatgaagaccaccgccaacagaaaccacaccgacagcgccggcaccccccacgtgagcggcggcaagatgctgagcgccctggagagcaccgtgccccccagccagcccccccccgtgggcaccagcgccatccacatgagcctgctggagatgagaagaagcgtggccgagctgagactgcagctgcagcagatgagacagctgcagctgcagaaccaggagctgctgagagccatgatgaagaaggccgagctggagatcagcggcaaggtgatggagaccatgaagagactggaggaccccgtgcagagacagagagtgctggtggagcaggagagacagaagtacctgcacgaggaggagaagatcgtgaagaagctgtgcgagctggaggacttcgtggaggacctgaagaaggacagcaccgccgccagcagactggtgaccctgaaggacgtggaggacggcgccttcctgctgagacaggtgggcgaggccgtggccaccctgaagggcgagttccccaccctgcagaacaagatgagagccatcctgagaatcgaggtggaggccgtgagattcctgaaggaggagccccacaagctggacagcctgctgaagagagtgagaagcatgaccgacgtgctgaccatgctgagaagacacgtgaccgacggcctgctgaagggcaccgacgccgcccaggccgcccagtacatggccatggagaaggccaccgccgccgaggtgctgaagagccaggaggaggccgcccacaccagcggccagcccttccacagcaccggcgcccccggcgacgccaagagcgaggtggtgcccctgagcggcatgatggtgagacacgcccagagcagccccgtggtgatccagcccagccagcacagcgtggccctgctgaaccccgcccagaacctgccccacgtggccagcagccccgccgtgccccaggaggccaccagcaccctgcagatgagccaggccccccagagcccccagatccccatgaacggcagcgccatgcagagcctgttcatcgaggagatccacagcgtgagcgccaagaacagagccgtgagcatcgagaaggccgagaagaagtgggaggagaagagacagaacctggaccactacaacggcaaggagttcgagaagctgctggaggaggcccaggccaacatcatgaagagcatccccaacctggagatgccccccgccaccggccccctgcccagaggcgacgcccccgtggacaaggtggagctgagcgaggacagccccaacagcgagcaggacctggagaagctgggcggcaagagcccccccccccccccccccccccccagaagaagctacctgcccggcagcggcctgaccaccaccagaagcggcgacgtggtgtacaccggcagaaaggagaacatcaccgccaaggccagcagcgaggacgccggccccagcccccagaccagagccaccaagtaccccgccgaggagcccgccagcgcctggacccccagccccccccccgtgaccaccagcagcagcaaggacgaggaggaggaggaggaggagggcgacaagatcatggccgagctgcaggccttccagaagtgcagcttcatggacgtgaacagcaacagccacgccgagcccagcagagccgacagccacgtgaaggacaccagaagcggcgccaccgtgccccccaaggagaagaagggcagcagcggcgccccccagaccagcagaatgcccgtgcccatgagcgccaagaacagacccggcaccctggacaagcccggcaagcagagcaagctgcaggaccccagacagtacagacaggccaacggcagcgccaagaagagcggcggcgacttcaagcccaccagccccagcctgcccgccagcaagatccccgccctgagccccagcagcggcaagagcagcagcctgcccagcagcagcggcgacagcagcaacctgcccaacccccccgccaccaagcccagcatcgccagcaaccccctgagcccccagaccggcccccccgcccacagcgccagcctgatccccagcgtgagcaacggcagcctgaagttccagagcctgacccacaccggcaagggccaccacctgagcttcagcccccagagccagaacggcagagcccccccccccctgagcttcagcagcagcccccccagccccgccagcagcgtgagcctgaaccagggcgccaagggcaccagaaccatccacacccccagcctgaccagctacaaggcccagaacggcagcagcagcaaggccacccccagcaccgccaaggagaccagctag

SEQ ID NO: 12725 - DNA, 177 bp, Artificial Sequence
  Description of Artificial Sequence: Synthetic coding sequence
tgaatcatccacaagctggccatgcagctgagacacatcggcgacaacatcgaccacagaatggtgagagaggacctgcagcaggacggcagagacgccctggaccacttcgtgttcttcttcttcagaagagtgcaggtgctgctgcacttcttctggaacaaccacctgctgtag

SEQ ID NO: 12726 - DNA, 429 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgccctgcccagcgacgtgcagaccgccatcaagagcgagctgctgatgatcatccagatggagacccagagcagcatgagaaagaaggtgtgcgacatcgccgccgagctggccagaaacctgatcggcgtgtactag

SEQ ID NO: 12727 - DNA, 93 bp, Artificial Sequence
  Description of Artificial Sequence: Synthetic coding sequence
atgggcagcagaaagaaggagatcgccctgcaggtgaacatcagcacccaggagctgtgggaggagatgctgagcagcaagggcctgacctag

SEQ ID NO: 12728 - DNA, 645 bp, Artificial Sequence; identical to SEQ ID NO: 9749
  Description of Artificial Sequence: Synthetic coding sequence

SEQ ID NO: 12729 - DNA, 1158 bp, Artificial Sequence; identical to SEQ ID NO: 9880
  Description of Artificial Sequence: Synthetic coding sequence

SEQ ID NO: 12730 - DNA, 255 bp, Artificial Sequence
  Description of Artificial Sequence: Synthetic coding sequence
atgagcggcctggtgctgggccagagagacgagcccgccggccacagactgagccaggaggagatcctgggcagcaccagactggtgagccagggcctggaggccctgagaagcgagcaccaggccgtgctgcagagcctgagccagaccatcgagtgcctgcagcagggcggccacgaggagggcctggtgcacgagaaggccagacagctgagaagaagcatggagaacatcgagctgggcctgagcgagtag

SEQ ID NO: 12731 - DNA, 483 bp, Artificial Sequence
  Description of Artificial Sequence: Synthetic coding sequence
atgagcgtgaacagcgagaagagcagcagcagcgagagacccgagccccagcagaaggcccccctggtgcccccccccccccccccccccccccccccccccccccccctgcccgaccccaccccccccgagcccgaggaggagatcctgggcagcgacgacgaggagcaggaggaccccgccgactactgcaagggcggctaccaccccgtgaagatcggcgacctgttcaacggcagataccacgtgatcagaaagctgggctggggccacttcagcaccgtgtggctgtgctgggacatgcagggcaagagattcgtggccatgaaggtggtgaagagcgcccagcactacaccgagaccgccctggacgagatcaagctgctgaagtgcgtgagagagagcgaccccagcgaccccaacaaggacatggtggtgcagctgatcgacgacttcaagatcagcggcatgaacggcatctag

SEQ ID NO: 12732 - DNA, 66 bp, Artificial Sequence
  Description of Artificial Sequence: Synthetic coding sequence
atgaaccccgccagcgcccccccccccctgcccccccccggccagcaggtgatccacgtgacctag

SEQ ID NO: 12733 - DNA, 1212 bp, Artificial Sequence; identical to SEQ ID NO: 9962
  Description of Artificial Sequence: Synthetic coding sequence

SEQ ID NO: 12734 - DNA, 5106 bp, Artificial Sequence; identical to SEQ ID NO: 9923
  Description of Artificial Sequence: Synthetic coding sequence

SEQ ID NO: 12735 - DNA, 408 bp, Artificial Sequence
  Description of Artificial Sequence: Synthetic coding sequence
atgggcaagagctgcaaggtggtggtgtgcggccaggccagcgtgggcaagaccagcatcctggagcagctgctgtacggcaaccacgtggtgggcagcgagatgatcgagacccaggaggacatctacgtgggcagcatcgagaccgacagaggcgtgagagagcaggtgaccatcgtggtgctgggcaacaagtgcgacctgcaggagcagagaagagtggaccccgacgtggcccagcactgggccaagagcgagaaggtgaagctgtgggaggtgagcgtggccgacagaagaagcctgctggagcccttcgtgtacctggccagcaagatgacccagccccagagcaagagcgccttccccctgagcagaaagaacaagggcagcggcagcctggacggctag

SEQ ID NO: 12736 - DNA, 3693 bp, Artificial Sequence; identical to SEQ ID NO: 10512
  Description of Artificial Sequence: Synthetic coding sequence

SEQ ID NO: 12737 - DNA, 267 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgtag

SEQ ID NO: 12738 - DNA, 3627 bp, Artificial Sequence; identical to SEQ ID NO: 10567
  Description of Artificial Sequence: Synthetic coding sequence

SEQ ID NO: 12739 - DNA, 1743 bp, Artificial Sequence
  Description of Artificial Sequence: Synthetic coding sequence
atggtgctggtgggcacccaggacgccatcagcgccgccaaccccagagtgatcgacgacagcagagccagaaagctgagcaccgacctgaagagatgcacctactacgagacctgcgccacctacggcctgaacgtggagagagtgttccaggacgtggcccagaaggtggtggccctgagaaagaagcagcagctggccatcggcccctgcaagagcctgcccaacagccccagccacagcgccgtgagcgccgccagcatccccgccgtgcacatcaaccaggccaccaacggcggcggcagcgccttcagcgactacagcagcagcgtgcccagcacccccagcatcagccagagagagctgagaatcgagaccatcgccgccagcagcacccccacccccatcagaaagcagagcaagagaagaagcaacatcttcaccagcagaaagggcgccgacctggacagagagaagaaggccgccgagtgcaaggtggacagcatcggcagcggcagagccatccccatcaagcagggcatcctgctgaagagaagcggcaagagcctgaacaaggagtggaagaagaagtacgtgaccctgtgcgacaacggcctgctgacctaccaccccagcctgcacgactacatgcagaacatccacggcaaggagatcgacctgctgagaaccaccgtgaaggtgcccggcaagagactgcccagagccacccccgccaccgcccccggcaccagccccagagccaacggcctgagcgtggagagaagcaacacccagctgggcggcggcaccgaggccgaggagagcttcgagttcgtggtggtgagcctgaccggccagacctggcacttcgaggccagcaccgccgaggagagagagctgtgggtgcagagcgtgcaggcccagatcctggccagcctgcagggctgcagaagcgccaaggacaagaccagactgggcaaccagaacgccgccctggccgtgcaggccgtgagaaccgtgagaggcaacagcttctgcatcgactgcgacgcccccaaccccgactgggccagcctgaacctgggcgccctgatgtgcatcgagtgcagcggcatccacagacacctgggcgcccacctgagcagagtgagaagcctggacctggacgactggccccccgagctgctggccgtgatgaccgccatgggcaacgccctggccaacagcgtgtgggagggcgccctgggcggctacagcaagcccggccccgacgcctgcagagaggagaaggagagatggatcagagccaagtacgagcagaagctgttcctggcccccctgcccagcagcgacgtgcccctgggccagcagctgctgagagccgtggtggaggacgacctgagactgctggtgatgctgctggcccacggcagcaaggaggaggtgaacgagacctacggcgacggcgacggcagaaccgccctgcacctgagcagcgccatggccaacgtggtgttcacccagctgctgatctggtacggcgtggacgtgagaagcagagacgccagaggcctgacccccctggcctacgccagaagagccggcagccaggagtgcgccgacatcctgatccagcacggctgccccggcgagggctgcggcctggcccccacccccaacagagagcccgccaacggcaccaaccccagcgccgagctgcacagaagccccagcctgctgtag

SEQ ID NO: 12740 - DNA, 312 bp, Artificial Sequence
  Description of Artificial Sequence: Synthetic coding sequence
atggccgagctgatccagaagaagctgcagggcgaggtggagaagtaccagcagctgcagaaggacctgagcaagagcatgagcggcagacagaagctggaggcccagctgaccgagaacaacatcgtgaaggaggagctggccctgctggacggcagcaacgtggtgttcaagctgctgggccccgtgctggtgaagcaggagctgggcgaggccagagccaccgtgggcaagagactggactacatcaccgccgagatcttcctgagaaccatccccgaccccggcgacgtgcccgacagcttcttctag

SEQ ID NO: 12741 - DNA, 453 bp, Artificial Sequence
  Description of Artificial Sequence: Synthetic coding sequence
atgaccagcagaaagaaggtgctgctgaaggtgatcatcctgggcgacagcggcgtgggcaagaccagcctgatgaaccagtacgtgaacaagaagttcagcaaccagtacaaggccaccatcggcgccgacttcctgaccaaggaggtgatggtggacgacagactggtgaccatgcagatctgggacaccgccggccaggagagattccagagcctgggcgtggccttctacagaggcgccgactgctgcgtgctggtgttcgacgtgaccgcccccaacaccttcaagaccctggacagctggagagacgagttcctgatccaggccagccccagagaccccgagaacttccccttcgtggtgctgggcaacaagatcgacctggagaacagacaggtggccaccaagagagcccaggcctggtgctacagcaagaacaacatcccctag

SEQ ID NO: 12742 - DNA, 540 bp, Artificial Sequence; identical to SEQ ID NO: 11327
  Description of Artificial Sequence: Synthetic coding sequence

SEQ ID NO: 12743 - DNA, 171 bp, Artificial Sequence
  Description of Artificial Sequence: Synthetic coding sequence
atggacagcagcatccacctgagcagcctgatcagcagacacgacgacgaggccaccagaaccagcaccagcgagggcctggaggagggcgaggtggagggcgagaccctgctgatcgtggagagcgaggaccaggccagcgtggacctgagccacgaccagagcggctag

SEQ ID NO: 12744 - DNA, 153 bp, Artificial Sequence
  Description of Artificial Sequence: Synthetic coding sequence
atgtgcagcaccagcggctgcgacctggaggagatccccctggacgacgacgacctgaacaccatcgagttcaagatcctggcctactacaccagacaccacgtgttcaagagcacccccgccctgttcagccccaagctgctgagaacctag

SEQ ID NO: 12745 - DNA, 1203 bp, Artificial Sequence; identical to SEQ ID NO: 10536
  Description of Artificial Sequence: Synthetic coding sequence

SEQ ID NO: 12746 - DNA, 513 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaagtag

SEQ ID NO: 12747 - DNA, 504 bp, Artificial Sequence
  Description of Artificial Sequence: Synthetic coding sequence
atggagaaggccgtgaacgacggcagccacagcgaggagctgttctgccacctgaagaccatcagcgagaaggaggacctgcccagatgcaccagcgagagccacctgagctgcctgaagcaggacatcctgaacgagaagaccgagctggaggccaccctgaaggaggccgagctggtgacccacagcgtggagctgctgctgcccctgttcaaggacaccatcgagaagatcaacttcgagaacgccaacctgagcgccctgaacctgaagatcagcgagcagaaggagatcctgatcaaggagctggacaccttcaagagcgtgaagctggccctggagcacctgctgagaaagagagactacaagcagaccggcgacaacctgagcagcatgctgctggagaacctgaccgacaacgagagcgagaacaccaacctgaagaagaaggtgttcgagaaggaggcccacatccaggagctgagctgcctgttccagagctag

SEQ ID NO: 12748 - DNA, 2376 bp, Artificial Sequence; identical to SEQ ID NO: 9995
  Description of Artificial Sequence: Synthetic coding sequence

SEQ ID NO: 12749 - DNA, 687 bp, Artificial Sequence
  Description of Artificial Sequence: Synthetic coding sequence
atgaccgaccagacctactgcgacagactggtgcaggacacccccttcctgaccggccacggcagactgagcgagcagcaggtggacagaatcatcctgcagctgaacagatactacccccagatcctgaccaacaaggaggccgagaagttcagaaaccccaaggccagcctgagagtgagactgtgcgacctgctgagccacctgcagagaagcggcgagagagactgccaggagttctacagagccctgtacatccacgcccagcccctgcacagcagactgcccagcagacacgccctgagaaagttccacatcaccaaccacgcctgcctggtgctggccagaggcggccaccccagcctgcccctgatggcctggatgagcagcatgaccacccaggtgtgctgcagccccggcctggccagccccctggccagcgcccccccccagagaccccccagcggccccgagggcagagtgtggcaggcccaggccgtgcagatgctggtgagcgtgagccacttcctgcccctgccccccagcctgagccacggcagcttccacaccgcctggggcatcctgtacgtgcacagctgccccagcttcagcaacctgatccccagaggcagcctgcacgtgtgcgtggacagcaacctggtgcccaccgccgcctggagaagctag

SEQ ID NO: 12750 - DNA, 948 bp, Artificial Sequence; identical to SEQ ID NO: 9362
  Description of Artificial Sequence: Synthetic coding sequence

SEQ ID NO: 12751 - DNA, 1203 bp, Artificial Sequence; identical to SEQ ID NO: 10536
  Description of Artificial Sequence: Synthetic coding sequence

SEQ ID NO: 12752 - DNA, 381 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctgccacagagccgtgctgagcgcctgcagcagctacttcagagccatgttctgcaacgaccacagagagagcagagagatgctggtggagatcaacggcatcctggccgaggccatggagtgcttcctgcagtacgtgtacacctag

SEQ ID NO: 12753 - DNA, 312 bp, Artificial Sequence; identical to SEQ ID NO: 12740
  Description of Artificial Sequence: Synthetic coding sequence

SEQ ID NO: 12754 - DNA, 237 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctag

SEQ ID NO: 12755 - DNA, 1320 bp, Artificial Sequence
  Description of Artificial Sequence: Synthetic coding sequence
atggccgccaacctgagcagaaacggccccgccctgcaggaggcctacgtgagagtggtgaccgagaagagccccaccgactgggccctgttcacctacgagggcaacagcaacgacatcagagtggccggcaccggcgagggcggcctggaggagatggtggaggagctgaacagcggcaaggtgatgtacgccttctgcagagtgaaggaccccaacagcggcctgcccaagttcgtgctgatcaactggaccggcgagggcgtgaacgacgtgagaaagggcgcctgcgccagccacgtgagcaccatggccagcttcctgaagggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagcagaacctgggagcagcagcaggaggtggtgagcagaaacagaaacgagcagggcagcacctgcgccagcctgcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12756 - DNA, 219 bp, Artificial Sequence
  Description of Artificial Sequence: Synthetic coding sequence
atgagctaccagcagcagcagtgcaagcagccctgccagcccccccccgtgtgccccgcccccaagtgccccgagccctgccccccccccaagtgccccgagccctgcccccccagcaagtgcccccagagctgccccccccagcagtgccagcagaagtgcccccccgtgacccccagccccccctgccagcccaagtgcccccccaagagcaagtag

SEQ ID NO: 12757 - DNA, 342 bp, Artificial Sequence
  Description of Artificial Sequence: Synthetic coding sequence
atgagcgccatccagaacctgcacagcttcgaccccttcgccgacgccagcaagggcgacgacctgctgcccgccggcaccgaggactacatccacatcagaatccagcagagaaacggcagaaagaccctgaccaccgtgcagggcatcgccgacgactacgacaagaagaagctggtgaaggccttcaagaagaagttcgcctgcaacggcaccgtgatcgagcaccccgagtacggcgaggtgatccagctgcagggcgaccagagaaagaacatctgccagttcctggtggagatcggcctggccaaggacgaccagctgaaggtgcacggcttctag

SEQ ID NO: 12758 - DNA, 927 bp, Artificial Sequence; identical to SEQ ID NO: 9961
  Description of Artificial Sequence: Synthetic coding sequence

SEQ ID NO: 12759 - DNA, 1809 bp, Artificial Sequence
  Description of Artificial Sequence: Synthetic coding sequence
atgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagcagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgatcgtgcccggcaagagccccaccagaaagaagagcggccccttcggcagcagaagaagcagcgccatcggcatcgagaacatccaggaggtgcaggagaagagagagagcccccccgccggccagaagacccccgacagcggccacgtgagccaggagcccaagagcgagaacagcagcacccagagcagccccgagatgcccaccaccaagaacagagccgagaccgccgcccagagagccgaggccctgaaggacttcagcagaagcagcagcagcgccagcagcttcgccagcgtggtggaggagaccgagggcgtggacggcgaggacaccggcctgcacgtggccggcggccagtgccagcaccactag

SEQ ID NO: 12760 - DNA, 177 bp, Artificial Sequence
  Description of Artificial Sequence: Synthetic coding sequence
atgggcagagtgtgggacctgcccggcgtgctgaaggtggagggcttcagagccaccatggcccagagactggtgagagtgctgcagatctgcgccggccacgtgcccggcgtgagcgccctgaacctgctgagcctgctgagaagcagcgagggccccagcctggaggacctgtag

SEQ ID NO: 12761 - DNA, 2199 bp, Artificial Sequence
  Description of Artificial Sequence: Synthetic coding sequence
atgctgccctgcgccgccggcgccagaggcagaggcgccatggtggtgctgagagccggcaagaagaccttcctgccccccctgtgcagagccttcgcctgcagaggctgccagctggcccccgagagaggcgccgagagaagagacaccgcccccagcggcgtgagcagattctgcccccccagaaagagctgccacgactggatcggcccccccgacaagtacagcaacctgagacccgtgcacttctacatccccgagaacgagagccccctggagcagaagctgagaaagctgagacaggagacccaggagtggaaccagcagttctgggccaaccagaacctgaccttcagcaaggagaaggaggagttcatccacagcagactgaagaccaagggcctgggcctgagaaccgagagcggccagaaggccaccctgaacgccgaggagatggccgacttctacaaggagttcctgagcaagaacttccagaagcacatgtactacaacagaatgtacgacaacatgagcaccatggtgtacatcaaggaggacaagctggagaagctgacccaggacgagatcatcagcaagaccaagcaggtgatccagggcctggaggccctgaagaacgagcacaacagcatcctgcagagcctgctggagaccctgaagtgcctgaagaaggacgacgagagcaacctggtggaggagaagagcaacatgatcagaaagagcctggagatgctggagctgggcctgagcgaggcccaggtgatgatggccctgagcaaccacctgaacgccgtggagagcgagaagcagaagctgagagcccaggtgagaagactgtgccaggagaaccagtggctgagagacgagctggccaacacccagcagaagctgcagaagagcgagcagagcgtggcccagctggaggaggagaagaagcacctggagttcatgaaccagctgaagaagtacgacgacgacatcagccccagcgaggacaaggacaccgacagcaccaaggagcccctggacgacctgttccccaacgacgaggacgaccccggccagggcatccagcagcagcacagcagcgccgccgccgccgcccagcagggcggctacgagatccccgccagactgagaaccctgcacaacctggtgatccagtacgccagccagggcagatacgaggtggccgtgcccctgtgcaagcaggccctggaggacctggagaagaccagcggccacgaccaccccgacgtggccaccatgctgaacatcctggccctggtgtacagagaccagaacaagtacaaggacgccgccaacctgctgaacgacgccctggccatcagagagaagaccctgggcaaggaccaccccgccgtggccgccaccctgaacaacctggccgtgctgtacggcaagagaggcaagtacaaggaggccgagcccctgtgcaagagagccctggagatcagagagaaggtgctgggcaaggaccaccccgacgtggccaagcagctgaacaacctggccctgctgtgccagaaccagggcaagtacgaggaggtggagtactactaccagagagccctggagatctaccagaccaagctgggccccgacgaccccaacgtggccaagaccaagaacaacctggccagctgctacctgaagcagggcaagttcaagcaggccgagaccctgtacaaggagatcctgaccagagcccacgagagagagttcggcagcgtggacgacgagaacaagcccatctggatgcacgccgaggagagagaggagtgcaagggcaagcagaaggacggcaccagcttcggcgagtacggcggctggtacaaggcctgcaaggtggacagccccaccgtgaccaccaccctgaagaacctgggcgccctgtacagaagacagggcaagttcgaggccgccgagaccctggaggaggccgccatgagaagcagaaagcagggcctggacaacgtgcacaagcagagagtggccgaggtgctgaacgaccccgagaacatggagaagagaagaagcagagagagcctgaacgtggacgtggtgaagtacgagagcggccccgacggcggcgaggaggtgagcatgagcgtggagtggaacggcatgagaaagatgaagctgggcctggtgaactag

SEQ ID NO: 12762 - DNA, 249 bp, Artificial Sequence
  Description of Artificial Sequence: Synthetic coding sequence
atgagcggcctggtgctgggccagagagacgagcccgccggccacagactgagccaggaggagatcctgggcagcaccagactggtgagccagggcctggaggccctgagaagcgagcaccaggccgtgctgcagagcctgagccagaccatcgagtgcctgcagcagggcggccacgaggagggcctggtgcacgagaaggccagacagctgagaagaagcatggagaacatcgagctgggcctgtag

SEQ ID NO: 12763 - DNA, 222 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagtag

SEQ ID NO: 12764 - DNA, 1191 bp, Artificial Sequence
  Description of Artificial Sequence: Synthetic coding sequence
atgaacttccaggccggcggcggccagagcccccagcagcagcagagcctggccgcccccggcggcggcggcgccgccgcccagcagctggtgtgcggcggccagttcggcggcgccggccccggcgccggcggcggcggcggccccagccagcagctggccggcggccccccccagcagttcgccctgagcaacagcgccgccatcagagccgagatccagagattcgagagcgtgcaccccaacatctacgccatctacgacctgatcgagagaatcgaggacctggccctgcagaaccagatcagagagcacgtgatcagcatcgaggacagcttcgtgaacagccaggagtggaccctgagcagaagcgtgcccgagctgaaggtgggcatcgtgggcaacctgagcagcggcaagagcgccctggtgcacagatacctgaccggcacctacgtgcaggaggagagccccgagggcggcagattcaagaaggagatcgtggtggacggccagagctacctgctgctgatcagagacgagggcggcccccccgagctgcagttcgccgcctgggtggacgccgtggtgttcgtgttcagcctggaggacgagatcagcttccagaccgtgtacaactacttcctgagactgtgcagcttcagaaacgccagcgaggtgcccatggtgctggtgggcacccaggacgccatcagcgccgccaaccccagagtgatcgacgacagcagagccagaaagctgagcaccgacctgaagagatgcacctactacgagacctgcgccacctacggcctgaacgtggagagagtgttccaggacgtggcccagaaggtggtggccctgagaaagaagcagcagctggccatcggcccctgcaagagcctgcccaacagccccagccacagcgccgtgagcgccgccagcatccccgccgtgcacatcaaccaggccaccaacggcggcggcagcgccttcagcgactacagcagcagcgtgcccagcacccccagcatcagccagagagagctgagaatcgagaccatcgccgccagcagcacccccacccccatcagaaagcagagcaagagaagaagcaacatcttcaccatctgcgccaccgtgagcaacttcagcagcaccaagagacccttccagctgctgcccaactag

SEQ ID NO: 12765 - DNA, 1110 bp, Artificial Sequence
  Description of Artificial Sequence: Synthetic coding sequence
atggacagctgcctgatggtgtggcacatgaagccccagagcagagcctacagattcaccggccacaaggacgccgtgacctgcgtgaacttcagccccagcggccacctgctggccagcggcagcagagacaagaccgtgagaatctgggtgcccaacgtgaagggcgagagcaccgtgttcagagcccacaccgccaccgtgagaagcgtgcacttctgcagcgacggccagagcttcgtgaccgccagcgacgacaagaccgtgaaggtgtgggccacccacagacagaagttcctgttcagcctgagccagcacatcaactgggtgagatgcgccaagttcagccccgacggcagactgatcgtgagcgccagcgacgacaagaccgtgaagctgtgggacaagagcagcagagagtgcgtgcacagctactgcgagcacggcggcttcgtgacctacgtggacttccaccccagcggcacctgcatcgccgccgccggcatggacaacaccgtgaaggtgtgggacgtgagaacccacagactgctgcagcactaccagctgcacagcgccgccgtgaacggcctgagcttccaccccagcggcaactacctgatcaccgccagcagcgacagcaccctgaagatcctggacctgatggagggcagactgctgtacaccctgcacggccaccagggccccgccaccaccgtggccttcagcagaaccggcgagtacttcgccagcggcggcagcgacgagcaggtgatggtgtggaagagcaacttcgacatcgtggaccacggcgaggtgaccaaggtgcccagaccccccgccaccctggccagcagcatgggcaacctgcccgaggtggacttccccgtgccccccggcagaggcagaagcgtggagagcgtgcagagccagccccaggagcccgtgagcgtgccccagaccctgaccagcaccctggagcacatcgtgggccagctggacgtgctgacccagaccgtgagcatcctggagcagagactgaccctgaccgaggacaagctgaagcagtgcctggagaaccagcagctgatcatgcagagagccaccccctag

SEQ ID NO: 12766 - DNA, 312 bp, Artificial Sequence; identical to SEQ ID NO: 12740
  Description of Artificial Sequence: Synthetic coding sequence

SEQ ID NO: 12767 - DNA, 270 bp, Artificial Sequence; identical to SEQ ID NO: 11466
  Description of Artificial Sequence: Synthetic coding sequence

SEQ ID NO: 12768 - DNA, 1140 bp, Artificial Sequence
  Description of Artificial Sequence: Synthetic coding sequence
atgtggcacctggacttcggcctgcacaccggcaagaccttccagcccctgcccttcatcatcgtggtgtaccccggcgccggcagaagatggggcctggtgctgagcctggccagccacagaagaagaaccgaggccggcggcggcaccggccccaccagcgacaccggctggggctgcatgctgagatgcggccagatgatcttcgcccaggccctggtgtgcagacacctgggcagagactggagatggacccagagaaagagacagcccgacagctacttcagcgtgctgaacgccttcatcgacagaaaggacagctactacagcatccaccagatcgcccagatgggcgtgggcgagggcaagagcatcggccagtggtacggccccaacaccgtggcccaggtgctgaagaagctggccgtgttcgacacctggagcagcctggccgtgcacatcgccatggacaacaccgtggtgatggaggagatcagaagactgtgcagaaccagcgtgccctgcgccggcgccaccgccttccccgccgacagcgacagacactgcaacggcttccccgccggcgccgaggtgaccaacagacccagcccctggagacccctggtgctgctgatccccctgagactgggcctgaccgacatcaacgaggcctacgtggagaccctgaagcactgcttcatgatgccccagagcctgggcgtgatcggcggcaagcccaacagcgcccactacttcatcggctacgtgggcgaggagctgatctacctggacccccacaccacccagcccgccgtggagcccaccgacggctgcttcatccccgacgagagcttccactgccagcaccccccctgcagaatgagcatcgccgagctggaccccagcatcgccgtgggcttcttctgcaagaccgaggacgacttcaacgactggtgccagcaggtgaagaagctgagcctgctgggcggcgccctgcccatgttcgagctggtggagctgcagcccagccacctggcctgccccgacgtgctgaacctgagcctggacagcagcgacgtggagagactggagagattcttcgacagcgaggacgaggacttcgagatcctgagcctgtag

SEQ ID NO: 12769 - DNA, 1683 bp, Artificial Sequence; identical to SEQ ID NO: 11916
  Description of Artificial Sequence: Synthetic coding sequence

SEQ ID NO: 12770 - DNA, 330 bp, Artificial Sequence
  Description of Artificial Sequence: Synthetic coding sequence
atgaaccccgccagcgcccccccccccctgcccccccccggccagcaggtgatccacgtgacccaggacctggacaccgacctggaggccctgttcaacagcgtgatgaaccccaagcccagcagctggagaaagaagatcctgcccgagagcttcttcaaggagcccgacagcggcagccacagcagacagagcagcaccgacagcagcggcggccaccccggccccagactggccggcggcgcccagcacgtgagaagccacagcagccccgccagcctgcagctgggcaccggcgccggcgccgccggcagccccgcccagcagtag

SEQ ID NO: 12771 - DNA, 609 bp, Artificial Sequence
  Description of Artificial Sequence: Synthetic coding sequence
atgggcagcagaaagaaggagatcgccctgcaggtgaacatcagcacccaggagctgtgggaggagatgctgagcagcaagggcctgaccgtggtggacgtgtaccagggctggtgcggcccctgcaagcccgtggtgagcctgttccagaagatgagaatcgaggtgggcctggacctgctgcacttcgccctggccgaggccgacagactggacgtgctggagaagtacagaggcaagtgcgagcccaccttcctgttctacgccggcggcgagctggtggccgtggtgagaggcgccaacgcccccctgctgcagaagaccatcctggaccagctggaggccgagaagaaggtgctggccgagggcagagagagaaaggtgatcaaggacgaggccctgagcgacgaggacgagtgcgtgagccacggcaagaacaacggcgaggacgaggacatggtgagcagcgagagaacctgcaccctggccatcatcaagcccgacgccgtggcccacggcaagaccgacgagatcatcatgaagatccaggaggccggcttcgagatcctgaccaacgaggagagaaccatgaccgaggccgaggtgtag

SEQ ID NO: 12772 - DNA, 195 bp, Artificial Sequence
  Description of Artificial Sequence: Synthetic coding sequence
atggccccccagaaggacagaaagcccaagagaagcacctggagattcaacctggacctgacccaccccgtggaggacggcatcttcgacagcggcaacttcggcaccttccccagcgagtacctgggcttcagcagcctggtgctgcacttcttctgcttcaagatcggcgccatcagcaccggcgagggctag

SEQ ID NO: 12773 - DNA, 372 bp, Artificial Sequence
  Description of Artificial Sequence: Synthetic coding sequence
atggagaacctgcagaccaacttcagcctggtgcagggcagcaccaagaagctgaacggcatgggcgacgacggcagcccccccgccaagaagatgatcaccgacatccacgccaacggcaagaccatcaacaaggtgcccaccgtgaagaaggagcacctggacgactacggcgaggcccccgtggagaccgacggcgagcacgtgaagagaacctgcaccagcgtgcccgagaccctgcacctgaaccccagcctgaagcacaccctggcccagttccacctgagcagccagagcagcctgggcggccccgccgccttcagcgccagacacagccaggagagcatgagccccaccgtgttcctgccctag

SEQ ID NO: 12774 - DNA, 201 bp, Artificial Sequence
  Description of Artificial Sequence: Synthetic coding sequence
atgaaccccagcatgaagcagaagcaggaggagatcaaggagaacatcaagaacagcagcgtgcccagaagaaccctgaagatgatccagcccagcgccagcggcagcctggtgggcagagagaacgagctgagcgccggcctgagcaagagaaagcacagaaacgaccacctgaccagcaccaccagcagccccggctag

SEQ ID NO: 12775 - DNA, 1614 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctgccacagagccgtgctgagcgcctgcagcagctacttcagagccatgttctgcaacgaccacagagagagcagagagatgctggtggagatcaacggcatcctggccgaggccatggagtgcttcctgcagtacgtgtacaccggcaaggtgaagatcaccaccgagaacgtgcagtacctgttcgagaccagcagcctgttccagatcagcgtgctgagagacgcctgcgccaagttcctggaggagcagctggacccctgcaactgcctgggcatccagagattcgccgacacccacagcctgaagaccctgttcaccaagtgcaagaacttcgccctgcagaccttcgaggacgtgagccagcacgaggagttcctggagctggacaaggacgagctgatcgactacatctgcagcgacgagctggtgatcggcaaggaggagatggtgttcgaggccgtgatgagatgggtgtacagagccgtggacctgagaagacccctgctgcacgagctgctgacccacgtgagactgcccctgctgcaccccaactacttcgtgcagaccgtggaggtggaccagctgatccagaacagccccgagtgctaccagctgctgcacgaggccagaagataccacatcctgggcaacgagatgatgagccccagaaccagacccagaagaagcaccggctacagcgaggtgatcgtggtggtgggcggctgcgagagagtgggcggcttcaacctgccctacaccgagtgctacgaccccgtgaccggcgagtggaagagcctggccaagctgcccgagttcaccaagagcgagtacgccgtgtgcgccctgagaaacgacatcctggtgagcggcggcagaatcaacagcagagacgtgtggatctacaacagccagctgaacatctggatcagagtggccagcctgaacaagggcagatggagacacaagatggccgtgctgctgggcaaggtgtacgtggtgggcggctacgacggccagaacagactgagcagcgtggagtgctacgacagcttcagcaacagatggaccgaggtggcccccctgaaggaggccgtgagcagccccgccgtgaccagctgcgtgggcaagctgttcgtgatcggcggcggccccgacgacaacacctgcagcgacaaggtgcagagctacgaccccgagaccaacagctggctgctgagagccgccatccccatcgccaagagatgcatcaccgccgtgagcctgaacaacctgatctacgtggccggcggcctgaccaaggccatctactgctacgaccccgtggaggactactggatgcacgtgcagaacaccttcagcagacaggtgatcacctag

SEQ ID NO: 12776 - DNA, 1611 bp, Artificial Sequence
  Description of Artificial Sequence: Synthetic coding sequence
atgagactggaggagctgaagagactgcagaaccccctggagcaggtgaacgacggcaagtacagcttcgagaacatccagagagcctggagagagtacctgcagagacaggagcccctgggcaagagaagccccagcccccccagcgtgagcagcgagaagctgagcagcagcgtgagcatgaacaccttcagcgacagcagcacccccgactacagagaggacggcatggacctgggcagcgacgccggcagcagcagcagcagcagcagagccagcagccagagcaacagcaccaaggtgaccccctgcagcgagtgcaagagcagcagcagccccggcggcagcctggacctggtgagcgccctggaggactacgaggagcccttccccgtgtaccagaagaaggtgatcgacgagtgggcccccgaggaggacggcgaggaggaggaggaggaggacgagagagaccagagaggctacagagacgacagaagccccgccagagagcccggcgacgtgagcgccagaaccagaagcggcggcggcggcggcagaagcgccaccaccgccatgcccccccccgtgcccaacggcaacctgcaccagcacgacccccaggacctgagacacaacggcaacgtggtggtggccggcagacccagctgcagcagaggccccagaagagccatccagaagccccagcccgccggcggcagaagaagcggcagaggccccgccgccggcggcctgtgcctgcagccccccgacggcggcacctgcgtgcccgaggagccccccgtgccccccatggactgggaggccctggagaagcacctggccggcctgcagttcagagagcaggaggtgagaaaccagggccaggccagaaccaacagcaccagcgcccagaagaacgagagagagagcatcagacagaagctggccctgggcagcttcttcgacgacggccccggcatctacaccagctgcagcaagagcggcaagcccagcctgagcagcagactgcagagcggcatgaacctgcagatctgcttcgtgaacgacagcggcagcgacaaggacagcgacgccgacgacagcaagaccgagaccagcctggacacccccctgagccccatgagcaagcagagcagcagctacagcgacagagacaccaccgaggaggagagcgagagcctggacgacatggacttcctgaccagacagaagaagctgcaggccgaggccaagatggccctggccatggccaagcccatggccaagatgcaggtggaggtggagaagcagaacagaaagaagagccccgtggccgacctgctgccccacatgccccacatcagcgagtgcctgatgaagagaagcctgaagcccaccgacctgagagacatgaccatcggccagctgcaggtgatcgtgaacgacctgcacagccagatcgagagcctgaacgaggagctggtgcagctgctgctgatcagagacgagctgcacaccgagcaggacgccatgctggtggacatcgaggacctgaccagacacgccgagagccagcagaagcacatggccgagaagatgcccgccaagtag

SEQ ID NO: 12777 - DNA, 630 bp, Artificial Sequence
  Description of Artificial Sequence: Synthetic coding sequence
atgagcgagaacgccgcccccggcctgatcagcgagctgaagctggccgtgccctggggccacatcgccgccaaggcctggggcagcctgcagggcccccccgtgctgtgcctgcacggctggctggacaacgccagcagcttcgacagactgatccccctgctgccccaggacttctactacgtggccatggacttcggcggccacggcctgagcagccactacagccccggcgtgccctactacctgcagaccttcgtgagcgagatcagaagagtggtggccgccctgaagtggaacagattcagcatcctgggccacagcttcggcggcgtggtgggcggcatgttcttctgcaccttccccgagatggtggacaagctgatcctgctggacacccccctgttcctgctggagagcgacgagatggagaacctgctgacctacaagagaagagccatcgagcacgtgctgcaggtggaggccagccaggagcccagccacgtgttcagcctgaagcagctgctgcagagactgctgaagagcaacagccacctgagcgaggagtgcggcgagctgctgctgcagagaggcaccaccaaggtggccaccggcagagagcagcactag

SEQ ID NO: 12778 - DNA, 201 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggcctag

SEQ ID NO: 12779 - DNA, 2061 bp, Artificial Sequence
  Description of Artificial Sequence: Synthetic coding sequence
atggccatcagccagcaccagttctacctggacagaaagcagagcaaggccaagatccccagcgccagaagcctggacgagatcgccatggacctgaccgagaccggcacccagagagccagcaagctggtgaccctggagaccaagagccagttcatcatggccagcaacggcagcctgatcagcagcggcagccaggacagcgaggtgagcgaggagcagaagagagagaagatcctggagctgaagaagaaggagaagctgctgcaggagaagctgctgaagaaggtggaggagctgaagaagatctgcctgagagaggccgagctgaccggcaagatgcccaaggagtaccccctgaacatcggcgagaagcccccccaggtgagaagaagagtgggcaccgccttcaagctggacgacaacctgctgcccagcgaggaggaccccgccctgcaggagctggagagcaacttcctgatccagcagaagctggtggaggccgccaagaagctggccaacgagcccgacctgtgcaagaccgtgaagaagaagagaaagcaggactacaccgacgccatgaagaagctgcaggagatcgagaacgccatcaacgagtacagaatcagatgcggcaagaagcccagccagaaggccaccgtgctgcccgaggacatcatccccagcgagagcagcagcctgagcgacaccaccacctacgacgaccccagcgacgccttcaccttccccggccagagaagcagcagcgtgccccacagccccagaatcctgccccccaagagcctgggcatcgagagaatccacttcagaaagagcagcatcaacgagcagttcgtggacaccagacagagcagagagatgctgagcacccacagcagcccctacaagaccctggagagaagaccccagggcggcagaagcatgcccaccacccccgtgctgaccagaaacgcctacagcagcagccacctggagcccgagagcagcagccagcactgcagacagagaagcggcagcctggagagccagagccacctgctgagcgagatggacagcgacaagcccttcttcagcctgagcaagagccagagaagcagcagcaccgagatcctggacgacggcagcagctacaccagccagagcagcaccgagtactactgcgtgacccccgtgaccggcccctactacaccacccagaccctggacaccagaaccagaggcagaagaagaagcaagaagcagaacgtgagcaccagcaacagcggcagcatgcccaacctggcccagaaggacagcctgagaaacggcgtgtacagcaagagccaggagccccccagcagcagctactacatcgccggctacaccccctacgccgagtgcgacttctactacagcggcggctacgtgtacgagaacgacaccgagggccagtacagcgtgaaccccagctacagaagcagcgcccactacggctacgagagacagagagactacagcagaagcttccacgaggacgaggtggacagagtgccccacaacccctacgccaccctgagactgcccagaaaggccgccgccaagagcgagcacatcaccaagaacatccacaaggccctggtggccgagcacctgagaggctggtaccagagagccagcggccagaaggaccagggccacagcccccagaccagcttcgacagcgacagaggcagccagagatgcctgggcttcgccggcctgcaggtgccctgcagccccagcagcagagccagcagctacagcagcgtgagcagcaccaacgccagcggcaactggagaacccagctgaccatcggcctgagcgactacgagacccccgcccacagcagctacaccagctgctacggcaacgtgtacaaccccctgcccagccccagcagacagtacaccgagatcagccagctggacggcaccgacggcaaccagctggaggacaacctggagagcagcgagcagagactgttctggcacgaggacagcaagcccggcaccctggtgtag

SEQ ID NO: 12780 - DNA, 219 bp, Artificial Sequence
  Description of Artificial Sequence: Synthetic coding sequence
atgatggaggagatcagcatcatggtggcctacgacgcccacgtgttcagccagctgcacgacgaggacttcctgaccagcctggtggccatcagcaagcccagaagcatggtgcccaccaagaagctgaagaagtacgagaaggagtaccagaccatgagagagagccagctgcagcaggaggaccccatggacagatacaagttcgtgtacctgtag

SEQ ID NO: 12781 - DNA, 1965 bp, Artificial Sequence
  Description of Artificial Sequence: Synthetic coding sequence
atggacagcctgcccgacgagttcttcgtgagacaccccgccgtggaggaccagagaaaggaggagaccgagaacaagctggagaagagcagcggccagctgaacaagcaggagaacgacatccccaccgacctggtgcccgtgaacctgctgctggaggtgaagaagctgctgaacgccatcaacaccctgcccaagggcgtggtgccccacatcaagaagttcctgcaggaggacttcagcttccagaccatgcagagagaggtggccgccaacagccagaacggcgaggagatcgtgcccgccctgaccctgagattcctgatcacccagctggaggccgccctgagaaacatccaggccggcaactacaccgcccaccagatcaacatcggctactacctgaccctgctgttcctgtacggcgtggccctgaccgagagaggcaagaaggaggactacaccgaggccgagaacaagttcctggtgatgaagatgatgatccaggagaacgagatctgcgagaacttcatgagcctggtgtacttcggcagaggcctgctgagatgcgcccagaagagatacaacggcggcctgctggagttccacaagagcctgcaggagatcggcgacaagaacgaccactggttcgacatcgaccccaccgaggacgaggacctgcccaccaccttcaaggacctgctgaacaacttcatcaagaccaccgagagcaacatcatgaagcagaccatctgcagctacctggactgcgagagaagctgcgaggccgacatcctgaagaacaccagctacaagggcttcttccagctgatgtgcagcaagagctgctgcgtgtacttccacaagatctgctggaagaagttcaagaacctgaagtaccccggcgagaacgaccagagcttcagcggcaagaagtgcctgaaggagggctgcaccggcgacatggtgagaatgctgcagtgcgacgtgcccggcatcgtgaagatcctgttcgaggtggtgagaaaggacgagtacatcaccatcgagaacctgggcgccagctacagaaagctgatcagcctgaagatcaccgacaccgacatcagacccaagatcagcctgaagttcaacaccaaggacgagatgcccatcttcaagctggactacaactacttctaccacctgctgcacatcatcatcatcagcggcaccgacatcgtgagacagatcttcgacgaggccatgcccccccccctgctgaagaaggagctgctgatccacaagaacgtgctggagagctactacaaccacctgtggaccaaccaccccctgggcggcagctggcacctgctgtacccccccaacaaggagctgccccagagcaagcagttcgacctgtgcctgctgctggccctgatcaagcacctgaacgtgttccccgcccccaagaagggctggaacatggagccccccagcagcgacatcagcaagagcgccgacatcctgagactgtgcaagtacagagacatcctgctgagcgagatcctgatgaacggcctgaccgagagccagttcaacagcatctggaagaaggtgagcgacatcctgctgagactgggcatgatgcaggaggacatcgacaaggtgaaggagaaccccatcgagaacatcagcctggactaccaccagctgagcgtgtacctgggcatccccgtgcccgagatcatccagagaatgctgagctgctaccagcagggcatcgccctgcagagcatcaccggcagccagagaatcgagatcgaggagctgcagaacgaggaggaggagctgagcccccccctgatggagtacaacatcaacgtgaagagccaccccgagatccagttcgccgagatcaacaaggacggcaccagcatccccagcgagagcagcaccgagagcctgaaggacctgcaggagtag

SEQ ID NO: 12782 - DNA, 570 bp, Artificial Sequence
  Description of Artificial Sequence: Synthetic coding sequence
atgaaccccgccagcgcccccccccccctgcccccccccggccagcaggtgatccacgtgacccaggacctggacaccgacctggaggccctgttcaacagcgtgatgaaccccaagcccagcagctggagaaagaagatcctgcccgagagcttcttcaaggagcccgacagcggcagccacagcagacagagcagcaccgacagcagcggcggccaccccggccccagactggccggcggcgcccagcacgtgagaagccacagcagccccgccagcctgcagctgggcaccggcgccggcgccgccggcagccccgcccagcagcacgcccacctgagacagcagagctacgacgtgaccgacgagctgcccctgccccccggctgggagatgaccttcaccgccaccggccagagatacttcctgaaccacatcgagaagatcaccacctggcaggaccccagaaaggccatgaaccagcccctgaaccacatgaacctgcaccccgccgtgagcagcacccccgtgccccagagaagcatggccgtgagccagcccaacctgtag

SEQ ID NO: 12783 - DNA, 849 bp, Artificial Sequence
  Description of Artificial Sequence: Synthetic coding sequence
atgggccccctgcccagaaccgtggagctgttctacgacgtgctgagcccctacagctggctgggcttcgagatcctgtgcagataccagaacatctggaacatcaacctgcagctgagacccagcctgatcaccggcatcatgaaggacagcggcaacaagccccccggcctgctgcccagaaagggcctgtacatggccaacgacctgaagctgctgagacaccacctgcagatccccatccacttccccaaggacttcctgagcgtgatgctggagaagggcagcctgagcgccatgagattcctgaccgccgtgaacctggagcaccccgagatgctggagaaggccagcagagagctgtggatgagagtgtggagcagagtgagcgtgggcctgtgggagagcagcggcagaaccctggacgacttcctgaccttccccagacacgtgttcagagtgatgatcctgcccccccccggcggcagcaccgtgctgcccgtgacccccctgagcccccacagactgcccgccgtgttcagcagcagccagaacgaggacatcaccgagccccagagcatcctggccgccgccgagaaggccggcatgagcgccgagcaggcccagggcctgctggagaagatcgccacccccaaggtgaagaaccagctgaaggagaccaccgaggccgcctgcagatacggcgccttcggcctgcccatcaccgtggcccacgtggacggccagacccacatgctgttcggcagcgacagaatggagctgctggcccacctgctgggcgagaagtggatgggccccatcccccccgccgtgaacgccagactgtag

SEQ ID NO: 12784 - DNA, 1221 bp, Artificial Sequence
  Description of Artificial Sequence: Synthetic coding sequence
atggaccagctggagaacgccaagatggagcacaccaacgccagcttcgacaccttcttctgcgagaccagagccggcaagcacgtgcccagagccctgttcgtggacctggagcccaccgtgatcgacggcatcagaaccggccagcacagaagcctgttccaccccgagcagctgctgagcggcaaggaggacgccgccaacaactacgccagaggcagatacagcgtgggcagcgaggtgatcgacctggtgctggagagaaccagaaagctggccgagcagtgcggcggcctgcagggcttcctgatcttcagaagcttcggcggcggcaccggcagcggcttcaccagcctgctgatggagagactgaccggcgagtacagcagaaagaccaagctggagttcagcgtgtaccccgcccccagaatcagcaccgccgtggtggagccctacaacagcgtgctgaccacccacagcaccaccgagcacaccgactgcaccttcatggtggacaacgaggccgtgtacgacatctgccacagaaagctgggcgtggagtgccccagccacgccagcatcaacagactggtggtgcaggtggtgagcagcatcaccgccagcctgagattcgagggccccctgaacgtggacctgatcgagttccagaccaacctggtgccctaccccagaatccacttccccatgaccgccttcgcccccatcgtgagcgccgacaaggcctaccacgagcagttcagcgtgagcgacatcaccaccgcctgcttcgagagcagcaaccagctggtgaagtgcgaccccagactgggcaagtacatggcctgctgcctgctgtacagaggcgacgtggtgcccaaggaggtgaacgccgccatcgccgccaccaagagcagacacagcgtgcagttcgtggactggtgccccaccggcttcaaggtgggcatcaacaacagaccccccaccgtgatgcccggcggcgacctggccaaggtgcacagaagcatctgcatgctgagcaacaccaccgccatcgtggaggcctgggccagactggaccacaagttcgacctgatgtacgccaagagagccttcctgcactggtacctgagagagggcatggaggaggccgagttcctggaggccagagaggacctggccgccctggagagagactacgaggaggtggcccagagcttctag

SEQ ID NO: 12785 - DNA, 1860 bp, Artificial Sequence; identical to SEQ ID NO: 10320
  Description of Artificial Sequence: Synthetic coding sequence

SEQ ID NO: 12786 - DNA, 294 bp, Artificial Sequence; identical to SEQ ID NO: 12523
  Description of Artificial Sequence: Synthetic coding sequence

SEQ ID NO: 12787 - DNA, 387 bp, Artificial Sequence
  Description of Artificial Sequence: Synthetic coding sequence
atgaccgacctggtggccgtgtgggacgtggccctgagcgacggcgtgcacaagatcgagttcgagcacggcaccaccagcggcaagagagtggtgtacgtggacggcaaggaggagatcagaaaggagtggatgttcaagctggtgggcaaggagaccttctacgtgggcgccgccaagaccaaggccaccatcaacatcgacgccatcagcggcttcgcctacgagtacaccctggagatcaacggcaagagcctgaagaagtacatggaggacagaagcaagaccaccaacacctgggtgctgcacatggacggcgagaacttcagaatcgtgctggagaaggacgccatggacgtgtggtgcaacggcaagaagctggagtag

SEQ ID NO: 12788 - DNA, 879 bp, Artificial Sequence
  Description of Artificial Sequence: Synthetic coding sequence
atgaccgtgagcaagttcatggccatccagaaggccctgcagcccgactggttccagtgcctgagcgacggcgaggtgagctgcaaggaggccaccagcatcaagagagtgagaaagagcgtggacagaagcctgctgttcctggacaactgcctgagactgcaggaggagagcgaggtgctgcagaagagcgtgatcatcggcgtgatcgagggcggcgacgtgatggaggagagactgagaagcgccagagagaccgccaagagacccgtgggcggcttcctgctggacggcttccagggcaaccccaccaccctggaggccagactgagactgctgagcagcgtgaccgccgagctgcccgaggacaagcccagactgatcagcggcgtgagcagacccgacgaggtgctggagtgcatcgagagaggcgtggacctgttcgagagcttcttcccctaccaggtgaccgagagaggctgcgccctgaccttcagcttcgactaccagcccaaccccgaggagaccctgctgcagcagaacggcacccaggaggagatcaagtgcatggaccagatcaagaagatcgagaccaccggctgcaaccaggagatcaccagcttcgagatcaacctgaaggagaagaagtaccaggaggacttcaaccccctggtgagaggctgcagctgctactgctgcaagaaccacaccagagcctacatccaccacctgctggtgaccaacgagctgctggccggcgtgctgctgatgatgcacaacttcgagcactacttcggcttcttccactacatcagagaggccctgaagagcgacaagctggcccagctgaaggagctgatccacagacaggccagctag

SEQ ID NO: 12789 - DNA, 600 bp, Artificial Sequence; identical to SEQ ID NO: 9510
  Description of Artificial Sequence: Synthetic coding sequence

SEQ ID NO: 12790 - DNA, 354 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgccctgcccagcgacgtgcagaccgccatcaagagcgagctgctgatgatcatccagatgtag

SEQ ID NO: 12791 - DNA, 888 bp, Artificial Sequence
  Description of Artificial Sequence: Synthetic coding sequence
tgaaccaagctggccaccggcagcaaggacaccaccgtgatcatctggcaggtggaccccgacacccacctgctgaagctgctgaagaccctggagggccacgcctacggcgtgagctacatcgcctggagccccgacgacaactacctggtggcctgcggccccgacgactgcagcgagctgtggctgtggaacgtgcagaccggcgagctgagaaccaagatgagccagagccacgaggacagcctgaccagcgtggcctggaaccccgacggcaagagattcgtgaccggcggccagagaggccagttctaccagtgcgacctggacggcaacctgctggacagctgggagggcgtgagagtgcagtgcctgtggtgcctgagcgacggcaagaccgtgctggccagcgacacccaccagagaatcagaggctacaacttcgaggacctgaccgacagaaacatcgtgcaggaggaccaccccatcatgagcttcaccatcagcaagaacggcagactggccctgctgaacgtggccacccagggcgtgcacctgtgggacctgcaggacagagtgctggtgagaaagtaccagggcgtgacccagggcttctacaccatccacagctgcttcggcggccacaacgaggacttcatcgccagcggcagcgaggaccacaaggtgtacatctggcacaagagaagcgagctgcccatcgccgagctgaccggccacaccagaaccgtgaactgcgtgagctggaacccccagatccccagcatgatggccagcgccagcgacgacggcaccgtgagaatctggggccccgcccccttcatcgaccaccagaacatcgaggaggagtgcagcagcatggacagctag

SEQ ID NO: 12792 - DNA, 1053 bp, Artificial Sequence
  Description of Artificial Sequence: Synthetic coding sequence
atggccagatggatccccaccaagagacagaagtacggcgtggccatctacaactacaacgccagccaggacgtggagctgagcctgcagatcggcgacaccgtgcacatcctggagatgtacgagggctggtacagaggctacaccctgcagaacaagagcaagaagggcatcttccccgagacctacatccacctgaaggaggccaccgtggaggacctgggccagcacgagaccgtgatccccggcgagctgcccctggtgcaggagctgaccagcaccctgagagagtgggccgtgatctggagaaagctgtacgtgaacaacaagctgaccctgttcagacagctgcagcagatgacctacagcctgatcgagtggagaagccagatcctgagcggcaccctgcccaaggacgagctggccgagctgaagaagaaggtgaccgccaagatcgaccacggcaacagaatgctgggcctggacctggtggtgagagacgacaacggcaacatcctggaccccgacgagaccagcaccatcgccctgttcaaggcccacgaggtggccagcaagagaatcgaggagaagatccaggaggagaagagcatcctgcagaacctggacctgagaggccagagcatcttcagcaccatccacacctacggcctgtacgtgaacttcaagaacttcgtgtgcaacatcggcgaggacgccgagctgttcatggccctgtacgaccccgaccagagcaccttcatcagcgagaactacctgatcagatggggcagcaacggcatgcccaaggagatcgagaagctgaacaacctgcaggccgtgttcaccgacctgagcagcatggacctgatcagacccagagtgagcctggtgtgccagatcgtgagagtgggccacatggagctgaaggagggcaagaagcacacctgcggcctgagaagacccttcggcgtggccgtgatggacatcaccgacatcatccacggcaaggtggacgacgaggagaagcagcacttcatccccttccagcagtag

SEQ ID NO: 12793 - DNA, 360 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgccctgcccagcgacgtgcagaccgccatcaagagcgagctgctgatgatcatccagatggagacctag

SEQ ID NO: 12794 - DNA, 279 bp, Artificial Sequence
  Description of Artificial Sequence: Synthetic coding sequence
atgagcggcctggtgctgggccagagagacgagcccgccggccacagactgagccaggaggagatcctgggcagcaccagactggtgagccagggcctggaggccctgagaagcgagcaccaggccgtgctgcagagcctgagccagaccatcgagtgcctgcagcagggcggccacgaggagggcctggtgcacgagaaggccagacagctgagaagaagcatggagaacatcgagctgggcctgagcgaggcccaggtgatgctggccctggcctag

SEQ ID NO: 12795 - DNA, 405 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctgccacagagccgtgctgagcgcctgcagcagctacttcagagccatgttctgcaacgaccacagagagagcagagagatgctggtggagatcaacggcatcctggccgaggccatggagtgcttcctgcagtacgtgtacaccggcaaggtgaagatcaccaccgagtag

SEQ ID NO: 12796 - DNA, 312 bp, Artificial Sequence; identical to SEQ ID NO: 12740
  Description of Artificial Sequence: Synthetic coding sequence

SEQ ID NO: 12797 - DNA, 1923 bp, Artificial Sequence
  Description of Artificial Sequence: Synthetic coding sequence
atgggcagaagaagcggcctgctgggcctgagacccggccccgagcccgtggccctggagagagtgatcaacaaggtgcacctgaaggccaaccacgtggtgaagagagacgtggacgagcacctgagaatcaagaccgtgtacgacaagagcgtggaggagctgctgcccgagaagaagaacctggtgaagaacaagctgttcccccaggccatcagctacctggagaagaccttccaggtgagaagacccgccggcaccatcctgctgagcagacagtgcgccaccaaccagtacctgagaaaggagaacgacccccacagatactgcaccggcgagtgcgccgcccacaccaagtgcggccccgtgatcgtgcccgaggagcacctgcagcagtgcagagtgtacagaggcggcaagtggccccacggcgccgtgggcgtgcccgaccaggagggcatcagcgacgccgacttcgtgctgtacgtgggcgccctggccaccgagagatgcagccacgagaacatcatcagctacgccgcctactgccagcaggaggccaacatggacagacccatcgccggctacgccaacctgtgccccaacatgatcagcacccagccccaggagttcgtgggcatgctgagcaccgtgaagcacgaggtgatccacgccctgggcttcagcgccggcctgttcgccttctaccacgacaaggacggcaaccccctgaccagcagattcgccgacggcctgccccccttcaactacagcctgggcctgtaccagtggagcgacaaggtggtgagaaaggtggagagactgtgggacgtgagagacaacaagatcgtgagacacaccgtgtacctgctggtgacccccagagtggtggaggaggccagaaagcacttcgactgccccgtgctggagggcatggagctggagaaccagggcggcgtgggcaccgagctgaaccactgggagaagagactgctggagaacgaggccatgaccggcagccacacccagaacagagtgctgagcagaatcaccctggccctgatggaggacaccggctggtacaaggccaactacagcatggccgagaagctggactggggcagaggcatgggctgcgacttcgtgagaaagagctgcaagttctggatcgaccagcagagacagaagagacagatgctgagcccctactgcgacaccctgagaagcaaccccctgcagctgacctgcagacaggaccagagagccgtggccgtgtgcaacctgcagaagttccccaagcccctgccccaggagtaccagtacttcgacgagctgagcggcatccccgccgaggacctgccctactacggcggcagcgtggagatcgccgactactgccccttcagccaggagttcagctggcacctgagcggcgagtaccagagaagcagcgactgcagaatcctggagaaccagcccgagatcttcaagaactacggcgccgagaagtacggcccccacagcgtgtgcctgatccagaagagcgccttcgtgatggagaagtgcgagagaaagctgagctaccccgactggggcagcggctgctaccaggtgagctgcagcccccagggcctgaaggtgtgggtgcaggacaccagctacctgtgcagcagagccggccaggtgctgcccgtgagcatccagatgaacggctggatccacgacggcaacctgctgtgccccagctgctgggacttctgcgagctgtgcccccccgagaccgacccccccgccaccaacctgaccagagccctgcccctggacctgtgcagctgcagcagcagcctggtggtgaccctgtggctgctgctgggcaacctgttccccctgctggccggcttcctgctgtgcatctggcactag

SEQ ID NO: 12798 - DNA, 783 bp, Artificial Sequence
  Description of Artificial Sequence: Synthetic coding sequence
atgaacctggacagcgacggcatggacgacatcatcagccaggagagcagcctggacatggagggcaactacaagaaggcccagaagaacgagagagagagcatcagacagaagctggccctgggcagcttcttcgacgacggccccggcatctacaccagctgcagcaagagcggcaagcccagcctgagcagcagactgcagagcggcatgaacctgcagatctgcttcgtgaacgacagcggcagcgacaaggacagcgacgccgacgacagcaagaccgagaccagcctggacacccccctgagccccatgagcaagcagagcagcagctacagcgacagagacaccaccgaggaggagagcgagagcctggacgacatggacttcctgaccagacagaagaagctgcaggccgaggccaagatggccctggccatggccaagcccatggccaagatgcaggtggaggtggagaagcagaacagaaagaagagccccgtggccgacctgctgccccacatgccccacatcagcgagtgcctgatgaagagaagcctgaagcccaccgacctgagagacatgaccatcggccagctgcaggtgatcgtgaacgacctgcacagccagatcgagagcctgaacgaggagctggtgcagctgctgctgatcagagacgagctgcacaccgagcaggacgccatgctggtggacatcgaggacctgaccagacacgccgagagccagcagaagcacatggccgagaagatgcccgccaagtag

SEQ ID NO: 12799 - DNA, 633 bp, Artificial Sequence; identical to SEQ ID NO: 10549
  Description of Artificial Sequence: Synthetic coding sequence

SEQ ID NO: 12800 - DNA, 381 bp, Artificial Sequence
  Description of Artificial Sequence: Synthetic coding sequence
atgaaccagagaagccacctgggcaccacctacctggacaccgccaagggcgccgtggagaccttcatgaagctgagagccagagaccccgccagcagaggcgacagatacatgctggtgaccttcgaggagcccccctacgccatcaaggccggctggaaggagaaccacgccaccttcatgaacgagctgaagaacctgcaggccgagggcctgaccaccctgggccagagcctgagaaccgccttcgacctgctgaacctgaacagactggtgaccggcatcgacaactacggccagggcagaaaccccttcttcctggagcccgccatcatcatcaccatcaccgacggcagcaagctgaccaccaccagcggctag

SEQ ID NO: 12801 - DNA, 1188 bp, Artificial Sequence
  Description of Artificial Sequence: Synthetic coding sequence
atggccaacgaccccctggagggcttccacgaggtgaacctggccagccccaccagccccgacctgctgggcgtgtacgagagcggcacccaggagcagaccaccagccccagcgtgatctacagaccccaccccagcgccctgagcagcgtgcccatccaggccaacgccctggacgtgagcgagctgcccacccagcccgtgtacagcagccccagaagactgaactgcgccgagatcagcagcatcagcttccacgtgaccgaccccgccccctgcagcaccagcggcgtgaccgccggcctgaccaagctgaccaccagaaaggacaactacaacgccgagagagagttcctgcagggcgccaccatcaccgaggcctgcgacggcagcgacgacatcttcggcctgagcaccgacagcctgagcagactgagaagccccagcgtgctggaggtgagagagaagggctacgagagactgaaggaggagctggccaaggcccagagagagctgaagctgaaggacgaggagtgcgagagactgagcaaggtgagagaccagctgggccaggagctggaggagctgaccgccagcctgttcgaggaggcccacaagatggtgagagaggccaacatcaagcaggccaccgccgagaagcagctgaaggaggcccagggcaagatcgacgtgctgcaggccgaggtggccgccctgaagaccctggtgctgagcagcagccccaccagccccacccaggagcccctgcccggcggcaagacccccttcaagaagggccacaccagaaacaagagcaccagcagcgccatgagcggcagccaccaggacctgagcgtgatccagcccatcgtgaaggactgcaaggaggccgacctgagcctgtacaacgagttcagactgtggaaggacgagcccaccatggacagaacctgccccttcctggacaagatctaccaggaggacatcttcccctgcctgaccttcagcaagagcgagctggccagcgccgtgctggaggccgtggagaacaacaccctgagcatcgagcccgtgggcctgcagcccatcagattcgtgaaggccagcgccgtggagtgcggcggccccaagagcctgctgtacgtgaccttcctgcacaccttcgacaccttcagcagagacagctag

SEQ ID NO: 12802 - DNA, 786 bp, Artificial Sequence; identical to SEQ ID NO: 10243
  Description of Artificial Sequence: Synthetic coding sequence

SEQ ID NO: 12803 - DNA, 1284 bp, Artificial Sequence
  Description of Artificial Sequence: Synthetic coding sequence
atggtgtgctggcaggacctggaggagagcctgagaatgaagctgagcctgaccaaggtggtgaacggctgcagactgggcaagatcaagaacctgggcaagaccggcgaccacaccatggacatccccggctgcctgctgtacaccaagaccggcagcgccccccacctgacccaccacaccctgcacaacatccacggcgtgcccgccatggcccagctgaccctgagcagcctggccgagcaccacgaggtgctgaccgagtacaaggagggcgtgggcaagttcatcggcatgcccgagagcctgctgtactgcagcctgcacgaccccgtgagcccctgccccgccggctacgtgaccaacaagagcgtgagcgtgtggagcgtggccggcagagtggagatgaccgtgagcaagttcatggccatccagaaggccctgcagcccgactggttccagtgcctgagcgacggcgaggtgagctgcaaggaggccaccagcatcaagagagtgagaaagagcgtggacagaagcctgctgttcctggacaactgcctgagactgcaggaggagagcgaggtgctgcagaagagcgtgatcatcggcgtgatcgagggcggcgacgtgatggaggagagactgagaagcgccagagagaccgccaagagacccgtgggcggcttcctgctggacggcttccagggcaaccccaccaccctggaggccagactgagactgctgagcagcgtgaccgccgagctgcccgaggacaagcccagactgatcagcggcgtgagcagacccgacgaggtgctggagtgcatcgagagaggcgtggacctgttcgagagcttcttcccctaccaggtgaccgagagaggctgcgccctgaccttcagcttcgactaccagcccaaccccgaggagaccctgctgcagcagaacggcacccaggaggagatcaagtgcatggaccagatcaagaagatcgagaccaccggctgcaaccaggagatcaccagcttcgagatcaacctgaaggagaagaagtaccaggaggacttcaaccccctggtgagaggctgcagctgctactgctgcaagaaccacaccagagcctacatccaccacctgctggtgaccaacgagctgctggccggcgtgctgctgatgatgcacaacttcgagcactacttcggcttcttccactacatcagagaggccctgaagagcgacaagctggcccagctgaaggagctgatccacagacaggccagctag

SEQ ID NO: 12804 - DNA, 393 bp, Artificial Sequence
  Description of Artificial Sequence: Synthetic coding sequence
atgaaccagagaagccacctgggcaccacctacctggacaccgccaagggcgccgtggagaccttcatgaagctgagagccagagaccccgccagcagaggcgacagatacatgctggtgaccttcgaggagcccccctacgccatcaaggccggctggaaggagaaccacgccaccttcatgaacgagctgaagaacctgcaggccgagggcctgaccaccctgggccagagcctgagaaccgccttcgacctgctgaacctgaacagactggtgaccggcatcgacaactacggccagggcagaaaccccttcttcctggagcccgccatcatcatcaccatcaccgacggcagcaagctgaccaccaccagcggcgtgcaggacgagtag

SEQ ID NO: 12805 - DNA, 417 bp, Artificial Sequence
  Description of Artificial Sequence: Synthetic coding sequence
atgaaccccgccagcgcccccccccccctgcccccccccggccagcaggtgatccacgtgacccaggacctggacaccgacctggaggccctgttcaacagcgtgatgaaccccaagcccagcagctggagaaagaagatcctgcccgagagcttcttcaaggagcccgacagcggcagccacagcagacagagcagcaccgacagcagcggcggccaccccggccccagactggccggcggcgcccagcacgtgagaagccacagcagccccgccagcctgcagctgggcaccggcgccggcgccgccggcagccccgcccagcagcacgcccacctgagacagcagagctacgacgtgaccgacgagctgcccctgccccccggctgggagatgaccttcaccgccaccggctag

SEQ ID NO: 12806 - DNA, 1692 bp, Artificial Sequence
  Description of Artificial Sequence: Synthetic coding sequence
atgagactggaggagctgaagagactgcagaaccccctggagcaggtgaacgacggcaagtacagcttcgagaaccaccagctggccatggacgccgagaacaacatcgagaagtaccccctgaacctgcagcccctggagagcaaggtgaagatcatccagagagcctggagagagtacctgcagagacaggagcccctgggcaagagaagccccagcccccccagcgtgagcagcgagaagctgagcagcagcgtgagcatgaacaccttcagcgacagcagcacccccgactacagagaggacggcatggacctgggcagcgacgccggcagcagcagcagcagcagcagagccagcagccagagcaacagcaccaaggtgaccccctgcagcgagtgcaagagcagcagcagccccggcggcagcctggacctggtgagcgccctggaggactacgaggagcccttccccgtgtaccagaagaaggtgatcgacgagtgggcccccgaggaggacggcgaggaggaggaggaggaggacgagagagaccagagaggctacagagacgacagaagccccgccagagagcccggcgacgtgagcgccagaaccagaagcggcggcggcggcggcagaagcgccaccaccgccatgcccccccccgtgcccaacggcaacctgcaccagcacgacccccaggacctgagacacaacggcaacgtggtggtggccggcagacccagctgcagcagaggccccagaagagccatccagaagccccagcccgccggcggcagaagaagcggcagaggccccgccgccggcggcctgtgcctgcagccccccgacggcggcacctgcgtgcccgaggagccccccgtgccccccatggactgggaggccctggagaagcacctggccggcctgcagttcagagagcaggaggtgagaaaccagggccaggccagaaccaacagcaccagcgcccagaagaacgagagagagagcatcagacagaagctggccctgggcagcttcttcgacgacggccccggcatctacaccagctgcagcaagagcggcaagcccagcctgagcagcagactgcagagcggcatgaacctgcagatctgcttcgtgaacgacagcggcagcgacaaggacagcgacgccgacgacagcaagaccgagaccagcctggacacccccctgagccccatgagcaagcagagcagcagctacagcgacagagacaccaccgaggaggagagcgagagcctggacgacatggacttcctgaccagacagaagaagctgcaggccgaggccaagatggccctggccatggccaagcccatggccaagatgcaggtggaggtggagaagcagaacagaaagaagagccccgtggccgacctgctgccccacatgccccacatcagcgagtgcctgatgaagagaagcctgaagcccaccgacctgagagacatgaccatcggccagctgcaggtgatcgtgaacgacctgcacagccagatcgagagcctgaacgaggagctggtgcagctgctgctgatcagagacgagctgcacaccgagcaggacgccatgctggtggacatcgaggacctgaccagacacgccgagagccagcagaagcacatggccgagaagatgcccgccaagtag

SEQ ID NO: 12807 - DNA, 228 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggagtag

SEQ ID NO: 12808 - DNA, 2712 bp, Artificial Sequence; identical to SEQ ID NO: 10162
  Description of Artificial Sequence: Synthetic coding sequence

SEQ ID NO: 12809 - DNA, 522 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaaggagggcgactag

SEQ ID NO: 12810 - DNA, 2262 bp, Artificial Sequence
  Description of Artificial Sequence: Synthetic coding sequence
atgtacagccccatcatctaccaggccctgtgcgagcacgtgcagacccagatgagcctgatgaacgacctgaccagcaagaacatccccaacggcatccccgccgtgccctgccacgcccccagccacagcgagagccaggccaccccccacagcagctacggcctgtgcaccagcacccccgtgtggagcctgcagagacccccctgcccccccaaggtgcacagcgaggtgcagaccgacggcaacagccagttcgccagccagggcaagaccgtgagcgccacctgcaccgacgtgctgagaaacagcttcaacaccagccccggcgtgccctgcagcctgcccaagaccgacatcagcgccatccccaccctgcagcagctgggcctggtgaacggcatcctgccccagcagggcatccacaaggagaccgacctgctgaagtgcatccagacctacctgagcctgttcagaagccacggcaaggagacccacctggacagccagacccacagaagccccacccagagccagcccgccttcctggccaccaacgaggagaagtgcgccagagagcagatcagagaggccaccagcgagagaaaggacctgaacatccacgtgagagacaccaagaccgtgaaggacgtgcagaaggccaagaacgtgaacaagaccgccgagaaggtgagaatcatcaagtacctgctgggcgagctgaaggccctggtggccgagcaggaggacagcgagatccagagactgatcaccgagatggaggcctgcatcagcgtgctgcccaccgtgagcggcaacaccgacatccaggtggagatcgccctggccatgcagcccctgagaagcgagaacgcccagctgagaagacagctgagaatcctgaaccagcagctgagagagcagcagaagacccagaagcccagcggcgccgtggactgcaacctggagctgttcagcctgcagagcctgaacatgagcctgcagaaccagctggaggagagcctgaagagccaggagctgctgcagagcaagaacgaggagctgctgaaggtgatcgagaaccagaaggacgagaacaagaagttcagcagcatcttcaaggacaaggaccagaccatcctggagaacaagcagcagtacgacatcgagatcaccagaatcaagatcgagctggaggaggccctggtgaacgtgaagagcagccagttcaagctggagaccgccgagaaggagaaccagatcctgggcatcaccctgagacagagagacgccgaggtgaccagactgagagagctgaccagaaccctgcagaccagcatggccaagctgctgagcgacctgagcgtggacagcgccagatgcaagcccggcaacaacctgaccaagagcctgctgaacatccacgacaagcagctgcagcacgaccccgcccccgcccacaccagcatcatgagctacctgaacaagctggagaccaactacagcttcacccacagcgagcccctgagcaccatcaagaacgaggagaccatcgagcccgacaagacctacgagaacgtgctgagcagcagaggcccccagaacagcaacaccagaggcatggaggaggccagcgcccccggcatcatcagcgccctgagcaagcaggacagcgacgagggcagcgagaccatggccctgatcgaggacgagcacaacctggacaacaccatctacatccccttcgccagaagcacccccgagaagaagagccccctgagcaagagactgagcccccagccccagatcagagccgccaccacccagctggtgagcaacagcggcctggccgtgagcggcaaggagaacaagctgtgcacccccgtgatctgcagcagcagcaccaaggaggccgaggacgcccccgagaagctgagcagagccagcgacatgaaggacacccagctgctgaagaagatcaaggaggccatcggcaagatccccgccgccaccaaggagcccgaggagcagaccgcctgccacggccccagcggctgcctgagcaacagcctgcaggtgaagggcaacaccgtgtgcgacggcagcgtgttcaccagcgacctgatgagcgactggagcatcagcagcttcagcaccttcaccagcagagacgagcaggacttcagaaacggcctggccgccctggacgccaacatcgccagactgcagaagagcctgagaaccggcctgctggagaagtag

SEQ ID NO: 12811 - DNA, 219 bp, Artificial Sequence; identical to SEQ ID NO: 12780
  Description of Artificial Sequence: Synthetic coding sequence

SEQ ID NO: 12812 - DNA, 588 bp, Artificial Sequence
  Description of Artificial Sequence: Synthetic coding sequence
atgtggcacatgaccagaaactggcccctggtgggcaagaccagcctgatcaccagattcatgtacgacagcttcgacaacacctaccaggccaccatcggcatcgacttcctgagcaagaccatgtacctggaggacagaaccgtgagactgcagctgtgggacaccgccggccaggagagattcagaagcctgatccccagctacatcagagacagcaccgtggccgtggtggtgtacgacatcaccaacctgaacagcttccagcagaccagcaagtggatcgacgacgtgagaaccgagagaggcagcgacgtgatcatcatgctggtgggcaacaagaccgacctggccgacaagagacagatcaccatcgaggagggcgagcagagagccaaggagctgagcgtgatgttcatcgagaccagcgccaagaccggctacaacgtgaagcagctgttcagaagagtggccagcgccctgcccggcatggagaacgtgcaggagaagagcaaggagggcatgatcgacatcaagctggacaagccccaggagccccccgccagcgagggcggctgcagctgctag

SEQ ID NO: 12813 - DNA, 1047 bp, Artificial Sequence; identical to SEQ ID NO: 10970
  Description of Artificial Sequence: Synthetic coding sequence

SEQ ID NO: 12814 - DNA, 2862 bp, Artificial Sequence
  Description of Artificial Sequence: Synthetic coding sequence
atgaagagaggcatcagaagagaccccttcagaaagagaaagctgggcggcagagccaagaaggtgagagagcccaccgccgtgaacagcttctacagagaggccagcctgcccagcgtgtgggccagcctgagaagaagagagatggtgagaagcggcgccagacccggccaggtgctgagcagcggcagacacaccggccccgccaagctgaccaacggcaagaaggccacctacctgagaaagatccccagattcaacgccgacagcggctacagcatccacagcgacagcgagagccaggccgagaccgtgcacggcctggacggctgcgccagcctgctgagagacatcctgagaaacgaggacagcggcagcgagaccgcctacctggagaacagaagcaacagcagacccctggagagcaagagatacggcagcaagaagaagagacacgagaagcacaccatccccctggtggtgcagaaggagaccagcagcagcgacaacaagaagcagatccccaacgaggccagcgccagaagcgagagagacaccagcgacctggagcagaactggagcctgcaggaccactacagaatgtacagccccatcatctaccaggccctgtgcgagcacgtgcagacccagatgagcctgatgaacgacctgaccagcaagaacatccccaacggcatccccgccgtgccctgccacgcccccagccacagcgagagccaggccaccccccacagcagctacggcctgtgcaccagcacccccgtgtggagcctgcagagacccccctgcccccccaaggtgcacagcgaggtgcagaccgacggcaacagccagttcgccagccagggcaagaccgtgagcgccacctgcaccgacgtgctgagaaacagcttcaacaccagccccggcgtgccctgcagcctgcccaagaccgacatcagcgccatccccaccctgcagcagctgggcctggtgaacggcatcctgccccagcagggcatccacaaggagaccgacctgctgaagtgcatccagacctacctgagcctgttcagaagccacggcaaggagacccacctggacagccagacccacagaagccccacccagagccagcccgccttcctggccaccaacgaggagaagtgcgccagagagcagatcagagaggccaccagcgagagaaaggacctgaacatccacgtgagagacaccaagaccgtgaaggacgtgcagaaggccaagaacgtgaacaagaccgccgagaaggtgagaatcatcaagtacctgctgggcgagctgaaggccctggtggccgagcaggaggacagcgagatccagagactgatcaccgagatggaggcctgcatcagcgtgctgcccaccgtgagcggcaacaccgacatccaggtggagatcgccctggccatgcagcccctgagaagcgagaacgcccagctgagaagacagctgagaatcctgaaccagcagctgagagagcagcagaagacccagaagcccagcggcgccgtggactgcaacctggagctgttcagcctgcagagcctgaacatgagcctgcagaaccagctggaggagagcctgaagagccaggagctgctgcagagcaagaacgaggagctgctgaaggtgatcgagaaccagaaggacgagaacaagaagttcagcagcatcttcaaggacaaggaccagaccatcctggagaacaagcagcagtacgacatcgagatcaccagaatcaagatcgagctggaggaggccctggtgaacgtgaagagcagccagttcaagctggagaccgccgagaaggagaaccagatcctgggcatcaccctgagacagagagacgccgaggtgaccagactgagagagctgaccagaaccctgcagaccagcatggccaagctgctgagcgacctgagcgtggacagcgccagatgcaagcccggcaacaacctgaccaagagcctgctgaacatccacgacaagcagctgcagcacgaccccgcccccgcccacaccagcatcatgagctacctgaacaagctggagaccaactacagcttcacccacagcgagcccctgagcaccatcaagaacgaggagaccatcgagcccgacaagacctacgagaacgtgctgagcagcagaggcccccagaacagcaacaccagaggcatggaggaggccagcgcccccggcatcatcagcgccctgagcaagcaggacagcgacgagggcagcgagaccatggccctgatcgaggacgagcacaacctggacaacaccatctacatccccttcgccagaagcacccccgagaagaagagccccctgagcaagagactgagcccccagccccagatcagagccgccaccacccagctggtgagcaacagcggcctggccgtgagcggcaaggagaacaagctgtgcacccccgtgatctgcagcagcagcaccaaggaggccgaggacgcccccgagaagctgagcagagccagcgacatgaaggacacccagctgctgaagaagatcaaggaggccatcggcaagatccccgccgccaccaaggagcccgaggagcagaccgcctgccacggccccagcggctgcctgagcaacagcctgcaggtgaagggcaacaccgtgtgcgacggcagcgtgttcaccagcgacctgatgagcgactggagcatcagcagcttcagcaccttcaccagcagagacgagcaggacttcagaaacggcctggccgccctggacgccaacatcgccagactgcagaagagcctgagaaccggcctgctggagaagtag

SEQ ID NO: 12815 - DNA, 1683 bp, Artificial Sequence; identical to SEQ ID NO: 11916
  Description of Artificial Sequence: Synthetic coding sequence

SEQ ID NO: 12816 - DNA, 153 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggtgacctag

SEQ ID NO: 12817 - DNA, 288 bp, Artificial Sequence
  Description of Artificial Sequence: Synthetic coding sequence
atggccatcggcaagagactggccaccctgcccaccaaggagcagaagacccagagactgatcagcgagctgagcctgctgaaccacaagctgcccgccagagtgtggctgcccaccgccggcttcgaccaccacgtggtgagagtgccccacacccaggccgtggtgctgaacagcaaggacaaggccccctacctgatctacgtggaggtgctggagtgcgagaacttcgacaccaccagcgtgcccgccagaatccccgagaacagaatcagaagcaccagatag

SEQ ID NO: 12818 - DNA, 1260 bp, Artificial Sequence
  Description of Artificial Sequence: Synthetic coding sequence
atggccggcagcggctgcgcctggggcgccgagccccccagattcctggaggccttcggcagactgtggcaggtgcagagcagactgggcagcggcagcagcgccagcgtgtacagagtgagatgctgcggcaaccccggcagcccccccggcgccctgaagcagttcctgccccccggcaccaccggcgccgccgccagcgccgccgagtacggcttcagaaaggagagagccgccctggagcagctgcagggccacagaaacatcgtgaccctgtacggcgtgttcaccatccacttcagccccaacgtgcccagcagatgcctgctgctggagctgctggacgtgagcgtgagcgagctgctgctgtacagcagccaccagggctgcagcatgtggatgatccagcactgcgccagagacgtgctggaggccctggccttcctgcaccacgagggctacgtgcacgccgacctgaagcccagaaacatcctgtggagcgccgagaacgagtgcttcaagctgatcgacttcggcctgagcttcaaggagggcaaccaggacgtgaagtacatccagaccgacggctacagagcccccgaggccgagctgcagaactgcctggcccaggccggcctgcagagcgacaccgagtgcaccagcgccgtggacctgtggagcctgggcatcatcctgctggagatgttcagcggcatgaagctgaagcacaccgtgagaagccaggagtggaaggccaacagcagcgccatcatcgaccacatcttcgccagcaaggccgtggtgaacgccgccatccccgcctaccacctgagagacctgatcaagagcatgctgcacgacgaccccagcagaagaatccccgccgagatggccctgtgcagccccttcttcagcatccccttcgccccccacatcgaggacctggtgatgctgcccacccccgtgctgagactgctgaacgtgctggacgacgactacctggagaacgaggaggagtacgaggacgtggtggaggacgtgaaggaggagtgccagaagtacggccccgtggtgagcctgctggtgcccaaggagaaccccggcagaggccaggtgttcgtggagtacgccaacgccggcgacagcaaggccgcccagaagctgctgaccggcagaatgttcgacggcaagttcgtggtggccaccttctaccccctgagcgcctacaagagaggctacctgtaccagaccctgctgtag

SEQ ID NO: 12819 - DNA, 1272 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaaggagggcgacgactacgaggtgatccccaacagcaacttctacgtgagcagaaccgcctgcagagacaacaccagcgtgtaccacatcagcggcaagaagaagaccttcaaggacgtgggcaacctgctgagaagccacggcatcgacctggaccacaacagattcctgatcctgcagggcgaggtggagcagatcgccatgatgaagcccaagggccagaccgagcacgacgagggcatgctggagtacctggaggacatcatcggctgcggcagactgaacgagcccatcaaggtgctgtgcagaagagtggagatcctgaacgagcacagaggcgagaagctgaacagagtgaagatggtggagaaggagaaggacgccctggagggcgagaagaacatcgccatcgagttcctgaccctggagaacgagatcttcagaaagaagaaccacgtgtgccagtactacatctacgagctgcagaagagaatcgccgagatggagacccagaaggagaagatccacgaggacaccaaggagatcaacgagaagagcaacatcctgagcaacgagatgaaggccaagaacaaggacgtgaaggacaccgagaagaagctgaacaagatcaccaagttcatcgaggagaacaaggagaagttcacccagctggacctggaggacgtgcaggtgagagagaagctgaagcacgccaccagcaaggccaagaagctggagaagcagctgcagaaggacaaggagtag

SEQ ID NO: 12820 - DNA, 1113 bp, Artificial Sequence
  Description of Artificial Sequence: Synthetic coding sequence
atggaggagggcgtgccctgccccgcccccgccgccaagctgaccccccccgtgaagaagagccaggacatgcacgacgagagaagcaagctggtgaacgagtacgcctgcagagtgctggagctgctgggcatgggccacagactgttcgtgcccagactgctggccaccagcaaggaggacctgctgcaggccgacttcgagggcgccctgaagttcttcagagtgcagctgcccaagagatacagagccgaggagaacgccagaagactgatggagcaggcctgcaacatcaaggtgcccaccaagaagctgaagaagtacgagaaggagtaccagaccatgagagagagccagctgcagcaggaggaccccatggacagatacaagagagagaacagaagactgcaggaggccagcatgagactggagcaggagaacgacgacctggcccacgagctggtgaccagcaagatcgccctgagaaacgacctggaccaggccgaggacaaggccgacgtgctgaacaaggagctgctgctgaccaagcagagactggtggagaccgaggaggagaagagaaagcaggaggaggagaccgcccagctgaaggaggtgttcagaaagcagctggagaaggccgagtacgagatcaagaagaccaccgccatcatcgccgagtacaagcagatctgcagccagctgagcaccagactggagaagcagcaggccgccagcaaggaggagctggaggtggtgaagggcaagatgatggcctgcaagcactgcagcgacatcttcagcaaggagggcgccctgaagctggccgccaccggcagagaggaccagggcatcgagaccgacgacgagaaggacagcctgaagaagcagctgagagagatggagctggagctggcccagaccaagctgcagctggtggaggccaagtgcaagatccaggagctggagcaccagagaggcgccctgatgaacgagatccaggccgccaagaacagctggttcagcaagaccctgaacagcatcaagaccgccaccggcacccagcccctgcagcccgcccccgtgacccagccccccaaggagagcacctag

SEQ ID NO: 12821 - DNA, 2262 bp, Artificial Sequence; identical to SEQ ID NO: 12810
  Description of Artificial Sequence: Synthetic coding sequence

SEQ ID NO: 12822 - DNA, 2067 bp, Artificial Sequence; identical to SEQ ID NO: 10442
  Description of Artificial Sequence: Synthetic coding sequence

SEQ ID NO: 12823 - DNA, 543 bp, Artificial Sequence
  Description of Artificial Sequence: Synthetic coding sequence
atgcccagaaagggcacccagcccagcaccgccagaagaagagaggagggcccccccccccccagccccgacggcgccagcagcgacgccgagcccgagccccccagcggcagaaccgagagccccgccaccgccgccgagaccgccagcgaggagctggacaacagaagcctggaggagatcctgaacagcatcccccccccccccccccccgccatgaccaacgaggccggcgcccccagactgatgatcacccacatcgtgaaccagaacttcaagagctacgccggcgagaagatcctgggccccttccacaagagattcagctgcatcatcggccccaacggcagcggcaagagcaacgtgatcgacagcatgctgttcgtgttcggctacagagcccagaagatcagaagcaagaagctgagcgtgctgatccacaacagcgacgagcacaaggacatccagagctgcaccgtggaggtgcacttccagaagatcatcgacaaggagggcgacgactacgaggtgatccccaactag

SEQ ID NO: 12824 - DNA, 4689 bp, Artificial Sequence
  Description of Artificial Sequence: Synthetic coding sequence
atgcccggcgaggccgccagagccgagctgctgctgcccgaggccgacagacccggccccagaaccgacctgagctgcgacgccgccgccgccaccaccatcctgggcggcgacagaagagagccctgcgccctgacccccggccccagccacctggccctgaccttcctgcccagcaagcccggcgccagaccccagcccgagggcgccagctgggacgccggccccggcggcgcccccagcgcctgggccgaccccggcgagggcggccccagccccatgctgctgcccgagggcctgagcagccaggccctgagcaccgaggcccccctgcccgccaccctggagcccagaatcgtgatgggcgaggagacctgccaggccctgctgagccccagagccgccagaaccgccctgagagaccaggagggcggccacgccagccccgaccccccccccgagctgtgcagccagggcgacctgagcgtgcccagccccccccccgaccccgacagcttcttcaccccccccagcacccccaccaagaccacctacgccctgctgcccgcctgcggcccccacggcgacgccagagacagcgaggccgagctgagagacgagctgctggacagcccccccgccagccccagcggcagctacatcaccgccgacggcgacagctgggccagcagccccagctgcagcctgagcctgctggcccccgccgagggcctggacttccccagcggctggggcctgagcccccagggcagcatggtggacgagagagagctgcaccccgccggcacccccgagccccccagcagcgagagcagcctgagcgccgacagcagcagcagctggggccaggagggccacttcttcgacctggacttcctggccaacgaccccatgatccccgccgccctgctgcccttccagggcagcctgatcttccaggtggaggccgtggaggtgacccccctgagccccgaggaggaggaggaggaggccgtggccgaccccgaccccggcggcgacctggccggcgagggcgaggaggacagcaccagcgccagcttcctgcagagcctgagcgacctgagcatcaccgagggcatggacgaggccttcgccttcagagacgacaccagcgccgccagcagcgacagcgacagcgccagctacgccgaggccgacgacgagagactgtacagcggcgagccccacgcccaggccaccctgctgcaggacagcgtgcagaagaccgaggaggagagcggcggcggcgccaagggcctgcaggcccaggacggcaccgtgagctgggccgtggaggccgccccccagaccagcgacagaggcgcctacctgagccagagacaggagctgatcagcgaggtgaccgaggagggcctggccctgggccaggagagcaccgccaccgtgaccccccacaccctgcaggtggcccccggcctgcaggtggaggtggccaccagagtgaccccccaggccggcgaggaggagaccgacagcaccgccggccaggagagcgccgccatggccatgccccagcccagccaggagggcatcagcgagatcctgggccaggagagcgtgaccgccgagaagctgcccaccccccaggaggagaccagcctgaccctgtgccccgacagcccccagaacctgaaggaggagggcggcctggacctgcccagcggcagaaagcccgtggccgccgccaccatcgtgcccagacaggccaaggaggacctgaccctgccccaggacagcgccatgaccccccccctgcccctgcaggacaccgacctgagcagcgcccccaagcccgtggccgccgccaccatcgtgagccagcaggccgaggagggcctgaccctgccccaggacagcgtgatgaccccccccctgcccctgcaggacaccgagctgagcagcgcccccaagcccgtggccgccgccaccctggtgagccagcaggccgaggagggcctgaccctgccccaggacagcgccatgaccccccccctgcccctgcaggacaccgacctgagcagcgcccccaagcccgtggccgccgccaccctggtgagccagcaggccgaggagggcctgaccctgccccaggacagcgccatgaccccccccctgcccctgcaggacaccgacctgagcagcgcccccaagcccgtggccgccgccaccctggtgagccagcaggccgaggagggcctgaccctgccccaggacagcgccatgaccccccccctgcccctgcaggacaccgacctgagcagcgcccccaagcccgtggccgccgccaccatcgtgagccagcaggccgaggagggcctgaccctgccccaggacagcgccatgaccccccccctgcccctgcaggacaccgacctgagcagcgcccccaagcccgtggccgccgccaccatcgtgagccagcaggccgaggagggcctgaccctgccccaggacagcgccatgaccccccccctgcccctgcaggacaccgacctgagcagcgcccccaagcccgtggccgccgccacccccgtgagccagcaggccgaggagggcctgaccctgccccaggacagcgccatgaccccccccctgcccctgcaggacaccgacctgagcagcgcccccaagcccgtggccgccgccacccccgtgagccagcaggccgaggagggcctgaccctgccccaggacagcgccatgaccgcccccctgcccctgcaggacaccggccccaccagcggccccgagcccctggccgtggccaccccccagaccctgcaggccgaggccggctgcgcccccggcaccgagcccgtggccaccatggcccagcaggaggtgggcgaggccctgggccccagacccgcccccgaggagaagaacgccgccctgcccaccgtgcccgagcccgccgccctggaccaggtgcagcaggacgacccccagcccgccgccgaggccggcaccccctgggccgcccaggaggacgccgacagcaccctgggcatggaggccctgagcctgcccgagcccgccagcggcgccggcgaggagatcgccgaggccctgagcagacccggcagagaggcctgcctggaggccagagcccacaccggcgacggcgccaagcccgacagcccccagaaggagaccctggaggtggagaaccagcaggagggcggcctgaagcccctggcccaggagcacggccccagaagcgccctgggcggcgccagagaggtgcccgacgccccccccgccgcctgccccgaggtgagccaggccagactgctgagccccgccagagaggagagaggcctgagcggcaagagcacccccgagcccaccctgcccagcgccgtggccaccgaggccagcctggacagctgccccgagagcagcgtgggcgccgtgagcagcctggacagaggctgccccgacgcccccgcccccaccagcgcccccaccagccagcagcccgagcccgtgctgggcctgggcagcgtggagcagccccacgaggtgcccagcgtgctgggcacccccctgctgcagccccccgagaacctggccaagggccagcccagcacccccgtggacagacccctgggccccgaccccagcgcccccggcaccctggccggcgccgccctgccccccctggagccccccgccccctgcctgtgccaggacccccaggaggacagcgtggaggacgaggagccccccggcagcctgggcctgccccccccccaggccggcgtgcagcccgccgccgccgccgtgagcggcaccacccagcccctgggcaccggccccagagtgagcctgagcccccacagccccctgctgagccccaaggtggccagcatggacgccaaggacctggccctgcagatcctgcccccctgccaggtgcccccccccagcggcccccagagccccgccggcccccagggcctgagcgcccccgagcagcaggaggacgaggacagcctggaggaggacagccccagagccctgggcagcggccagcacagcgacagccacggcgagagcagcgccgagctggacgagcaggacatcctggccccccagaccgtgcagtgccccgcccaggcccccgccggcggcagcgaggagaccatcgccaaggccaagcagagcagaagcgagaagaaggccagaaaggccatgagcaagctgggcctgagacagatccagggcgtgaccagaatcaccatccagaagagcaagaacatcctgttcgtgatcgccaagcccgacgtgttcaagagccccgccagcgacacctacgtggtgttcggcgaggccaagatcgaggacctgagccagcaggtgcacaaggccgccgccgagaagttcaaggtgcccagcgagcccagcgccctggtgcccgagagcgcccccagacccagagtgagactggagtgcaaggaggaggaggaggaggaggaggaggaggtggacgaggccggcctggagctgagagacatcgagctggtgatggcccaggccaacgtgagcagagccaaggccgtgagagccctgagagacaaccacagcgacatcgtgaacgccatcatggagctgaccatgtag

SEQ ID NO: 12825 - DNA, 3294 bp, Artificial Sequence; identical to SEQ ID NO: 10454
  Description of Artificial Sequence: Synthetic coding sequence

SEQ ID NO: 12826 - DNA, 1011 bp, Artificial Sequence
  Description of Artificial Sequence: Synthetic coding sequence
atgaaggccaccgccatgaccagcgcctggctggcccagggcggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagcagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12827 - DNA, 78 bp, Artificial Sequence
  Description of Artificial Sequence: Synthetic coding sequence
atgtggatgcacgtggccaaggtgcaccccaagggcggcgagatggtgggcgccatcagaaacgccgccttcctgtag

SEQ ID NO: 12828 - DNA, 312 bp, Artificial Sequence; identical to SEQ ID NO: 12740
  Description of Artificial Sequence: Synthetic coding sequence

SEQ ID NO: 12829 - DNA, 4101 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcaccacccagggcttccccgtgagaaacgtgagacccgtgcagaacgccatgaaccaggtgggcatcgtgctgaacgtgcagcagggccagaccgtgagacccatcaccctggtgcccgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggcccccagcttccccagcccccccgccgtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccagccctacttccccagctacgtgacccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 12830 - DNA, 564 bp, Artificial Sequence
  Description of Artificial Sequence: Synthetic coding sequence
atggacatcagcaagggcctgcccggcatgcagggcggcctgcacatctggatcagcgagaacagaaagatggtgcccgtgcccgagggcgcctacggcaacttcttcgaggagcactgctacgtgatcctgcacgtgccccagagccccaaggccacccagggcgccagcagcgacctgcactactgggtgggcaagcaggccggcgccgaggcccagggcgccgccgaggccttccagcagagactgcaggacgagctgggcggccagaccgtgctgcacagagaggcccagggccacgagagcgactgcttctgcagctacttcagacccggcatcatctacagaaagggcggcctggccagcgacctgaagcacgtggagaccaacctgttcaacatccagagactgctgcacatcaagggcagaaagcacgtgagcgccaccgaggtggagctgagctggaacagcttcaacaagggcgacatcttcctgctggacctgggcaagatgatgatccagtggaacggccccaagaccagcatcagcgagaaggccagatag

SEQ ID NO: 12831 - DNA, 1329 bp, Artificial Sequence
  Description of Artificial Sequence: Synthetic coding sequence
atgcccctggagaacctggaggaggagggcctgcccaagaaccccgacctgagaatcgcccagctgagattcctgctgagcctgcccgagcacagaggcgacgccgccgtgagagacgagctgatggccgccgtgagagacaacaacttctggaacagaatcagacaggagcagaccgaggactgcccccccagcagccccagcagaggctggcactgccaggactggcccagcagaaagccccccaccagcatcagactgtgcttcgccaagcccatcatcaagagacacagaatgcccagctacatggccccctactacgaggccctgtgcaagagcctggactggcagatcgacgtggacctgctgaacaagatgaagaaggccaacgaggacgagctgaagagactggacgaggagctggaggacgccgagaagaacctgggcgagagcgagatcagagacgccatgatggccaaggccgagtacctgtgcagaatcggcgacaaggagggcgccctgaccgccttcagaaagacctacgacaagaccgtggccctgggccacagactggacatcgtgttctacctgctgagaatcggcctgttctacatggacaacgacctgatcaccagaaacaccgagaaggccaagagcctgatcgaggagggcggcgactgggacagaagaaacagactgaaggtgtaccagggcctgtactgcgtggccatcagagacttcaagcaggccgccgagctgttcctggacaccgtgagcaccttcaccagctacgagctgatggactacaagaccttcgtgacctacaccgtgtacgtgagcatgatcgccctggagagacccgacctgagagagaaggtgatcaagggcgccgagatcctggaggtgctgcacagcctgcccgccgtgagacagtacctgttcagcctgtacgagtgcagatacagcgtgttcttccagagcctggccgtggtggagcaggagatgaagaaggactggctgttcgccccccactacagatactacgtgagagagatgagaatccacgcctacagccagctgctggagagctacagaagcctgaccctgggctacatggccgaggccttcggcgtgggcgtggagttcatcgaccaggagctgagcagattcatcgccgccggcagactgcactgcaagatcgacaaggtgaacgagatcgtggagaccaacagacccgacagcaagaactggcagtaccaggagaccatcaagaagggcgacctgctgctgaacagagtgcagaagctgagcagagtgatcaacatgtag

SEQ ID NO: 12832 - DNA, 333 bp, Artificial Sequence
  Description of Artificial Sequence: Synthetic coding sequence
atgctgtgctggggcaacgccagcttcggccagctgggcctgggcggcatcgacgaggagatcgtgctggagcccagaaagagcgacttcttcatcaacaagagagtgagagacgtgggctgcggcctgagacacaccgtgttcgtgctggacgacggcaccgtgtacacctgcggctgcaacgacctgggccagctgggccacgagaagagcagaaagaagcccgagttcagaagctgcttccccggcagaagcgccatggcccccagcagactgaccgccaccagcgccagccaggtgcaggccatcctgctgccccagccccccgagtag

SEQ ID NO: 12833 - DNA, 930 bp, Artificial Sequence
  Description of Artificial Sequence: Synthetic coding sequence
atggtgtgctggcagagcgtgagcgtgtggagcgtggccggcagagtggagatgaccgtgagcaagttcatggccatccagaaggccctgcagcccgactggttccagtgcctgagcgacggcgaggtgagctgcaaggaggccaccagcatcaagagagtgagaaagagcgtggacagaagcctgctgttcctggacaactgcctgagactgcaggaggagagcgaggtgctgcagaagagcgtgatcatcggcgtgatcgagggcggcgacgtgatggaggagagactgagaagcgccagagagaccgccaagagacccgtgggcggcttcctgctggacggcttccagggcaaccccaccaccctggaggccagactgagactgctgagcagcgtgaccgccgagctgcccgaggacaagcccagactgatcagcggcgtgagcagacccgacgaggtgctggagtgcatcgagagaggcgtggacctgttcgagagcttcttcccctaccaggtgaccgagagaggctgcgccctgaccttcagcttcgactaccagcccaaccccgaggagaccctgctgcagcagaacggcacccaggaggagatcaagtgcatggaccagatcaagaagatcgagaccaccggctgcaaccaggagatcaccagcttcgagatcaacctgaaggagaagaagtaccaggaggacttcaaccccctggtgagaggctgcagctgctactgctgcaagaaccacaccagagcctacatccaccacctgctggtgaccaacgagctgctggccggcgtgctgctgatgatgcacaacttcgagcactacttcggcttcttccactacatcagagaggccctgaagagcgacaagctggcccagctgaaggagctgatccacagacaggccagctag

SEQ ID NO: 12834 - DNA, 384 bp, Artificial Sequence
  Description of Artificial Sequence: Synthetic coding sequence
atggtgctgatcctgggcagaagactgaacagagaggacctgggcgtgagagacagccccgccaccaagagaaaggtgttcgagatggaccccaagagcctgaccggccacgagttcttcgacttcagcagcggcagcagccacgccgagaacatcctgcagatcttcaacgagttcagagacagcagactgttcaccgacgtgatcatctgcgtggagggcaaggagttcccctgccacagagccgtgctgagcgcctgcagcagctacttcagagccatgttctgcaacgaccacagagagagcagagagatgctggtggagatcaacggcatcctggccgaggccatggagtgcttcctgcagtacgtgtacaccggctag

SEQ ID NO: 12835 - DNA, 1581 bp, Artificial Sequence; identical to SEQ ID NO: 12018
  Description of Artificial Sequence: Synthetic coding sequence

SEQ ID NO: 12836 - DNA, 195 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgtag

SEQ ID NO: 12837 - DNA, 741 bp, Artificial Sequence; identical to SEQ ID NO: 9760
  Description of Artificial Sequence: Synthetic coding sequence

SEQ ID NO: 12838 - DNA, 1296 bp, Artificial Sequence
  Description of Artificial Sequence: Synthetic coding sequence
atggccgccaacctgagcagaaacggccccgccctgcaggaggcctacgtgagagtggtgaccgagaagagccccaccgactgggccctgttcacctacgagggcaacagcaacgacatcagagtggccggcaccggcgagggcggcctggaggagatggtggaggagctgaacagcggcaaggtgatgtacgccttctgcagagtgaaggaccccaacagcggcctgcccaagttcgtgctgatcaactggaccggcgagggcgtgaacgacgtgagaaagggcgcctgcgccagccacgtgagcaccatggccagcttcctgaagggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagcagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 12839 - DNA, 1854 bp, Artificial Sequence
  Description of Artificial Sequence: Synthetic coding sequence
atgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagcagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgctgatccccggcaagagcgccagcagattcggcagaagaggcagcgccatcggcatcggcaccgtggaggaggtggtggtgagaggcgccgccggcagcggcggctgcctgcacgccctgttcagcgccagaagccaggacggcggccacatcggcgacgtggcccccctgccccccggccaggcccccggcagagccggctggagcggcggcagcagcgacggcacccagcacctgctgtggggcctggtgcccgtgcccgagcccgtgcccctgaccagaggcttctggccctgcctgggcccctgggaccccggccccgtgcccgccagaatcagataccccaaggccctgcaccccgccgccagaccccccatcagccccgtgtgcatggagagacaccccagccccctgccctag

SEQ ID NO: 12840 - DNA, 1224 bp, Artificial Sequence
  Description of Artificial Sequence: Synthetic coding sequence
atgggcaacaccagcttcaacgaggtgatggaggcccagctgcccagccacggcggccccaagcccagcgccgagagcgacatgggcaccagaagagactacatcatggccaagtacgtggagcacagattcgccagaagatgcacccccgagccccagagactgtggaccgccatctgcaacagagacctgctgagcgtgctggaggccttcgccaacggccaggacttcggccagcccctgcccggccccgacgcccaggcccccgaggagctggtgctgcacctggccgtgaaggtggccaaccaggccagcctgcccctggtggacttcatcatccagaacggcggccacctggacgccaaggccgccgacggcaacaccgccctgcactacgccgccctgtacaaccagcccgactgcctgaagctgctgctgaagggcagagccctggtgggcaccgtgaacgaggccggcgagaccgccctggacatcgccagaaagaagcaccacaaggagtgcgaggagctgctggagcaggcccaggccggcaccttcgccttccccctgcacgtggactacagctgggtgatcagcaccgagcccggcagcgacagcgaggaggacgaggaggagaagagatgcctgctgaagctgcccgcccaggcccactgggccagcggcagactggacatcagcaacaagacctacgagaccgtggccagcctgggcgccgccaccccccagggcgagagcgaggactgccccccccccctgcccgtgaagaacagcagcagaaccctggtgcagggctgcgccagacacgccagcggcgacagaagcgaggtgagcagcctgagcagcgaggcccccgagacccccgagagcctgggcagccccgccagcagcagcagcctgatgagccccctggagcccggcgaccccagccaggccccccccaacagcgaggagggcctgagagagccccccggcaccagcagacccagcctgaccagcggcaccacccccagcgagatgtacctgcccgtgagattcagcagcgagagcaccagaagctacagaagaggcgccagaagccccgaggacggccccagcgccagacagcccctgcccagaagaaacgtgcccgtgggcatcaccgagggcgacggcagcagaaccggcagcctgcccgccagcagcgtgcagctgctgcaggactag

SEQ ID NO: 12841 - DNA, 813 bp, Artificial Sequence
  Description of Artificial Sequence: Synthetic coding sequence
atggccatggagatgagactgcccgtggccagaaagcccctgagcgagagactgggcagagacaccaagaagcacctggtggtgcccggcgacaccatcaccaccgacaccggcttcatgagaggccacggcacctacatgggcgaggagaagctgatcgccagcgtggccggcagcgtggagagagtgaacaagctgatctgcgtgaaggccctgaagaccagatacatcggcgaggtgggcgacatcgtggtgggcagaatcaccgaggtgcagcagaagagatggaaggtggagaccaacagcagactggacagcgtgctgctgctgagcagcatgaacctgcccggcggcgagctgagaagaagaagcgccgaggacgagctggccatgagaggcttcctgcaggagggcgacctgatcagcctgggccagggcgtgctggtgcaggtgagccccagcctggtgaagagacagaagacccacttccacgacctgccctgcggcgccagcgtgatcctgggcaacaacggcttcatctggatctaccccacccccgagcacaaggaggaggaggccggcggcttcatcgccaacctggagcccgtgagcctggccgacagagaggtgatcagcagactgagaaactgcatcatcagcctggtgacccagagaatgatgctgtacgacaccagcatcctgtactgctacgaggccagcctgccccaccagatcaaggacatcctgaagcccgagatcatggaggagatcgtgatggagaccagacagagactgctggagcaggagggctag

SEQ ID NO: 12842 - DNA, 297 bp, Artificial Sequence
  Description of Artificial Sequence: Synthetic coding sequence
atgcccgaggaccaggtgggcaagctggaggccaccgagaacaccatcagcgccatggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgcctag

SEQ ID NO: 12843 - DNA, 306 bp, Artificial Sequence
  Description of Artificial Sequence: Synthetic coding sequence
atggacgaggtggagcaggaccagcacgaggccagactgaaggagctgttcgacagcttcgacaccaccggcaccggcagcctgggccaggaggagctgaccgacctgtgccacatgctgagcctggaggaggtggcccccgtgctgcagcagaccctgctgcaggacaacctgctgggcagagtgcacttcgaccagttcaaggaggccctgatcctgatcctgagcagaaccctgagcaacgaggagcacttccaggagcccgactgcagcctggaggcccagcccaagtacgtgagaggctag

SEQ ID NO: 12844 - DNA, 1065 bp, Artificial Sequence
  Description of Artificial Sequence: Synthetic coding sequence
atggcccacagccccgtggccgtgcaggtgcccggcatgcagaacaacatcgccgaccccgaggagctgttcaccaagctggagagaatcggcaagggcagcttcggcgaggtgttcaagggcatcgacaacagaacccagcaggtggtggccatcaagatcatcgacctggaggaggccgaggacgagatcgaggacatccagcaggagatcaccgtgctgagccagtgcgacagcagctacgtgaccaagtactacggcagctacctgaagggcagcaagctgtggatcatcatggagtacctgggcggcggcagcgccctggacctgctgagagccggccccttcgacgagttccagatcgccaccatgctgaaggagatcctgaagggcctggactacctgcacagcgagaagaagatccacagagacatcaaggccgccaacgtgctgctgagcgagcagggcgacgtgaagctggccgacttcggcgtggccggccagctgaccgacacccagatcaagagaaacaccttcgtgggcacccccttctggatggcccccgaggtgatccagcagagcgcctacgacagcaagagacccaccgccaaggagctgctgaagcacaagttcatcgtgaagaacagcaagaagaccagctacctgaccgagctgatcgacagattcaagagatggaaggccgagggccacagcgacgacgagagcgacagcgagggcagcgacagcgagagcaccagcagagagaacaacacccaccccgagtggagcttcaccaccgtgagaaagaagcccgaccccaagaaggtgcagaacggcgccgagcaggacctggtgcagaccctgagctgcctgagcatgatcatcacccccgccttcgccgagctgaagcagcaggacgagaacaacgccagcagaaaccaggccatcgaggagctggagaagagcatcgccgtggccgaggccgcctgccccggcatcaccgacaagatggtgaagaagctgatcgagaagttccagaagtgcagcgccgacgagagcccctag

SEQ ID NO: 12845 - DNA, 522 bp, Artificial Sequence; identical to SEQ ID NO: 12809
  Description of Artificial Sequence: Synthetic coding sequence

SEQ ID NO: 12846 - DNA, 801 bp, Artificial Sequence
  Description of Artificial Sequence: Synthetic coding sequence
tgacccagagccgccgccagagtgagagccgccggcgaggccctggagagaagaagaagatggctgggcagactgagccccagcgcccccagacccagaagagccagacccagcctgagaagagccagcgcctgggtgagagacagagtggccggcagacccggcgccctgcccggcttccaggccagcggcgtggccggcgaggcccagaaggcccccggccaccccgccgcccccgcccccgccgccagctgcctgaccgaggccgacggcagagtgttcctgcacgccttcagactggccctgatccagctgcagatcagcagcatcaagagcgacaacgtgaccagagcctgcagcttcatcagagaggccgccacccagggcgccaagatcgtgagcctgcccgagtgcttcaacagcccctacggcgccaagtacttccccgagtacgccgagaagatccccggcgagagcacccagaagctgagcgaggtggccaaggagtgcagcatctacctgatcggcggcagcatccccgaggaggacgccggcaagctgtacaacacctgcgccgtgttcggccccgacggcaccctgctggccaagtacagaaagatccacctgttcgacatcgacgtgcccggcaagatcaccttccaggagagcaagaccctgagccccggcgacagcttcagcaccttcgacaccccctactgcagagtgggcctgggcatctgctacgacatgagattcgccgagctggcccagatctacgcccagagaggcgaggccgtgtag

SEQ ID NO: 12847 - DNA, 216 bp, Artificial Sequence
  Description of Artificial Sequence: Synthetic coding sequence
atggacagcctgcccgacgagttcttcgtgagacaccccgccgtggaggaccagagaaaggaggagaccgagaacaagctggagaagagcagcggccagctgaacaagcaggagaacgacatccccaccgacctggtgcccgtgaacctgctgctggaggtgaagaagctgctgaacgccatcaacaccctgcccaagggcgtggtgccccactag

SEQ ID NO: 12848 - DNA, 2130 bp, Artificial Sequence
  Description of Artificial Sequence: Synthetic coding sequence
atgagcgtggagagcgagcagctgaccggcgtgcccctggacgacagcgccatcacccccatgtgcgaggtgaccggcggcagaagctacagcgtgtgcagccccagaatgctgaaccagtgcctggagagcctggtgcagaaggtgcagagcggcgtggtgatcaacttcgagaaggccggccccgaccccagccccgtggaggacggccagcccgacatcagcagacccttcggcagccagccctggcacagctgccacaagctgatctacgtgagacccaaccccaagaccggcgtgcccatcggccactggcccgtgcccgagagcttctggcccgaccagaacagccccaccctgccccccagaaccagccaccccgtggtgaagttcagctgcaccgactgcgagcccatggtgatcgacaagctgcccttcgacaagtacgagctggagcccagccccctgacccagttcatcctggagagaaagagcccccagacctgctggcaggtgtacgtgagcaacagcgccaagtacagcgagctgggccaccccttcggctacctgaaggccagcaccgccctgaactgcgtgaacctgttcgtgatgccctacaactaccccgtgctgctgcccctgctggacgacctgttcaaggtgcacaaggccaagcccaccctgaagtggagacagagcttcgagagctacctgaagaccatgcccccctactacctgggccccctgaagaaggccgtgagaatgatgggcgcccccaacctgatcgccgacagcatggagtacggcctgagctacagcgtgatcagctacctgaagaagctgagccagcaggccaagatcgagagcgacagagtgatcggcagcgtgggcaagaaggtggtgcaggagaccggcatcaaggtgagaagcagaagccacggcctgagcatggcctacagaaaggacttccagcagctgctgcagggcatcagcgaggacgtgccccacagactgctggacctgaacatgaaggagtacaccggcttccaggtggccctgctgaacaaggacctgaagccccagaccttcagaaacgcctacgacatccccagaagaaacctgctggaccacctgaccagaatgagaagcaacctgctgaagagcaccagaagattcctgaagggccaggacgaggaccaggtgcacagcgtgcccatcgcccagatgggcaactaccaggagtacctgaagcaggtgcccagccccctgagagagctggaccccgaccagcccagaagactgcacaccttcggcaaccccttcaagctggacaagaagggcatgatgatcgacgaggccgacgagttcgtggccggcccccagaacaagcacaagagacccggcgagcccaacatgcagggcatccccaagagaagaagatgcatgagccccctgctgagaggcagacagcagaaccccgtggtgaacaaccacatcggcggcaagggcccccccgcccccaccacccaggcccagcccgacctgatcaagcccctgcccctgcacaagatcagcgagaccaccaacgacagcatcatccacgacgtggtggagaaccacgtggccgaccagctgagcagcgacatcacccccaacgccatggacaccgagttcagcgccagcagccccgccagcctgctggagagacccaccaaccacatggaggccctgggccacgaccacctgggcaccaacgacctgaccgtgggcggcttcctggagaaccacgaggagcccagagacaaggagcagtgcgccgaggagaacatccccgccagcagcctgaacaagggcaagaagctgatgcactgcagaagccacgaggaggtgaacaccgagctgaaggcccagatcatgaaggagatcagaaagcccggcagaaagtacgagagaatcttcaccctgctgaagcacgtgcagggcagcctgcagaccagactgatcttcctgcagaacgtgatcaaggaggccagcagattcaagaagagaatgctgatcgagcagctggagaacttcctggacgagatccacagaagagccaaccagatcaaccacatcaacagcaactag

SEQ ID NO: 12849 - DNA, 387 bp, Artificial Sequence
  Description of Artificial Sequence: Synthetic coding sequence
atggccagcagcaacaccgtgctgatgagactggtggccagcgcctacagcatcgcccagaaggccggcatgatcgtgagaagagtgatcgccgagggcgacctgggcatcgtggagaagacctgcgccaccgacctgcagaccaaggccgacagactggcccagatgagcatctgcagcagcctggccagaaagttccccaagctgaccatcatcggcgaggaggacctgcccagcgaggaggtggaccaggagctgatcgaggacagccagtgggaggagatcctgaagcagccctgccccagccagtacagcgccatcaaggaggaggacctggtggtgtgggtggaccccctggacggcaccaaggagtacaccgagggctag

SEQ ID NO: 12850 - DNA, 237 bp, Artificial Sequence; identical to SEQ ID NO: 9623
  Description of Artificial Sequence: Synthetic coding sequence

SEQ ID NO: 12851 - DNA, 171 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtactag

SEQ ID NO: 12852 - DNA, 357 bp, Artificial Sequence
  Description of Artificial Sequence: Synthetic coding sequence
atgaagatcttcgtgggcaacgtggacggcgccgacaccacccccgaggagctggccgccctgttcgccccctacggcaccgtgatgagctgcgccgtgatgaagcagttcgccttcgtgcacatgagagagaacgccggcgccctgagagccatcgaggccctgcacggccacgagctgagacccggcagagccctggtggtggagatgagcagacccagacccctgaacacctggaagatcttcgtgggcaacgtgagcgccgcctgcaccagccaggagctgagaagcctgttcgagagaagaggcagagtgatcgagtgcgacgtggtgaagggcggcatgtgcgtgggctag

SEQ ID NO: 12853 - DNA, 438 bp, Artificial Sequence
  Description of Artificial Sequence: Synthetic coding sequence
atgagcagccccagagacttcagagccgagcccgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgtgcagcaccacggctacagcggccccaacgagagaaccaccttctggcacggcagcaacgagggcgccgtgagcctgctgctgagatactgcgcctag

SEQ ID NO: 12854 - DNA, 438 bp, Artificial Sequence; identical to SEQ ID NO: 11428
  Description of Artificial Sequence: Synthetic coding sequence

SEQ ID NO: 12855 - DNA, 444 bp, Artificial Sequence; identical to SEQ ID NO: 10203
  Description of Artificial Sequence: Synthetic coding sequence

SEQ ID NO: 12856 - DNA, 300 bp, Artificial Sequence
  Description of Artificial Sequence: Synthetic coding sequence
atggacgagagcgccctgctggacctgctggagtgccccgtgtgcctggagagactggacgccagcgccaaggtgctgccctgccagcacaccttctgcaagagatgcctgctgggcatcgtgggcagcagaaacgagctgagatgccccgagtgcagaaccctggtgggcagcggcgtggaggagctgcccagcaacatcctgctggtgagactgctggacggcatcaagcagagaccctggaagcccggccccggcggcggcagcggcaccaactgcaccaacgccctgagaagctag

SEQ ID NO: 12857 - DNA, 3675 bp, Artificial Sequence
  Description of Artificial Sequence: Synthetic coding sequence
atggccctgagacccggcgccggcagcggcggcggcggcgccgccggcgccggcgccggcagcgccggcggcggcggcttcatgttccccgtggccggcggcatcagacccccccaggccggcctgatgcccatgcagcagcagggcttccccatggtgagcgtgatgcagcccaacatgcagggcatcatgggcatgaactacagcagccagatgagccagggccccatcgccatgcaggccggcatccccatgggccccatgcccgccgccggcatgccctacctgggccaggcccccttcctgggcatgagaccccccggcccccagtacacccccgacatgcagaagcagttcgccgaggagcagcagaagagattcgagcagcagcagaagctgctggaggaggagagaaagagaagacagttcgaggagcagaagcagaagctgagactgctgagcagcgtgaagcccaagaccggcgagaagagcagagacgacgccctggaggccatcaagggcaacctggacggcttcagcagagacgccaagatgcaccccacccccgccagccaccccaagaagcccggcgtgggcgtgttccccagccaggaccccgcccagcccagaatgcccccctggatctacaacgagagcctggtgcccgacgcctacaagaagatcctggagaccaccatgacccccaccggcatcgacaccgccaagctgtaccccatcctgatgagcagcggcctgcccagagagaccctgggccagatctgggccctggccaacagaaccacccccggcaagctgaccaaggaggagctgtacaccgtgctggccatgatcgccgtgacccagagaggcgtgcccgccatgagccccgacgccctgaaccagttccccgccgcccccatccccaccctgagcggcttcagcatgaccctgcccacccccgtgagccagcccaccgtgatccccagcggccccgccggcagcatgcccctgagcctgggccagcccgtgatgggcatcaacctggtgggccccgtgggcggcgccgccgcccaggccagcagcggcttcatccccacctaccccgccaaccaggtggtgaagcccgaggaggacgacttccaggacttccaggacgccagcaagagcggcagcctggacgacagcttcagcgacttccaggagctgcccgccagcagcaagaccagcaacagccagcacggcaacagcgcccccagcctgctgatgcccctgcccggcaccaaggccctgcccagcatggacaagtacgccgtgttcaagggcatcgccgccgacaagagcagcgagaacaccgtgccccccggcgaccccggcgacaagtacagcgccttcagagagctggagcagaccgccgagaacaagcccctgggcgagagcttcgccgagttcagaagcgccggcaccgacgacggcttcaccgacttcaagaccgccgacagcgtgagccccctggagccccccaccaaggacaagaccttcccccccagcttccccagcggcaccatccagcagaagcagcagacccaggtgaagaaccccctgaacctggccgacctggacatgttcagcagcgtgaactgcagcagcgagaagcccctgagcttcagcgccgtgttcagcaccagcaagagcgtgagcaccccccagagcaccggcagcgccgccaccatgaccgccctggccgccaccaagaccagcagcctggccgacgacttcggcgagttcagcctgttcggcgagtacagcggcctggcccccgtgggcgagcaggacgacttcgccgacttcatggccttcagcaacagcagcatcagcagcgagcagaagcccgacgacaagtacgacgccctgaaggaggaggccagccccgtgcccctgaccagcaacgtgggcagcaccgtgaagggcggccagaacagcaccgccgccagcaccaagtacgacgtgttcagacagctgagcctggagggcagcggcctgggcgtggaggacctgaaggacaacacccccagcggcaagagcgacgacgacttcgccgacttccacagcagcaagttcagcagcatcaacagcgacaagagcctgggcgagaaggccgtggccttcagacacaccaaggaggacagcgccagcgtgaagagcctggacctgcccagcatcggcggcagcagcgtgggcaaggaggacagcgaggacgccctgagcgtgcagttcgacatgaagctggccgacgtgggcggcgacctgaagcacgtgatgagcgacagcagcctggacctgcccaccgtgagcggccagcacccccccgccgccgacatcgaggacctgaagtacgccgccttcggcagctacagcagcaacttcgccgtgagcaccctgaccagctacgactggagcgacagagacgacgccacccagggcagaaagctgagccccttcgtgctgagcgccggcagcggcagccccagcgccaccagcatcctgcagaagaaggagaccagcttcggcagcagcgagaacatcaccatgaccagcctgagcaaggtgaccaccttcgtgagcgaggacgccctgcccgagaccaccttccccgccctggccagcttcaaggacaccatcccccagaccagcgagcagaaggagtacgagaacagagactacaaggacttcaccaagcaggacctgcccaccgccgagagaagccaggaggccacctgccccagccccgccagcagcggcgccagccaggagacccccaacgagtgcagcgacgacttcggcgagttccagagcgagaagcccaagatcagcaagttcgacttcctggtggccaccagccagagcaagatgaagagcagcgaggagatgatcaagagcgagctggccaccttcgacctgagcgtgcagggcagccacaagagaagcctgagcctgggcgacaaggagatcagcagaagcagccccagccccgccctggagcagcccttcagagacagaagcaacaccctgaacgagaagcccgccctgcccgtgatcagagacaagtacaaggacctgaccggcgaggtggaggagaacgagagatacgcctacgagtggcagagatgcctgggcagcgccctgaacgtgatcaagaaggccaacgacaccctgaacggcatcagcagcagcagcgtgtgcaccgaggtgatccagagcgcccagggcatggagtacctgctgggcgtggtggaggtgtacagagtgaccaagagagtggagctgggcatcaaggccaccgccgtgtgcagcgagaagctgcagcagctgctgaaggacatcgacaaggtgtggaacaacctgatcggcttcatgagcctggccaccctgacccccgacgagaacagcctggacttcagcagctgcatgctgagacccggcatcaagaacgcccaggagctggcctgcggcgtgtgcctgctgaacgtggacagcagaagcagagccttcaacagcgagaccgacagcttcaagctggcctacggcggccaccagtaccacgccagctgcgccaacttctggatcaactgcgtggagcccaagccccccggcctggtgctgcccgacctgctgtag

SEQ ID NO: 12858 - DNA, 354 bp, Artificial Sequence; identical to SEQ ID NO: 11388
  Description of Artificial Sequence: Synthetic coding sequence

SEQ ID NO: 12859 - DNA, 621 bp, Artificial Sequence; identical to SEQ ID NO: 11427
  Description of Artificial Sequence: Synthetic coding sequence

SEQ ID NO: 12860 - DNA, 582 bp, Artificial Sequence
  Description of Artificial Sequence: Synthetic coding sequence
atggaggagaccatcaaggacccccccaccagcgccgtgctgctggaccactgccacttcagccaggtgatcttcaacagcgtggagaagttctacatccccggcggcgacgtgacctgccactacaccttcacccagcacttcatccccagaagaaaggactggatcggcatcttcagagtgggctggaagaccaccagagagtactacaccttcatgtgggtgaccctgcccatcgacctgaacaacaagagcgccaagcagcaggaggtgcagttcaaggcctactacctgcccaaggacgacgagtactaccagttctgctacgtggacgaggacggcgtggtgagaggcgccagcatccccttccagttcagacccgagaacgaggaggacatcctggtggtgaccacccagggcgaggtggaggagatcgagcagcacaacaaggagctgtgcaaggagaaccaggagctgaaggacagctgcatcagcctgcagaagcagaacagcgacatgcaggccgagctgcagaagaagcaggaggagctggagaccctgcagagcatcaacaagaagtag

SEQ ID NO: 12861 - DNA, 156 bp, Artificial Sequence
  Description of Artificial Sequence: Synthetic coding sequence
atggacttcttcagcagccacctgctggccgacagcagcagccccgccaccaacagcagccacaccgacgcccacgagatcctggtgagcgacttcctggtgagcgacgagaacctgcagaagatggagaacgtgctggacctgtggagcagctag

SEQ ID NO: 12862 - DNA, 513 bp, Artificial Sequence
  Description of Artificial Sequence: Synthetic coding sequence
atgagcagcaacgagtgcttcaagtgcggcagaagcggccactgggccagagagtgccccaccggcggcggcagaggcagaggcatgagaagcagaggcagaggcttccagttcgtgagcagcagcctgcccgacatctgctacagatgcggcgagagcggccacctggccaaggactgcgacctgcaggaggacgcctgctacaactgcggcagaggcggccacatcgccaaggactgcaaggagcccaagagagagagagagcagtgctgctacaactgcggcaagcccggccacctggccagagactgcgaccacgccgacgagcagaagtgctacagctgcggcgagttcggccacatccagaaggactgcaccaaggtgaagtgctacagatgcggcgagaccggccacgtggccatcaactgcagcaagaccagcgaggtgaactgctacagatgcggcgagagcggccacctggccagagagtgcaccatcgaggccaccgcctag

SEQ ID NO: 12863 - DNA, 399 bp, Artificial Sequence
  Description of Artificial Sequence: Synthetic coding sequence
atgaaccaggaggacctggaccccgacagcaccaccgacgtgggcgacgtgaccaacaccgaggaggagctgatcagagagtgcgaggagatgtggaaggacatggaggagtgccagaacaagctgagcctgatcggcaccgagaccctgaccgacagcaacgcccagctgagcctgctgatcatgcaggtgaagtgcctgaccgccgagctgagccagtggcagaagaagacccccgagaccatccccctgaccgaggacgtgctgatcaccctgggcaaggaggagttccagaagctgagacaggacctggagatggtgctgagcaccaaggagagcaagaacgagaagctgaaggaggacctggagagagagcagagatggctggacgagcagtag

SEQ ID NO: 12864 - DNA, 1095 bp, Artificial Sequence
  Description of Artificial Sequence: Synthetic coding sequence
atggtgaagctgttcatcggcaacctgcccagagaggccaccgagcaggagatcagaagcctgttcgagcagtacggcaaggtgctggagtgcgacatcatcaagaactacggcttcgtgcacatcgaggacaagaccgccgccgaggacgccatcagaaacctgcaccactacaagctgcacggcgtgaacatcaacgtggaggccagcaagaacaagagcaagaccagcaccaagctgcacgtgggcaacatcagccccacctgcaccaacaaggagctgagagccaagttcgaggagtacggccccgtgatcgagtgcgacatcgtgaaggactacgccttcgtgcacatggagagagccgaggacgccgtggaggccatcagaggcctggacaacaccgagttccagggcaagagaatgcacgtgcagctgagcaccagcagactgagaaccgcccccggcatgggcgaccagagcggctgctacagatgcggcaaggagggccactggagcaaggagtgccccatcgacagaagcggcagagtggccgacctgaccgagcagtacaacgagcagtacggcgccgtgagaaccccctacaccatgagctacggcgacagcctgtactacaacaacgcctacggcgccctggacgcctactacaagagatgcagagccgccagaagctacgaggccgtggccgccgccgccgccagcgtgtacaactacgccgagcagaccctgagccagctgccccaggtgcagaacaccgccatggccagccacctgaccagcaccagcctggacccctacgacagacacctgctgcccaccagcggcgccgccgccaccgccgccgccgccgccgccgccgccgccgccgtgaccgccgccagcaccagctactacggcagagacagaagccccctgagaagagccaccgcccccgtgcccaccgtgggcgagggctacggctacggccacgagagcgagctgagccaggccagcgccgccgccagaaacagcctgtacgacatggccagatacgagagagagcagtacgccgacagagccagatacagcgccttctag

SEQ ID NO: 12865 - DNA, 420 bp, Artificial Sequence
  Description of Artificial Sequence: Synthetic coding sequence
atggccaccggcgacctgaagagaagcctgagaaacctggagcaggtgctgagactgctgaactaccccgaggaggtggactgcgtgggcctgatcaagggcgaccccgccgccagcctgcccatcatcagctacagcttcaccagctacagcccctacgtgaccgagctgatcatggagagcaacgtggagctgatcgccaagaacgacctgagattcatcgacgccgtgtacaagctgctgagagaccagttcaactacaagcccatcctgaccaagaagcagttcatccagtgcggcttcgccgagtggaagatccagatcgtgtgcgacatcctgaactgcgtgatgaagaagcacaaggagctgagcagcctgcagaagatccccagccagcagagaaagaagatcagcagctag

SEQ ID NO: 12866 - DNA, 450 bp, Artificial Sequence
  Description of Artificial Sequence: Synthetic coding sequence
atggccaacatcgccgtgcagagaatcaagagagagttcaaggaggtgctgaagagcgaggaggtgagattcatcaccaagatctggcaccccaacatcagcagcgtgaccggcgccatctgcctggacatcctgaaggaccagtgggccgccgccatgaccctgagaaccgtgctgctgagcctgcaggccctgctggccgccgccgagcccgacgacccccaggacgccgtggtggccaaccagtacaagcagaaccccgagatgttcaagcagaccgccagactgtgggcccacgtgtacgccggcgcccccgtgagcagccccgagtacaccaagaagatcgagaacctgtgcgccatgggcttcgacagaaacgccgtgatcgtggccctgagcagcaagagctgggacgtggagaccgccaccgagctgctgctgagcaactag

SEQ ID NO: 12867 - DNA, 597 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagaccttcgtgctggcccccgagggcagcgtgcccaacaagttctacgtgcacaacgacatgttcagatacgaggacgaggtgttcggcgacagcgagcccgagctggacgaggagagcgaggacgaggtggaggaggagcaggaggagagacagcccagccccgagcccgtgcaggagaacgccaacagcggctactacgaggcccaccccgtgaccaacggcatcgaggagcccctggaggagagcagccacgagcccgagccctag

SEQ ID NO: 12868 - DNA, 150 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagatag

SEQ ID NO: 12869 - DNA, 1266 bp, Artificial Sequence; identical to SEQ ID NO: 11954
  Description of Artificial Sequence: Synthetic coding sequence

SEQ ID NO: 12870 - DNA, 1173 bp, Artificial Sequence; identical to SEQ ID NO: 9682
  Description of Artificial Sequence: Synthetic coding sequence

SEQ ID NO: 12871 - DNA, 390 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtgtag

SEQ ID NO: 12872 - DNA, 489 bp, Artificial Sequence
  Description of Artificial Sequence: Synthetic coding sequence
atggacttcttcagcagccacctgctggccgacagcagcagccccgccaccaacagcagccacaccgacgcccacgagatcctggtgagcgacttcctggtgagcgacgagaacctgcagaagatggagaacgtgctggacctgtggagcagcggcctgaagaccaacatcatcagcgagctgagcaagtggagactgaacttcatcgactggcacagaatggagatgagaaaggagaaggagaagcacgccgcccacctgaagcagctgtgcaaccagatcaacgagctgaaggagctgcagaagaccttcgagatcagcatcggcagaaaggacgaggtgatcagcagcctgagccacgccatcggcaagcagaaggagaagatcgagctgatgagaaccttcttccactggagaatcggccacgtgagagccagacaggacgtgtacgagggcaagctggccgaccagtactaccagagaacctag

SEQ ID NO: 12873 - DNA, 411 bp, Artificial Sequence
  Description of Artificial Sequence: Synthetic coding sequence
atgatcgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgtgcagcaccacggctacagcggccccaacgagagaaccaccttctggcacggcagcaacgagggcgccgtgagcctgctgctgagatactgcgcctag

SEQ ID NO: 12874 - DNA, 321 bp, Artificial Sequence
  Description of Artificial Sequence: Synthetic coding sequence
atggccagccagctgcaggtgttcagcccccccagcgtgagcagcagcgccttctgcagcgccaagaagctgaagatcgagcccagcggctgggacgtgagcggccagagcagcaacgacaagtactacacccacagcaagaccctgcccgccacccagggccaggccaacagcagccaccaggtggccaacttcaacatccccgcctacgaccagggcctgctgctgcccgcccccgccgtggagcacatcgtggtgaccgccgccgacagcagcggcagcgccgccaccagcaccttccagagcagccagaccctgtag

SEQ ID NO: 12875 - DNA, 411 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtggacatcagaaccctggccgactag

SEQ ID NO: 12876 - DNA, 396 bp, Artificial Sequence
  Description of Artificial Sequence: Synthetic coding sequence
atggaggacggcacccccaagcacatcatccagatgaccggcttcaagatggaggagaaggaggccctggtgaagctgctgctgaagctggactgcaccttcatcaagagcgagaagtacaagaactgcacccacctgatcgccgagagactgtgcaagagcgagaagttcctggccgcctgcgccgccggcaagtggatcctgaccaaggactacatcatccacagcgccaagagcggcagatggctggacgagaccacctacgagtggggctacaagatcgagaaggacagcagatacagcccccagatgcagagcgcccccaagagatggagagaggagctgaagagaaccggcgcccccggcgccttccacagatggaaggtggtgctgtag

SEQ ID NO: 12877 - DNA, 1668 bp, Artificial Sequence; identical to SEQ ID NO: 9476
  Description of Artificial Sequence: Synthetic coding sequence

SEQ ID NO: 12878 - DNA, 1635 bp, Artificial Sequence; identical to SEQ ID NO: 10420
  Description of Artificial Sequence: Synthetic coding sequence

SEQ ID NO: 12879 - DNA, 393 bp, Artificial Sequence
  Description of Artificial Sequence: Synthetic coding sequence
atgggcagactggacggcaaggtgatcatcctgaccgccgccgcccagggcatcggccaggccgccgccctggccttcgccagagagggcgccaaggtgatcgccaccgacatcaacgagagcaagctgcaggagctggagaagtaccccggcatccagaccagagtgctggacgtgaccaagaagaagcagatcgaccagttcgccaacgaggtggagagactggacgtgctgttcaacgtggccggcttcgtgcaccacggcaccgtgctggactgcgaggagaaggactgggacttcagcatgaacctgaacgtgagaagcatgtacctgatgatcaaggccttcctgcccaagatgctggcccagaagagcggcaacatcatcaactag

SEQ ID NO: 12880 - DNA, 1119 bp, Artificial Sequence
  Description of Artificial Sequence: Synthetic coding sequence
atgcagggccccgccggcaacgccagcagaggcctgcccggcggcccccccagcaccgtggccagcggcgccggcagatgcgagagcggcgccctgatgcacagcttcggcatcttcctgcagggcctgctgggcgtggtggccttcagcaccctgatgctgaagagattcagagagcccaagcacgagagaagaccctggagaatctggttcctggacaccagcaagcaggccatcggcatgctgttcatccacttcgccaacgtgtacctggccgacctgaccgaggaggacccctgcagcctgtacctgatcaacttcctgctggacgccaccgtgggcatgctgctgatctacgtgggcgtgagagccgtgagcgtgctggtggagtggcagcagtgggagagcctgagattcggcgagtacggcgaccccctgcagtgcggcgcctgggtgggccagtgcgccctgtacatcgtgatcatgatcttcgagaagagcgtggtgttcatcgtgctgctgatcctgcagtggaagaaggtggccctgctgaaccccatcgagaaccccgacctgaagctggccatcgtgatgctgatcgtgcccttcttcgtgaacgccctgatgttctgggtggtggacaacttcctgatgagaaagggcaagaccaaggccaagctggaggagagaggcgccaaccaggacagcagaaacggcagcaaggtgagatacagaagagccgccagccacgaggagagcgagagcgagatcctgatcagcgccgacgacgagatggaggagagcgacgtggaggaggacctgagaagactgacccccctgaagcccgtgaagaagaagaagcacagattcggcctgcccgccggcgcccaggaggcccccatcaagaagaagagaccccccgtgaaggacgaggacctgaagggcgccagaggcaacctgaccaagaaccaggagatcaagagcaagacctaccaggtgatgagagagtgcgagcaggccggcagcgccgcccccagcgtgttcagcagaaccagaaccggcaccgagaccgtgttcgagaagcccaaggccggccccaccaagagcgtgttcggctag

SEQ ID NO: 12881 - DNA, 507 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagagagggcagacccagcggcgaggccttcgtggagctggagagcgaggacgaggtgaagctggccctgaagaaggacagagagaccatgggccacagatacgtggaggtgttcaagagcaacaacgtggagatggactgggtgctgaagcacaccggccccaacagccccgacaccgccaacgacggcttcgtgagactgagaggcctgcccttcggctgcagcaaggaggagatcgtgcagttcttcagcggcctggagatcgtgcccaacggcatcaccctgcccgtggacttccagggcagaagcaccggcgaggccttcgtgcagttcgccagccaggagatcgccgagaaggcctag

SEQ ID NO: 12882 - DNA, 9 bp, Artificial Sequence
  Description of Artificial Sequence: Synthetic coding sequence
atggcctag

SEQ ID NO: 12883 - DNA, 1131 bp, Artificial Sequence
  Description of Artificial Sequence: Synthetic coding sequence
atgaccaccgtggtggtgcacgtggacagcaaggccgagctgaccaccctgctggagcagtgggagaaggagcacggcagcggccaggacatggtgcccatcctgaccagaatgagccagctgatcgagaaggagaccgaggagtacagaaagggcgaccccgaccccttcgacgacagacaccccggcagagccgaccccgagtgcatgctgggccacctgctgagaatcctgttcaagaacgacgacttcatgaacgccctggtgaacgcctacgtgatgaccagcagagagccccccctgaacaccgccgcctgcagactgctgctggacatcatgcccggcctggagaccgccgtggtgttccaggagaaggagggcatcgtggagaacctgttcaagtgggccagagaggccgaccagcccctgagaacctacagcaccggcctgctgggcggcgccatggagaaccaggacatcgccgccaactacagagacgagaacagccagctggtggccatcgtgctgagaagactgagagagctgcagctgcaggaggtggccctgagacaggagaacaagagacccagccccagaaagctgagcagcgagcccctgctgcccctggacgaggaggccgtggacatggactacggcgacatggccgtggacgtggtggacggcgaccaggaggaggccagcggcgacatggagatcagcttccacctggacagcggccacaagaccagcagcagagtgaacagcaccaccaagcccgaggacggcggcctgaagaagaacaagagcgccaagcagggcgacagagagaacttcagaaaggccaagcagaagctgggcttcagcagcagcgaccccgacagaatgttcgtggagctgagcaacagcagctggagcgagatgagcccctgggtgatcggcaccaactacaccctgtaccccatgacccccgccatcgagcagagactgatcctgcagtacctgacccccctgggcgagtaccaggagctgctgcccatcttcatgcagctgggcagcagagagctgatgatgttctacatcgacctgaagcagaccaacgacgtgctgctgaccttcgaggccctgaagtag

SEQ ID NO: 12884 - DNA, 504 bp, Artificial Sequence
  Description of Artificial Sequence: Synthetic coding sequence
atgagcagcaacgagtgcttcaagtgcggcagaagcggccactgggccagagagtgccccaccggcggcggcagaggcagaggcatgagaagcagaggcagaggcggcttcaccagcgacagagacatctgctacagatgcggcgagagcggccacctggccaaggactgcgacctgcaggaggacgcctgctacaactgcggcagaggcggccacatcgccaaggactgcaaggagcccaagagagagagagagcagtgctgctacaactgcggcaagcccggccacctggccagagactgcgaccacgccgacgagcagaagtgctacagctgcggcgagttcggccacatccagaaggactgcaccaaggtgaagtgctacagatgcggcgagaccggccacgtggccatcaactgcagcaagaccagcgaggtgaactgctacagatgcggcgagagcggccacctggccagagagtgcaccatcgaggccaccgcctag

SEQ ID NO: 12885 - DNA, 999 bp, Artificial Sequence; identical to SEQ ID NO: 10468
  Description of Artificial Sequence: Synthetic coding sequence

SEQ ID NO: 12886 - DNA, 615 bp, Artificial Sequence
  Description of Artificial Sequence: Synthetic coding sequence
atgagcgacctgagaatcaccgaggccttcctgtacatggactacctgtgcttcagagccctgtgctgcaagggccccccccccgccagacccgagtacgacctggtgtgcatcggcctgaccggcagcggcaagaccagcctgctgagcaagctgtgcagcgagagccccgacaacgtggtgagcaccaccggcttcagcatcaaggccgtgcccttccagaacgccatcctgaacgtgaaggagctgggcggcgccgacaacatcagaaagtactggagcagatactaccagggcagccagggcgtgatcttcgtgctggacagcgccagcagcgaggacgacctggaggccgccagaaacgagctgcacagcgccctgcagcacccccagctgtgcaccctgcccttcctgatcctggccaaccaccaggacaagcccgccgccagaagcgtgcaggagatcaagaagtacttcgagctggagcccctggccagaggcaagagatggatcctgcagccctgcagcctggacgacatggacgccctgaaggacagcttcagccagctgatcaacctgctggaggagaaggaccacgaggccgtgagaatgtag

SEQ ID NO: 12887 - DNA, 6315 bp, Artificial Sequence
  Description of Artificial Sequence: Synthetic coding sequence
atggagagccaggagttcatcgtgctgtacacccaccagaagatgaagaagagcaaggtgtggcaggacggcatcctgaagatcacccacctgggcaacaaggccatcctgtacgacgacaagggcgcctgcctggagagcctgttcctgaagtgcctggaggtgaagcccggcgacgacctggagagcgacagatacctgatcaccgtggaggaggtgaaggtggccggcgccatcggcatcgtgaagcagaacgtgaacaaggaggcccccgagctgaacagcagaaccttcatcagcagcggcagaagcctgggctgccagcccagcggcctgaagagaaagttcaccggcttccagggccccagacaggtgcccaagaagatggtgatcatggagagcggcgagagcgccgccagccacgaggccaagaagaccggccccaccatcttcagccccttctgcagcatgccccccctgttccccaccgtgggcaagaaggacgtgaacaacatcctggccgaccccgagaacatcgtgacctacaagaacagagagagaaacgccatggacttcagcagcgtgttcagccccagcttccagatcaaccccgaggtgctgtgcgaggagaactacttctgcagccccgtgaacagcggcaacaagctgagcgacagcctgctgaccaacgagcccgtgaagagagacagcctggccagccactacagcggcgtgagccagaacatcagaagcaaggcccagatcctggccctgctgaagagcgagagcagcagcagctgcgaggagctgaacagcgagatgaccgagcacttcccccagaagcagccccagggcagcctgaagatcgccaccaagcccaagtacctgatccagcaggaggagtgcgccgagatgaagagcaccgagaacctgtactaccagcaccagagcgagaacaccatgagaaacaagagcagatgggccatgtacctgagcagccagagcagccccatccacagcagcaccgtggacggcaacgacaccgagagaaagcccaaggcccaggaggacgacgtgaacagcaacctgaaggacctgagcctgcagaagatcatccagttcgtggagacctacgccgaggagagaaagaagtacaacgtggaccagagcgtgggcaacaacgaccccagctggaaccaggaggtgaagctggagatccccagcttcaacgagagcagcagcctgcaggtgacctgcagcagcgccgagaacgacggcatcctgagcgagagcgacatccaggaggacaacaagatccccttcaaccagaacgacaagggctgcatcaagggcagcgtgctgatcaaggagaacgcccaggaggtgaacacctgcggcaccctggagaaggagtacgagcagagcgagagcagcctgcccgagctgaagcacctgcagatcgagagcagcaacaacagcagaatcagcgacgacatcaccgacatgatcagcgagagcaagatggacaacgagagcctgaacagcatccacgagagcctgagcaacgtgacccagcccttcctggaggtgaccttcaacctgaacaacttcgagaccagcgacaccgaggaggagagccaggagagcaacaagatcagccaggacagcgagagctgggtgaaggacatcctggtgaacgacggcaacagctgcttccagaagagaagcgagaacaccaactgcgaggagatcgagggcgagcacctgcccttcctgaccagcgtgagcgacaagcccaccgtgaccttccccgtgaaggagaccctgcccagccagttctgcgacaagacctacgtgggcttcgacatgggcatctgcaagaccgagaacaccggcaaggagatcgaggagtacagcgacaccctgagcaacttcgagagcttcaagtggaccgacgccgtgtacggcgacaacaaggaggacgccaacaagcccatccaggaggtgagaatcaactacgacttcgccctgccccccaacaagagcaagggcatcaacatgaacctgcacatcccccacatccagaaccagatcgccgagaacagcaacctgttcagcgaggacgcccagccccagcccttcatcctgggcagcgacctggacaagaacgacgagcacgtgctgcccagcaccagcagcagcgacaacagcgtgcagctgctgaacaccaaccagaaccactacgagtgcatcgccctggacaagagcaacacccacatcagcaacagcctgttctaccccctgggcaagaagcacctgatcagcaaggacaccgaggcccacatcagcgagcccgaggacctgggcaagatcagaagccccccccccgaccacgtggaggtggagaccgccagagagggcaagcagtactggaaccccagaaacagcagcgagctgagcggcctggtgaacaccatcagcatcctgaagagcctgtgcgagcacagcaccgccctggacagcctggagatcctgaagaagaagaacaccgtgttccagcagggcacccagcagacctacgagcccgacagcccccccgaggtgagaaagcccttcatcaccgtggtgagccccaagagcccccacctgcacaaggacagccagcagatcctgaaggaggacgaggtggagctgagcgagcccctgcagagcgtgcagttcagcagcagcggcagcaaggaggagaccgccttccaggccgtgatccccaagcagatcgagagaaagacctgcgaccccaagcccgtggagttccagggccaccaggtgaagggcagcgccaccagcggcgtgatggtgagaggccacagcagccagctgggctgcagccagttccccgacagcaccgagtacgagaacttcatgaccgagacccccgagctgcccagcacctgcatgcagatcgacttcctgcaggtgaccagccccgaggagaacatcagcaccctgagccccgtgagcaccttcagcctgaacagcagagacgaggacttcatggtggagttcagcgagaccagcctgaaggccagaaccctgcccgacgacctgcacttcctgaacctggagggcatgaagaagagcagaagcctggagaacgagaacctgcagagactgagcctgctgagcagaacccaggtgcccctgatcaccctgcccagaaccgacggcccccccgacctggacagccacagctacatgatcaacagcaacacctacgagagcagcggcagccccatgctgaacctgtgcgagaagagcgccgtgctgagcttcagcatcgagcccgaggaccagaacgagaccttcttcagcgaggagagcagagaggtgaaccccggcgacgtgagcctgaacaacatcagcacccagagcaagtggctgaagtaccagaacaccagccagtgcaacgtggccacccccaacagagtggacaagagaatcaccgacggcttcttcgccgaggccgtgagcggcatgcacttcagagacaccagcgagagacagagcgacgccgtgaacgagagcagcctggacagcgtgcacctgcagatgatcaagggcatgctgtaccagcagagacaggacttcagcagccaggacagcgtgagcagaaagaaggtgctgagcctgaacctgaagcagaccagcaagaccgaggagatcaagaacgtgctgggcggcagcacctgctacaactacagcgtgaaggacctgcaggagatcagcggcagcgagctgtgcttccccagcggccagaagatcaagagcgcctacctgccccagagacagatccacatccccgccgtgttccagagccccgcccactacaagcagaccttcaccagctgcctgatcgagcacctgaacatcctgctgttcggcctggcccagaacctgcagaaggccctgagcaaggtggacatcagcttctacaccagcctgaagggcgagaagctgaagaacgccgagaacaacgtgcccagctgccaccacagccagcccgccaagctggtgatggtgaagaaggagggccccaacaagggcagactgttctacacctgcgacggccccaaggccgacagatgcaagttcttcaagtggctggaggacgtgacccccggctacagcacccaggagggcgccagacccggcatggtgctgagcgacatcaagagcatcggcctgtacctgagaagccagaagatccccctgtacgaggagtgccagctgctggtgagaaagggcttcgacttccagagaaagcagtacggcaagctgaagaagttcaccaccgtgaaccccgagttctacaacgagcccaagaccaagctgtacctgaagctgagcagaaaggagagaagcagcgcctacagcaagaacgacctgtgggtggtgagcaagaccctggacttcgagctggacaccttcatcgcctgcagcgccttcttcggccccagcagcatcaacgagatcgagatcctgcccctgaagggctacttccccagcaactggcccaccaacatggtggtgcacgccctgctggtgtgcaacgccagcaccgagctgaccaccctgaagaacatccaggactacttcaaccccgccaccctgcccctgacccagtacctgctgaccaccagcagccccaccatcgtgagcaacaagagagtgagcaagagaaagttcatcccccccgccttcaccaacgtgagcaccaagttcgagctgctgagcctgggcgccaccctgaagctggccagcgagctgatccaggtgcacaagctgaacaaggaccaggccaccgccctgatccagatcgcccagatgatggccagccacgagagcatcgaggaggtgaaggagctgcagacccacaccttccccatcaccatcatccacggcgtgttcggcgccggcaagagctacctgctggccgtggtgatcctgttcttcgtgcagctgttcgagaagagcgaggcccccaccatcggcaacgccagaccctggaagctgctgatcagcagcagcaccaacgtggccgtggacagagtgctgctgggcctgctgagcctgggcttcgagaacttcatcagagtgggcagcgtgagaaagatcgccaagcccatcctgccctacagcctgcacgccggcagcgagaacgagagcgagcagctgaaggagctgcacgccctgatgaaggaggacctgacccccaccgagagagtgtacgtgagaaagagcatcgagcagcacaagctgggcaccaacagaaccctgctgaagcaggtgagagtggtgggcgtgacctgcgccgcctgccccttcccctgcatgaacgacctgaagttccccgtggtggtgctggacgagtgcagccagatcaccgagcccgccagcctgctgcccatcgccagattcgagtgcgagaagctgatcctggtgggcgaccccaagcagctgccccccaccatccagggcagcgacgccgcccacgagaacggcctggagcagaccctgttcgacagactgtgcctgatgggccacaagcccatcctgctgagaacccagtacagatgccaccccgccatcagcgccatcgccaacgacctgttctacaagggcgccctgatgaacggcgtgaccgagatcgagagaagccccctgctggagtggctgcccaccctgtgcttctacaacgtgaagggcctggagcagatcgagagagacaacagcttccacaacgtggccgaggccaccttcaccctgaagctgatccagagcctgatcgccagcggcatcgccggcagcatgatcggcgtgatcaccctgtacaagagccagatgtacaagctgtgccacctgctgagcgccgtggacttccaccaccccgacatcaagaccgtgcaggtgagcaccgtggacgccttccagggcgccgagaaggagatcatcatcctgagctgcgtgagaaccagacaggtgggcttcatcgacagcgagaagagaatgaacgtggccctgaccagaggcaagagacacctgctgatcgtgggcaacctggcctgcctgagaaagaaccagctgtggggcagagtgatccagcactgcgagggcagagaggacggcctgcagcacgccaaccagtacgagccccagctgaaccacctgctgaaggactacttcgagaagcaggtggaggagaagcagaagaagaagagcgagaaggagaagagcaaggacaagagccacagctag

SEQ ID NO: 12888 - DNA, 567 bp, Artificial Sequence
  Description of Artificial Sequence: Synthetic coding sequence
atggccgccaccgccagagaggacggcgccagcggccaggagagaggccagagaggctgcgagcactacgacagaggctgcctgctgaaggccccctgctgcgacaagctgtacacctgcagactgtgccacgacaacaacgaggaccaccagctggacagattcaaggtgaaggaggtgcagtgcatcaactgcgagaagatccagcacgcccagcagacctgcgaggagtgcagcaccctgttcggcgagtactactgcgacatctgccacctgttcgacaaggacaagaagcagtaccactgcgagaactgcggcatctgcagaatcggccccaaggaggacttcttccactgcctgaagtgcaacctgtgcctggccatgaacctgcagggcagacacaagtgcatcgagaacgtgagcagacagaactgccccatctgcctggaggacatccacaccagcagagtggtggcccacgtgctgccctgcggccacctgctgcacagaacctgctacgaggagatgctgaaggagtacgaccaggtgctggagaccgccggctag

SEQ ID NO: 12889 - DNA, 339 bp, Artificial Sequence
  Description of Artificial Sequence: Synthetic coding sequence
atggccaccggcgacctgaagagaagcctgagaaacctggagcaggtgctgagactgctgaactaccccgaggaggtggactgcgtgggcctgatcaagggcgaccccgccgccagcctgcccatcatcagctacagcttcaccagctacagcccctacgtgaccgagctgatcatggagagcaacgtggagctgatcgccaagaacgacctgagattcatcgacgccgtgtacaagctgctgagagaccagttcaactacaagcccatcctgaccaagaagcagttcatccagtgcggcttcgccgagtggaagatccagatcgtgtgcgacatctag

SEQ ID NO: 12890 - DNA, 363 bp, Artificial Sequence
  Description of Artificial Sequence: Synthetic coding sequence
atgtggaaggtggtgaacctgcccaccgacctgttcaacagcgtgatgaacgtgggcagattcaccgaggagatcgagtggctgaagttcctggccctggcctgcagcgccctgggcgtgaccatcaccaagaccctgaagatcgtgtgcgaggtgctgagctgcgaccacaacggcggcctgcccagaatccccttcagcaccttccagttcctgtacacctacatcgccgaggtggacggcgagatctgcgccagccacgtgagcagaatgctgaactacatcgagcaggaggtgatcggccccgacggcctgatcaccgtgaacgacttcacccagaaccccagagtgtggctggagtag

SEQ ID NO: 12891 - DNA, 2490 bp, Artificial Sequence
  Description of Artificial Sequence: Synthetic coding sequence
atggccaagtacaacaccggcggcaaccccaccgaggacgtgagcgtgaacagcagacccttcagagtgaccggccccaacagcagcagcggcatccaggccagaaagaacctgttcaacaaccagggcaacgccagcccccccgccggccccagcaacgtgcccaagttcggcagccccaagccccccgtggccgtgaagcccagcagcgaggagaagcccgacaaggagcccaagccccccttcctgaagcccaccggcgccggccagagattcggcacccccgccagcctgaccaccagagaccccgaggccaaggtgggcttcctgaagcccgtgggccccaagcccatcaacctgcccaaggaggacagcaagcccaccttcccctggccccccggcaacaagcccagcctgcacagcgtgaaccaggaccacgacctgaagcccctgggccccaagagcggccccaccccccccaccagcgagaacgagcagaagcaggccttccccaagctgaccggcgtgaagggcaagttcatgagcgccagccaggacctggagcccaagcccctgttccccaagcccgccttcggccagaagccccccctgagcaccgagaacagccacgaggacgagagccccatgaagaacgtgagcagcagcaagggcagccccgcccccctgggcgtgagaagcaagagcggccccctgaagcccgccagagaggacagcgagaacaaggaccacgccggcgagatcagcagcctgcccttccccggcgtggtgctgaagcccgccgccagcagaggcggccccggcctgagcaagaacggcgaggagaagaaggaggacagaaagatcgacgccgccaagaacaccttccagagcaagatcaaccaggaggagctggccagcggcaccccccccgccagattccccaaggcccccagcaagctgaccgtgggcggcccctggggccagagccaggagaaggagaagggcgacaagaacagcgccacccccaagcagaagcccctgccccccctgttcaccctgggcccccccccccccaagcccaacagaccccccaacgtggacctgaccaagttccacaagaccagcagcggcaacagcaccagcaagggccagaccagctacagcaccaccagcctgcccccccccccccccagccaccccgccagccagccccccctgcccgccagccaccccagccagccccccgtgcccagcctgccccccagaaacatcaagccccccttcgacctgaagagccccgtgaacgaggacaaccaggacggcgtgacccacagcgacggcgccggcaacctggacgaggagcaggacagcgagggcgagacctacgaggacatcgaggccagcaaggagagagagaagaagagagagaaggaggagaagaagagactggagctggagaagaaggagcagaaggagaaggagaagaaggagcaggagatcaagaagaagttcaagctgaccggccccatccaggtgatccacctggccaaggcctgctgcgacgtgaagggcggcaagaacgagctgagcttcaagcagggcgagcagatcgagatcatcagaatcaccgacaaccccgagggcaagtggctgggcagaaccgccagaggcagctacggctacatcaagaccaccgccgtggagatcgactacgacagcctgaagctgaagaaggacagcctgggcgcccccagcagacccatcgaggacgaccaggaggtgtacgacgacgtggccgagcaggacgacatcagcagccacagccagagcggcagcggcggcatcttcccccccccccccgacgacgacatctacgacggcatcgaggaggaggacgccgacgacggcagcaccctgcaggtgcaggagaagagcaacacctggagctggggcatcctgaagatgctgaagggcaaggacgacagaaagaagagcatcagagagaagcccaaggtgagcgacagcgacaacaacgagggcagcagcttccccgccccccccaagcagctggacatgggcgacgaggtgtacgacgacgtggacaccagcgacttccccgtgagcagcgccgagatgagccagggcaccaacgtgggcaaggccaagaccgaggagaaggacctgaagaagctgaagaagcaggagaaggaggagaaggacttcagaaagaagttcaagtacgacggcgagatcagagtgctgtacagcaccaaggtgaccaccagcatcaccagcaagaagtggggcaccagagacctgcaggtgaagcccggcgagagcctggaggtgatccagaccaccgacgacaccaaggtgctgtgcagaaacgaggagggcaagtacggctacgtgctgagaagctacctggccgacaacgacggcgagatctacgacgacatcgccgacggctgcatctacgacaacgactag

SEQ ID NO: 12892 - DNA, 795 bp, Artificial Sequence
  Description of Artificial Sequence: Synthetic coding sequence
atgcccgacagcgcccccgccatggccgacaagatggacatgagcctggacgacatcatcaagctgaacagaagccagagaggcggcagaggcggcggcagaggcagaggcagagccggcagccagggcggcagaggcggcggcgcccaggccgccgccagagtgaacagaggcggcggccccatcagaaacagacccgccatcgccagaggcgccgccggcggcggcggcagaaacagacccgccccctacagcagacccaagcagctgcccgacaagtggcagcacgacctgttcgacagcggcttcggcggcggcgccggcgtggagaccggcggcaagctgctggtgagcaacctggacttcggcgtgagcgacgccgacatccaggagctgttcgccgagttcggcaccctgaagaaggccgccgtgcactacgacagaagcggcagaagcctgggcaccgccgacgtgcacttcgagagaaaggccgacgccctgaaggccatgaagcagtacaacggcgtgcccctggacggcagacccatgaacatccagctggtgaccagccagatcgacgcccagagaagacccgcccagagcgtgaacagaggcggcatgaccagaaacagaggcgccggcggcttcggcggcggcggcggcaccagaagaggcaccagaggcggcgccagaggcagaggcagaggcgccggcagaaacagcaagcagcagctgagcgccgaggagctggacgcccagctggacgcctacaacgccagaatggacaccagctag

SEQ ID NO: 12893 - DNA, 312 bp, Artificial Sequence
  Description of Artificial Sequence: Synthetic coding sequence
atggccaagcacggcgccgacgagcccagcagcagaagcggcagccccgacagagagggcagagccagcgaggacagaagcctgctgcaccagagactggccgtgagagagctgatcgacaccgaggtgagctacctgcacatgctgcagctgtgcgccagcgacatcagaagcagactgcagcagctgccccagggcgacctggacgtgctgttcagcaacatcgacgacatcatcaaggtgaacagcagattcctgcacgacctgcaggagaccgccagcaaggaggaggagcaggtgcagctggtgtag

SEQ ID NO: 12894 - DNA, 639 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagagagggcagacccagcggcgaggccttcgtggagctggagagcgaggacgaggtgaagctggccctgaagaaggacagagagaccatgggccacagatacgtggaggtgttcaagagcaacaacgtggagatggactgggtgctgaagcacaccggccccaacagccccgacaccgccaacgacggcttcgtgagactgagaggcctgcccttcggctgcagcaaggaggagatcgtgcagttcttcagcggcctggagatcgtgcccaacggcatcaccctgcccgtggacttccagggcagaagcaccggcgaggccttcgtgcagttcgccagccaggagatcgccgagaaggccctgaagaagcacaaggagagaatcggccacagatacatcgagatcttcaagagcagcagagccgaggtgagaacccactacgacccccccagaaagctgatggccatgcagagacccggcccctacgacagatag

SEQ ID NO: 12895 - DNA, 1020 bp, Artificial Sequence; identical to SEQ ID NO: 10066
  Description of Artificial Sequence: Synthetic coding sequence

SEQ ID NO: 12896 - DNA, 3213 bp, Artificial Sequence
  Description of Artificial Sequence: Synthetic coding sequence
atggccggcgccctgagaagaggcagagccctgggcagcagacccagcggccccaccgtgagcagcagaagaagcccccagtgccccgtggcccaggagggcctgggcgccagaagcagacccagagtggcccccagaagcctggccagatgcggccccagcagcagactgatgggctggaagcccagcgaggccagaggccagagccagagcttccaggccagcggcctgcagcccagaagcctgaaggccgccagaagagccaccggcagacccgacagaagcagagccgccagacccaccatggaccccagcgcccacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcggcgagggcaagcccggcagagtggtggacatcagaggctgggacgtggagaccggcagaagcgtggccagcgtgacctgggccgacggcaccaccaacgtgtacagagtgggccacaagggcaaggtggacctgaagtgcgtgggcgaggccgccggcggcttctactacaaggaccacctgcccagactgggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagttcatcggccagaccggcaccgtgcacagaatcaccgacagaggcgacgtgagagtgcagttcaaccacgagaccagatggaccttccaccccggcgccctgaccaagcaccacagcttctgggtgggcgacgtggtgagagtgatcggcgacctggacaccgtgaagagactgcaggccggccacggcgagtggaccgacgacatggcccccgccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 12897 - DNA, 957 bp, Artificial Sequence; identical to SEQ ID NO: 12633
  Description of Artificial Sequence: Synthetic coding sequence

SEQ ID NO: 12898 - DNA, 1044 bp, Artificial Sequence; identical to SEQ ID NO: 10033
  Description of Artificial Sequence: Synthetic coding sequence

SEQ ID NO: 12899 - DNA, 108 bp, Artificial Sequence
  Description of Artificial Sequence: Synthetic coding sequence
atgccccagaccttcagcggcggcagaggcttcgagctggacagcggcagcgacgacatggaccccggcagacccagaccccccagagaccccgacgagctgcactag

SEQ ID NO: 12900 - DNA, 1179 bp, Artificial Sequence; identical to SEQ ID NO: 11426
  Description of Artificial Sequence: Synthetic coding sequence

SEQ ID NO: 12901 - DNA, 2052 bp, Artificial Sequence; identical to SEQ ID NO: 9821
  Description of Artificial Sequence: Synthetic coding sequence

SEQ ID NO: 12902 - DNA, 99 bp, Artificial Sequence
  Description of Artificial Sequence: Synthetic coding sequence
atggacttcttcagcagccacctgctggccgacagcagcagccccgccaccaacagcagccacaccgacgcccacgagatcctggtgagcgacttctag

SEQ ID NO: 12903 - DNA, 858 bp, Artificial Sequence; identical to SEQ ID NO: 10401
  Description of Artificial Sequence: Synthetic coding sequence

SEQ ID NO: 12904 - DNA, 354 bp, Artificial Sequence; identical to SEQ ID NO: 11388
  Description of Artificial Sequence: Synthetic coding sequence

SEQ ID NO: 12905 - DNA, 7614 bp, Artificial Sequence
  Description of Artificial Sequence: Synthetic coding sequence
atggaggacttcagaggcatcgccgaggagagcttccccagcttcctgaccaacagcctgttcggcaacagcggcatcctggagaacgtgaccctgagcagcaacctgggcctgcccgtggccgtgagcaccctggccagagacagaagcagcaccgacaacagataccccgacatccaggccagctacctggtggagggcagattcagcgtgcccagcggcagcagccccggcagccagagcgacgccgagcccagagagagactgcagctgagcttccaggacgacgacagcatcagcagaaagaagagctacgtggagagccagagactgagcaacgccctgagcaagcagagcgccctgcagatggagaccgccggccccgaggaggagcccgccggcgccaccgagagcctgcagggccaggacctgttcaacagagccagccccctggagcaggcccaggacagccccatcgacttccacctgcagagctggatgaacaacaaggagcccaagatcgtggtgctggacgccggcaagcacttcgaggacaagaccctgaagagcgacctgagccacaccagcctgctggagaacgagaagctgatcctgcccaccagcctggaggacagcagcgacgacgacatcgacgacgagatgttctacgacgaccacctggaggcctacttcgagcagctggccatccccggcatgatctacgaggacctggagggccccgagccccccgagaagggcttcaagctgcccaccaacggcctgagacaggccaacgagaacggcagcctgaactgcaagttccagagcgagaacaacagcagcctgatcagcctggacagccacagcagcgagaccacccacaaggagagcgaggagagccaggtgatctgcctgcccggcaccagcaacagcatcggcaccggcgacagcagaagatacaccgacggcatgctgcccttcagcagcggcacctggggcaccgagaaggagatcgagaacctgaagggcatcgtgcccgacctgaacagcgagtgcgccagcaaggacgtgctggtgaagaccctgagagccatcgacgtgaagctgaacagcgacaacttccacgacgccaacgccaacagaggcggcttcgacctgaccgaccccgtgaagcagggcgccgagtgcccccaccagaacaagaccgtgctgcacatggacggctgcctggacaccgagacccccaccgtgagcatccaggagaacgtggacgtggccagcctgaagcccatcagcgacagcggcatcaacttcaccgacgccatctggagccccacctgcgagagaagaacctgcgagtgccacgagagcatcgagaagaacaaggacaagaccgacctgccccagagcgtggtgtaccagaacgaggagggcagatgggtgaccgacctggcctactacaccagcttcaacagcaagcagaacctgaacgtgagcctgagcgacgagatgaacgaggacttcagaagcggcagcgaggccttcgacctgatcgcccaggacgaggaggagttcaacaaggagcaccagttcatccaggaggagaacatcgacgcccacaacaccagcgtggccctgggcgacaccagctggggcgccaccatcaactacagcctgctgagaaagagcagaagcaccagcgacctggacaaggacgacgccagctacctgagactgagcctgggcgagttcttcgcccagagaagcgaggccctgggctgcctgggcggcggcaacaacgtgaagagacccagcttcggctacttcatcagaagccccgagaagagagagcccatcgccctgatcagaaagagcgacgtgagcagaggcaacctggagaaggagatggcccacctgaaccacgacctgtacagcggcgacctgaacgagcagagccaggcccagctgagcgagggcagcatcaccctgcaggtggaggccgtggagagcaccagccaggtggacgagaacgacgtgaccctgaccgccgacaagggcaagaccgaggacaccttcttcatgagcaacaagccccagagatacaaggacaagctgcccgacagcggcgacagcatgctgagaatcagcaccatcgccagcgccatcgccgaggccagcgtgaacaccgaccccagccagctggccgccatgatcaaggccctgagcaacaagaccagagacaagaccttccaggaggacgagaagcagaaggactacagccacgtgagacacttcctgcccaacgacctggagaagagcaacggcagcaacgccctggacatggagaagtacctgaagaagaccgaggtgagcagatacgagagcgccctggagaacttcagcagagccagcatgagcgacacctgggacctgagcctgcccaaggagcagaccacccaggacatccaccccgtggacctgagcgccaccagcgtgagcgtgagagcccccgaggagaacaccgccgccatcgtgtacgtggagaacggcgagagcgagaaccaggagagcttcagaaccatcaacagcagcaacagcgtgaccaacagagagaacaacagcgccgtggtggacgtgaagacctgcagcatcgacaacaagctgcaggacgtgggcaacgacgagaaggccaccagcatcagcacccccagcgacagctacagcagcgtgagaaaccccagaatcaccagcctgtgcctgctgaaggactgcgaggagatcagagacaacagagagaaccagagacagaacgagtgcgtgagcgagatcagcaacagcgagaagcacgtgaccttcgagaaccacagaatcgtgagccccaagaacagcgacctgaagaacaccagccccgagcacggcggcagaggcagcgaggacgagcaggagagcttcagacccagcaccagccccctgagccacagcagccccagcgagatcagcggcaccagcagcagcggctgcgccctggagagcttcggcagcgccgcccagcagcagcagcccccctgcgagcaggagctgagccccctggtgtgcagccccgccggcgtgagcagactgacctacgtgagcgagcccgagagcagctaccccaccaccgccaccgacgacgccctggaggacagaaagagcgacatcaccagcgagctgagcaccaccatcatccagggcagccccgccgccctggaggagagagccatggagaagctgagagagaaggtgcccttccagaacagaggcaagggcaccctgagcagcatcatccagaacaacagcgacaccagaaaggccaccgagaccaccagcctgagcagcaagcccgagtacgtgaagcccgacttcagatggagcaaggaccccagcagcaagagcggcaacctgctggagaccagcgaggtgggctggaccagcaaccccgaggagctggaccccatcagactggccctgctgggcaagagcggcctgagctgccaggtgggcagcgccaccagccaccccgtgagctgccaggagcccatcgacgaggaccagagaatcagccccaaggacaagagcaccgccggcagagagttcagcggccaggtgagccaccagaccaccagcgagaaccagtgcacccccatccccagcagcaccgtgcacagcagcgtggccgacatgcagaacatgcccgccgccgtgcacgccctgctgacccagcccagcctgagcgccgcccccttcgcccagagatacctgggcaccctgcccagcaccggcagcaccaccctgccccagtgccacgccggcaacgccaccgtgtgcggcttcagcggcggcctgccctaccccgccgtggccggcgagcccgtgcagaacagcgtggccgtgggcatctgcctgggcagcaacatcggcagcggctggatgggcaccagcagcctgtgcaacccctacagcaacaccctgaaccagaacctgctgagcaccaccaagcccttccccgtgcccagcgtgggcaccaactgcggcatcgagccctgggacagcggcgtgaccagcggcctgggcagcgtgagagtgcccgaggagctgaagctgccccacgcctgctgcgtgggcatcgccagccagaccctgctgagcgtgctgaaccccaccgacagatggctgcaggtgagcatcggcgtgctgagcatcagcgtgaacggcgagaaggtggacctgagcacctacagatgcctggtgttcaagaacaaggccatcatcagaccccacgccaccgaggagatcaaggtgctgttcatccccagcagccccggcgtgttcagatgcaccttcagcgtggccagctggccctgcagcaccgacgccgagaccatcgtgcaggccgaggccctggccagcaccgtgaccctgaccgccatcgccgagagccccgtgatcgaggtggagaccgagaagaaggacgtgctggacttcggcgacctgacctacggcggctggaaggccctgcccctgaagctgatcaacagaacccacgccaccgtgcccatcagactgatcatcaacgccaacgccgtggcctggagatgcttcaccttcagcaaggagagcgtgagagcccccgtggaggtggccccctgcgccgacgtggtgaccagactggccggccccagcgtggtgaaccacatgatgcccgccagctacgacggccaggaccccgagttcctgatgatctgggtgctgttccacagccccaagaagcagatcagcagcagcgacatcctggacagcgccgaggagttcagcgccaaggtggacatcgaggtggacagccccaaccccacccccgtgctgagaagcgtgagcctgagagccagagccggcatcgccagaatccacgcccccagagacctgcagaccatgcacttcctggccaaggtggccagcagcagaaagcagcacctgcccctgaagaacgccggcaacatcgaggtgtacctggacatcaaggtgcccgagcagggcagccacttcagcgtggaccccaagaacctgctgctgaagcccggcgaggagcacgaggtgatcgtgagcttcacccccaaggaccccgaggcctgcgaggagagaatcctgaagatcttcgtgcagcccttcggcccccagtacgaggtggtgctgaagggcgaggtgatcagcagcggcagcaagcccctgagccccggcccctgcctggacatccccagcatcctgagcaacaagcagttcctggcctggggcggcgtgcccctgggcagaacccagctgcagaagctggccctgagaaacaacagcgccagcaccacccagcacctgagactgctgatcagaggccaggaccaggactgcttccagctgcagaacaccttcggcagcgagcagagactgaccagcaactgcgagatcagaatccaccccaaggaggacatcttcatcagcgtgctgttcgcccccaccagactgagctgcatgctggccagactggagatcaagcagctgggcaacagaagccagcccggcatcaagttcaccatccccctgagcggctacggcggcaccagcaacctgatcctggagggcgtgaagaagctgagcgacagctacatggtgaccgtgaacggcctggtgcccggcaaggagagcaagatcgtgttcagcgtgagaaacaccggcagcagagccgccttcgtgaaggccgtgggcttcaaggacagccagaagaaggtgctgctggaccccaaggtgctgagaatcttccccgacaagttcgtgctgaaggagagaacccaggagaacgtgaccctgatctacaaccccagcgacagaggcatcaacaacaagaccgccaccgagctgagcaccgtgtacctgttcggcggcgacgagatcagcagacagcagtacagaagagccctgctgcacaagcccgagatgatcaagcagatcctgcccgagcacagcgtgctgcagaacatcaacttcgtggaggccttccaggacgagctgctggtgaccgaggtgtacgacctgccccagagacccaacgacgtgcagctgttctacggcagcatgtgcaagatcatcctgagcgtgatcggcgagttcagagactgcatcagcagcagagagttcctgcagcccagcagcaaggccagcctggagagcaccagcgacctgggcgccagcggcaagcacggcggcaacgtgagcctggacgtgctgcccgtgaagggcccccagggcagccccctgctgagcagagccgccagaccccccctggaccagctggccagcgaggagccctggaccgtgctgcccgagcacctgatcctggtggcccccagcccctgcgacatggccaagaccggcagattccagatcgtgaacaacagcgtgagactgctgagattcgagctgtgctggcccgcccactgcctgaccgtgaccccccagcacggctgcgtggcccccgagagcaagctgcagatcctggtgagccccaacagcagcctgagcaccaagcagagcatgttcccctggagcggcctgatctacatccactgcgacgacggccagaagaagatcgtgaaggtgcagatcagagaggacctgacccaggtggagctgctgaccagactgaccagcaagcccttcggcatcctgagccccgtgagcgagcccagcgtgagccacctggtgaagcccatgaccaagccccccagcaccaaggtggagatcagaaacaagagcatcaccttccccaccaccgagcccggcgagaccagcgagagctgcctggagctggagaaccacggcaccaccgacgtgaagtggcacctgagcagcctggcccccccctacgtgaagggcgtggacgagagcggcgacgtgttcagagccacctacgccgccttcagatgcagccccatcagcggcctgctggagagccacggcatccagaaggtgagcatcaccttcctgcccagaggcagaggcgactacgcccagttctgggacgtggagtgccaccccctgaaggagccccacatgaagcacaccctgagattccagctgagcggccagagcatcgaggccgagaacgagcccgagaacgcctgcctgagcaccgacagcctgatcaagatcgaccacctggtgaagcccagaagacaggccgtgagcgaggccagcgccagaatccccgagcagctggacgtgaccgccagaggcgtgtacgcccccgaggacgtgtacagattcagacccaccagcgtgggcgagagcagaaccctgaaggtgaacctgagaaacaacagcttcatcacccacagcctgaagttcctgagccccagagagcccttctacgtgaagcacagcaagtacagcctgagagcccagcactacatcaacatgcccgtgcagttcaagcccaagagcgccggcaagttcgaggccctgctggtgatccagaccgacgagggcaagagcatcgccatcagactgatcggcgaggccctgggcaagaactag

SEQ ID NO: 12906 - DNA, 90 bp, Artificial Sequence
  Description of Artificial Sequence: Synthetic coding sequence
atgctgtgctggggcaacgccagcttcggccagctgggcctgggcggcatcgacgaggagatcgtgctggagcccagaaagagcgactag

SEQ ID NO: 12907 - DNA, 66 bp, Artificial Sequence
  Description of Artificial Sequence: Synthetic coding sequence
atggccaagtacaacaccggcggcaaccccaccgaggacgtgagcgtgaacagcagacccttctag

SEQ ID NO: 12908 - DNA, 261 bp, Artificial Sequence
  Description of Artificial Sequence: Synthetic coding sequence
atggaggccgacatcatcaccaacctgagatgcagactgaaggaggccgaggaggagagactgaaggccgcccagtacggcctgcagctggtggagagccagaacgagctgcagaaccagctggacaagtgcagaaacgagatgatgaccatgaccgagagctacgagcaggagaagtacaccctgcagagagaggtggagctgaagagcagaatgctggagagcctgagctgcgagtgcgaggccatcaagcagcagtag

SEQ ID NO: 12909 - DNA, 1983 bp, Artificial Sequence
  Description of Artificial Sequence: Synthetic coding sequence
atggtgaccagcctgaacgaggacaacgagagcgtgaccgtggagtggatcgagaacggcgacaccaagggcaaggagatcgacctggagagcatcttcagcctgaaccccgacctggtgcccgacgaggagatcgagcccagccccgagaccccccccccccccgccagcagcgccaaggtgaacaagatcgtgaagaacagaagaaccgtggccagcatcaagaacgacccccccagcagagacaacagagtggtgggcagcgccagagccagacccagccagttccccgagcagagcagcagcgcccagcagaacgccagaagaaagagcaactgcgtgaaggaggtggagaagctgcaggagaagagagagaagagaagactgcagcagcaggagctgagagagaagagagcccaggacgtggacgccaccaaccccaactacgagatcatgtgcatgatcagagacttcagaggcagcctggactacagacccctgaccaccgccgaccccatcgacgagcacagaatctgcgtgtgcgtgagaaagagacccctgaacaagaaggagacccagatgaaggacctggacgtgatcaccatccccagcaaggacgtggtgatggtgcacgagcccaagcagaaggtggacctgaccagatacctggagaaccagaccttcagattcgactacgccttcgacgacagcgcccccaacgagatggtgtacagattcaccgccagacccctggtggagaccatcttcgagagaggcatggccacctgcttcgcctacggccagaccggcagcggcaagacccacaccatgggcggcgacttcagcggcaagaaccaggactgcagcaagggcatctacgccctggccgccagagacgtgttcctgatgctgaagaagcccaactacaagaagctggagctgcaggtgtacgccaccttcttcgagatctacagcggcaaggtgttcgacctgctgaacagaaagaccaagctgagagtgctggaggacggcaagcagcaggtgcaggtggtgggcctgcaggagagagaggtgaagtgcgtggaggacgtgctgaagctgatcgacatcggcaacagctgcagaaccagcggccagaccagcgccaacgcccacagcagcagaagccacgccgtgttccagatcatcctgagaagaaagggcaagctgcacggcaagttcagcctgatcgacctggccggcaacgagagaggcgccgacaccagcagcgccgacagacagaccagactggagggcgccgagatcaacaagagcctgctggccctgaaggagtgcatcagagccctgggcagaaacaagccccacacccccttcagagccagcaagctgacccaggtgctgagagacagcttcatcggcgagaacagcagaacctgcatgatcgccaccatcagccccggcatggccagctgcgagaacaccctgaacaccctgagatacgccaacagagtgaaggagctgaccgtggaccccaccgccgccggcgacgtgagacccatcatgcaccacccccccaaccagatcgacgacctggagacccagtggggcgtgggcagcagcccccagagagacgacctgaagctgctgtgcgagcagaacgaggaggaggtgagcccccagctgttcaccttccacgaggccgtgagccagatggtggagatggaggagcaggtggtggaggaccacagagccgtgttccaggagagcatcagatggctggaggacgagaaggccctgctggagatgaccgaggaggtggactacgacgtggacagctacgccacccagctggaggccatcctggagcagaagatcgacatcctgaccgagctgagagacaaggtgaagagcttcagagccgccctgcaggaggaggagcaggccagcaagcagatcaaccccaagagacccagagccctgtag

SEQ ID NO: 12910 - DNA, 207 bp, Artificial Sequence
  Description of Artificial Sequence: Synthetic coding sequence
atgagcagccccagagacttcagagccgagcccgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggactag

SEQ ID NO: 12911 - DNA, 294 bp, Artificial Sequence
  Description of Artificial Sequence: Synthetic coding sequence
atgaacggcagagccgacttcagagagcccaacgccgaggtgcccagacccatcccccacatcggccccgactacatccccaccgaggaggagagaagagtgttcgccgagtgcaacgacgagagcttctggttcagaagcgtgcccctggccgccaccagcatgctgatcacccagggcctgatcagcaagggcatcctgagcagccaccccaagtacggcagcatccccaagctgatcctggcctgcatcatgggctacttcgccggcaagctgagctacgtgaagacctag

SEQ ID NO: 12912 - DNA, 309 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggctag

SEQ ID NO: 12913 - DNA, 597 bp, Artificial Sequence
  Description of Artificial Sequence: Synthetic coding sequence
atgggcaccacctgcctgcacctgggcaccctggagcagagcctggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgcccttccagcaccacggctacagcggccccaacgagagaaccaccttctggcacggcagcaacgagggcgccgtgagcctgctgctgagatactgcgcctag

SEQ ID NO: 12914 - DNA, 384 bp, Artificial Sequence; identical to SEQ ID NO: 9944
  Description of Artificial Sequence: Synthetic coding sequence

SEQ ID NO: 12915 - DNA, 426 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagaccttcgtgctggcccccgagggcagcgtgcccaacaagttctacgtgcacaacgacatgttcagatacgaggacgaggtgttcggcgacagctag

SEQ ID NO: 12916 - DNA, 135 bp, Artificial Sequence
  Description of Artificial Sequence: Synthetic coding sequence
atgctgctgctggactgcaaccccgaggtggacggcctgaagcacctgctggagaccggcgccagcgtgaacgccccccccgacccctgcaagcagagccccgtgcacctggccgccggcagcggcctggcctag

SEQ ID NO: 12917 - DNA, 399 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtggacatcagatag

SEQ ID NO: 12918 - DNA, 972 bp, Artificial Sequence; identical to SEQ ID NO: 11565
  Description of Artificial Sequence: Synthetic coding sequence

SEQ ID NO: 12919 - DNA, 312 bp, Artificial Sequence
  Description of Artificial Sequence: Synthetic coding sequence
atggcccagaccgacaagcccacctgcatcccccccgagctgcccaagatgctgaaggagttcgccaaggccgccatcagagcccagccccaggacctgatccagtggggcgccgactacttcgaggccctgagcagaggcgagaccccccccgtgagagagagaagcgagagagtggccctgtgcaactgggccgagctgacccccgagctgctgaagatcctgcacagccaggtggccggcagactgatcatcagagccgaggagctggcccagatgtggaaggtggtgaacctgcccaccgacctgtag

SEQ ID NO: 12920 - DNA, 540 bp, Artificial Sequence
  Description of Artificial Sequence: Synthetic coding sequence
atggaggacggcacccccaagcacatcatccagatgaccggcttcaagatggaggagaaggaggccctggtgaagctgctgctgaagctggactgcaccttcatcaagagcgagaagtacaagaactgcacccacctgatcgccgagagactgtgcaagagcgagaagttcctggccgcctgcgccgccggcaagtggatcctgaccaaggactacatcatccacagcgccaagagcggcagatggctggacgagaccacctacgagtggggctacaagatcgagaaggacagcagatacagcccccagatgcagagcgcccccaagagatggagagaggagctgaagagaaccggcgcccccggcgccttccacagatggaaggtggtgctgctggtgagaaccgacaagagaagcgacagcctgatcagaaagaagttcagaatgatgaagatccccaagcccatcctgttcggcctgaacatcgccatgaagaagcagaccaagatcagcggcaagatgcaggacttcctgaagtag

SEQ ID NO: 12921 - DNA, 453 bp, Artificial Sequence
  Description of Artificial Sequence: Synthetic coding sequence
atggaggccgacatcatcaccaacctgagatgcagactgaaggaggccgaggaggagagactgaaggccgcccagtacggcctgcagctggtggagagccagaacgagctgcagaaccagctggacaagtgcagaaacgagatgatgaccatgaccgagagctacgagcaggagaagtacaccctgcagagagaggtggagctgaagagcagaatgctggagagcctgagctgcgagtgcgaggccatcaagcagcagcagaagatgcacctggagaagctggaggagcagctgagcagaagccacggccaggaggtgaacgagctgaagaccaagatcgagaagctgaaggtggagctggacgaggccagactgagcgagaagcagctgaagcaccaggtggaccaccagaaggagctgctgagctgcaagagcgaggagctgagagtgtag

SEQ ID NO: 12922 - DNA, 738 bp, Artificial Sequence; identical to SEQ ID NO: 9467
  Description of Artificial Sequence: Synthetic coding sequence

SEQ ID NO: 12923 - DNA, 180 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaactag

SEQ ID NO: 12924 - DNA, 597 bp, Artificial Sequence; identical to SEQ ID NO: 12913
  Description of Artificial Sequence: Synthetic coding sequence

SEQ ID NO: 12925 - DNA, 465 bp, Artificial Sequence
  Description of Artificial Sequence: Synthetic coding sequence
atggccagcgccagcgccagaggcaaccaggacaaggacgcccacttccccccccccagcaagcagagcctgctgttctgccccaagagcaagctgcacatccacagagccgagatcagcaagatcatgagagagtgccaggaggagagcttctggaagagagccctgcccttcagcctggtgagcatgctggtgacccagggcctggtgtaccagggctacctggccgccaacagcagattcggcagcctgcccaaggtggccctggccggcctgctgggcttcggcctgggcaaggtgagctacatcggcgtgtgccagagcaagttccacttcttcgaggaccagctgagaggcgccggcttcggcccccagcacaacagacactgcctgctgacctgcgaggagtgcaagatcaagcacggcctgagcgagaagggcgacagccagcccagcgccagctag

SEQ ID NO: 12926 - DNA, 2520 bp, Artificial Sequence; identical to SEQ ID NO: 9680
  Description of Artificial Sequence: Synthetic coding sequence

SEQ ID NO: 12927 - DNA, 54 bp, Artificial Sequence
  Description of Artificial Sequence: Synthetic coding sequence
atggacgagggcatggagatcagcagcgagggcaacagcctgatcaaggcctag

SEQ ID NO: 12928 - DNA, 2394 bp, Artificial Sequence
  Description of Artificial Sequence: Synthetic coding sequence
atgggcgtgagcagactgatggacctgctggccgacagcagagaggtgatcagaaacgacggcgtgctgctgctgcaggccctgaccagaagcaacggcgccatccagaagatcgtggccttcgagaacgccttcgagagactgctggacatcatcagcgaggagggcaacagcgacggcggcatcgtggtggaggactgcctgatcctgctgcagaacctgctgaagaacaacaacagcaaccagaacttcttcaaggagggcagctacatccagagaatgaagccctggttcgaggtgggcgacgagaacagcggctggagcgcccagaaggtgaccaacctgcacctgatgctgcagctggtgagagtgctggtgagccccaccaacccccccggcgccaccagcagctgccagaaggccatgttccagtgcggcctgctgcagcagctgtgcaccatcctgatggccaccggcgtgcccgccgacatcctgaccgagaccatcaacaccgtgagcgaggtgatcagaggctgccaggtgaaccaggactacttcgccagcgtgaacgcccccagcaacccccccagacccgccatcgtggtgctgctgatgagcatggtgaacgagagacagcccttcgtgctgagatgcgccgtgctgtactgcttccagtgcttcctgtacaagaaccagaagggccagggcgagatcgtgagcaccctgctgcccagcaccatcgacgccaccggcaacagcgtgagcgccggccagctgctgtgcggcggcctgttcagcaccgacagcctgagcaactggtgcgccgccgtggccctggcccacgccctgcaggagaacgccacccagaaggagcagctgctgagagtgcagctggccaccagcatcggcaacccccccgtgagcctgctgcagcagtgcaccaacatcctgagccagggcagcaagatccagaccagagtgggcctgctgatgctgctgtgcacctggctgagcaactgccccatcgccgtgacccacttcctgcacaacagcgccaacgtgcccttcctgaccggccagatcgccgagaacctgggcgaggaggagcagctggtgcagggcctgtgcgccctgctgctgggcatcagcatctacttcaacgacaacagcctggagagctacatgaaggagaagctgaagcagctgatcgagaagagaatcggcaaggagaacttcatcgagaagctgggcttcatcagcaagcacgagctgtacagcagagccagccagaagccccagcccaacttccccagccccgagtacatgatcttcgaccacgagttcaccaagctggtgaaggagctggagggcgtgatcaccaaggccatctacaagagcagcgaggaggacaagaaggaggaggaggtgaagaagaccctggagcagcacgacaacatcgtgacccactacaagaacatgatcagagagcaggacctgcagctggaggagctgagacagcaggtgagcaccctgaagtgccagaacgagcagctgcagaccgccgtgacccagcaggtgagccagatccagcagcacaaggaccagtacaacctgctgaagatccagctgggcaaggacaaccagcaccagggcagctacagcgagggcgcccagatgaacggcatccagcccgaggagatcggcagactgagagaggagatcgaggagctgaagagaaaccaggagctgctgcagagccagctgaccgagaaggacagcatgatcgagaacatgaagagcagccagaccagcggcaccaacgagcagagcagcgccatcgtgagcgccagagacagcgagcaggtggccgagctgaagcaggagctggccaccctgaagagccagctgaacagccagagcgtggagatcaccaagctgcagaccgagaagcaggagctgctgcagaagaccgaggccttcgccaagagcgtggaggtgcagggcgagaccgagaccatcatcgccaccaagaccaccgacgtggagggcagactgagcgccctgctgcaggagaccaaggagctgaagaacgagatcaaggccctgagcgaggagagaaccgccatcaaggagcagctggacagcagcaacagcaccatcgccatcctgcagaccgagaaggacaagctggagctggagatcaccgacagcaagaaggagcaggacgacctgctggtgctgctggccgaccaggaccagaagatcctgagcctgaagaacaagctgaaggacctgggccaccccgtggaggaggaggacgagctggagagcggcgaccaggaggacgaggacgacgagagcgaggaccccggcaaggacctggaccacatctag

SEQ ID NO: 12929 - DNA, 441 bp, Artificial Sequence
  Description of Artificial Sequence: Synthetic coding sequence
tgaagacacctgagagccacccccaacaccagaggcagcgccagactgctgtgcgccgagatgcccaagaaggccggcgccaccaccaagggcaagagccagagcaaggagcccgagagacccctgccccccctgggccccgtggccgtggaccccaagggctgcgtgaccatcgccatccacgccaagcccggcagcaagcagaacgccgtgaccgacctgaccgccgaggccgtgaacgtggccatcgccgccccccccagcgagggcgaggccaacgccgagctgtgcagatacctgagcaaggtgctggagctgagaaagagcgacgtggtgctggacaagaagctgagagacctgctgaagatcgtgccctgcaagctggccaccagaacccagatcctgggcctgctggtggagtgcagcttcagcagactgtag

SEQ ID NO: 12930 - DNA, 243 bp, Artificial Sequence
  Description of Artificial Sequence: Synthetic coding sequence
atgaacggcagagccgacttcagagagcccaacgccgaggtgcccagacccatcccccacatcggccccgactacatccccaccgaggaggagagaagagtgttcgccgagtgcaacgacgagagcttctggttcagaagcgtgcccctggccgccaccagcatgctgatcacccagggcctgatcagcaagggcatcctgagcagccaccccaagtacggcagcatccccaagctgatctag

SEQ ID NO: 12931 - DNA, 360 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagctag

SEQ ID NO: 12932 - DNA, 69 bp, Artificial Sequence
  Description of Artificial Sequence: Synthetic coding sequence
atggccaagtacaacaccggcggcaaccccaccgaggacgtgagcgtgaacagcagacccttcagatag

SEQ ID NO: 12933 - DNA, 1059 bp, Artificial Sequence
  Description of Artificial Sequence: Synthetic coding sequence
atggccgccgccgtgagacaggacctggcccagctgatgaacagcagcggcagccacaaggacctggccggcaagtacagacagatcctggagaaggccatccagctgagcggcgccgagcagctggaggccctgaaggccttcgtggaggccatggtgaacgagaacgtgagcctggtgatcagcagacagctgctgaccgacttctgcacccacctgcccaacctgcccgacagcaccgccaaggagatctaccacttcaccctggagaagatccagcccagagtgatcagcttcgaggagcaggtggccagcatcagacagcacctggccagcatctacgagaaggaggaggactggagaaacgccgcccaggtgctggtgggcatccccctggagaccggccagaagcagtacaacgtggactacaagctggagacctacctgaagatcgccagactgtacctggaggacgacgaccccgtgcaggccgaggcctacatcaacagagccagcctgctgcagaacgagagcaccaacgagcagctgcagatccactacaaggtgtgctacgccagagtgctggactacagaagaaagttcatcgaggccgcccagagatacaacgagctgagctacaagaccatcgtgcacgagagcgagagactggaggccctgaagcacgccctgcactgcaccatcctggccagcgccggccagcagagaagcagaatgctggccaccctgttcaaggacgagagatgccagcagctggccgcctacggcatcctggagaagatgtacctggacagaatcatcagaggcaaccagctgcaggagttcgccgccatgctgatgccccaccagaaggccaccaccgccgacggcagcagcatcctggacagagccgtgatcgagcacaacctgctgagcgccagcaagctgtacaacaacatcaccttcgaggagctgggcgccctgctggagatccccgccgccaagcacgagaagccctgccagagaggcatcagcagaagcaaccacttcgtgagcaagtag

SEQ ID NO: 12934 - DNA, 378 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagaccttcgtgctggcccccgagggcagcgtgcccaacaagttctactag

SEQ ID NO: 12935 - DNA, 657 bp, Artificial Sequence
  Description of Artificial Sequence: Synthetic coding sequence
atgaacggcagagccgacttcagagagcccaacgccgaggtgcccagacccatcccccccgtgcccctggccgccaccagcatgctgatcacccagggcctgatcagcaagggcatcctgagcagccaccccaagtacggcagcatccccaagctgatcctggcctgcatcatgggctacttcgccggcaagctgagctacgtgaagacctgccaggagaagttcaagaagctggagaacagccccctgggcgaggccctgagaagcggccaggccagaagaagcagcccccccggccactactaccagaagagcaagtacgacagcagcgtgagcggccagagcagcttcgtgaccagccccgccgccgacaacatcgagatgctgccccactacgagcccatccccttcagcagcagcatgaacgagagcgcccccaccggcatcaccgaccacatcgtgcagggccccgaccccaacctggaggagagccccaagagaaagaacatcacctacgaggagctgagaaacaagaacagagagagctacgaggtgagcctgacccagaagaccgaccccagcgtgagacccatgcacgagagagtgcccaagaaggaggtgaaggtgaacaagtacggcgacacctgggacgagtag

SEQ ID NO: 12936 - DNA, 243 bp, Artificial Sequence; identical to SEQ ID NO: 12930
  Description of Artificial Sequence: Synthetic coding sequence

SEQ ID NO: 12937 - DNA, 654 bp, Artificial Sequence
  Description of Artificial Sequence: Synthetic coding sequence
atgatcgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgcccttccagcaccacggctacagcggccccaacgagagaaccaccttctggcacggcagcaacgagggcgccgtgagcctgctgctgagatactgcgcctag

SEQ ID NO: 12938 - DNA, 351 bp, Artificial Sequence
  Description of Artificial Sequence: Synthetic coding sequence
atgggcagactggacggcaaggtgatcatcctgaccgccgccgcccagggcatcggccaggccgccgccctggccttcgccagagagggcgccaaggtgatcgccaccgacatcaacgagagcaagctgcaggagctggagaagtaccccggcatccagaccagagtgctggacgtgaccaagaagaagcagatcgaccagttcgccaacgaggtggagagactggacgtgctgttcaacgtggccggcttcgtgcaccacggcaccgtgctggactgcgaggagaaggactgggacttcagcatgaacctgaacgtgagaagcatgtacctgatgatcaaggccttctag

SEQ ID NO: 12939 - DNA, 504 bp, Artificial Sequence
  Description of Artificial Sequence: Synthetic coding sequence
atgaaggccatcaagaagagcctgaccgaggaggagtacctgtacctggacttcagccaccagaccgagggctgcatcttccccctgcacaccagcgtgaccctgttcctgctgagctactgcgactgcaagatcttcaagatctgcctggtggtgaccaaggaggtgagcagagacagcagcctgctgagagacgacctgatccaggacgtggagatccagatcatcagcagacaggagctgccccccatcgtgcagaactgctgcctgcccgccgtggtggagagaagcgacaacttctgcagagccggcctggccgtggtgctgagacacatcatccagaagagctacgaggccgaccccctgaagaaggagctgctggagctgctgggcttcaagaagacctgcctgaaggcctgcgccgaggtgagccagtggaccagactgtgcgagctgaccatccccctggccatcgagaacttcctgagagagagcagcgactag

SEQ ID NO: 12940 - DNA, 933 bp, Artificial Sequence; identical to SEQ ID NO: 10011
  Description of Artificial Sequence: Synthetic coding sequence

SEQ ID NO: 12941 - DNA, 237 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagatag

SEQ ID NO: 12942 - DNA, 681 bp, Artificial Sequence; identical to SEQ ID NO: 10935
  Description of Artificial Sequence: Synthetic coding sequence

SEQ ID NO: 12943 - DNA, 1020 bp, Artificial Sequence; identical to SEQ ID NO: 10066
  Description of Artificial Sequence: Synthetic coding sequence

SEQ ID NO: 12944 - DNA, 1179 bp, Artificial Sequence; identical to SEQ ID NO: 11426
  Description of Artificial Sequence: Synthetic coding sequence

SEQ ID NO: 12945 - DNA, 654 bp, Artificial Sequence; identical to SEQ ID NO: 12937
  Description of Artificial Sequence: Synthetic coding sequence

SEQ ID NO: 12946 - DNA, 438 bp, Artificial Sequence; identical to SEQ ID NO: 11428
  Description of Artificial Sequence: Synthetic coding sequence

SEQ ID NO: 12947 - DNA, 207 bp, Artificial Sequence; identical to SEQ ID NO: 12910
  Description of Artificial Sequence: Synthetic coding sequence

SEQ ID NO: 12948 - DNA, 525 bp, Artificial Sequence
  Description of Artificial Sequence: Synthetic coding sequence
atggccaagtacaacaccggcggcaaccccaccgaggacgtgagcgtgaacagcagacccttcagagtgaccggccccaacagcagcagcggcatccaggccagaaagaacctgttcaacaaccagggcaacgccagcccccccgccggccccagcaacgtgcccaagttcggcagccccaagccccccgtggccgtgaagcccagcagcgaggagaagcccgacaaggagcccaagccccccttcctgaagcccaccggcgccggccagagattcggcacccccgccagcctgaccaccagagaccccgaggccaaggtgggcttcctgaagcccgtgggccccaagcccatcaacctgcccaaggaggacagcaagcccaccttcccctggccccccggcaacaagcccagcctgcacagcgtgaaccaggaccacgacctgaagcccctgggccccaagagcggccccaccccccccaccagcgagaacgagcagaagcaggccttccccaagctgacctag

SEQ ID NO: 12949 - DNA, 405 bp, Artificial Sequence
  Description of Artificial Sequence: Synthetic coding sequence
atgagcgacgacgccggcgacaccctggccaccggcgacaaggccgaggtgaccgagatgcccaacagcgacagcctgcccgaggacgccgaggtgcactgcgacagcgccgccgtgagccacgagcccacccccgccgaccccagaggcgagggccacgagaacgccgccgtgcagggcgccggcgccgccgccatcggcccccccgtgcagccccaggacgccaacgccctggagccccccctgaacggcgacgtgaccgaggacaccctggccgagtgcatcgacagcgtgagcctggaggccgagcccagaagcgagatccccctgcaggagcagaactacctggccgtggacagcccccccagcggcggcggctgggccggctggggcagctggggctag

SEQ ID NO: 12950 - DNA, 432 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtggacatcagaaccctggccgacagcgtgtgcagatacgacctgtag

SEQ ID NO: 12951 - DNA, 1200 bp, Artificial Sequence; identical to SEQ ID NO: 11147
  Description of Artificial Sequence: Synthetic coding sequence

SEQ ID NO: 12952 - DNA, 240 bp, Artificial Sequence
  Description of Artificial Sequence: Synthetic coding sequence
atggacgagagcgccctgctggacctgctggagtgccccgtgtgcctggagagactggacgccagcgccaaggtgctgccctgccagcacaccttctgcaagagatgcctgctgggcatcgtgggcagcagaaacgagctgagatgccccgagtgcagaaccctggtgggcagcggcgtggaggagctgcccagcaacatcctgctggtgagactgctggacggcatcaagcagagatag

SEQ ID NO: 12953 - DNA, 621 bp, Artificial Sequence; identical to SEQ ID NO: 11427
  Description of Artificial Sequence: Synthetic coding sequence

SEQ ID NO: 12954 - DNA, 501 bp, Artificial Sequence
  Description of Artificial Sequence: Synthetic coding sequence
atgaaggccatcaagaagagcctgaccgaggaggagtacctgtacctggacttcagccaccagaccgagggctgcatcttccccctgcacaccagcgtgaccctgttcctgctgagctactgcgactgcaagatcttcaagatctgcctggtggtgaccaaggaggtgagcagagacagcagcctgctgagagacgacctgatccaggacgtggagatccagatcatcagcagacaggagctgccccccatcgtgcagaactgctgcctgcccgccgtggtggagagaagcgacaacttctgcagagccggcctggccgtggtgctgagacacatcatccagaagagctacgaggccgaccccctgaagaaggagctgctggagctgctgggcttcaagaagacctgcctgaaggcctgcgccgaggtgagccagtggaccagactgtgcgagctgaccatccccctggccatcgagaacttcctgagagagagcagctag

SEQ ID NO: 12955 - DNA, 363 bp, Artificial Sequence; identical to SEQ ID NO: 12890
  Description of Artificial Sequence: Synthetic coding sequence

SEQ ID NO: 12956 - DNA, 351 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagaccttcgtgctggccccctag

SEQ ID NO: 12957 - DNA, 480 bp, Artificial Sequence
  Description of Artificial Sequence: Synthetic coding sequence
atgagcgaccacagatacggcgacggcggcagcaccttccagagcaccaccggccactgcgtgcacatgagaggcctgccctacagagccaccgagaacgacatctacaacttcttcagccccctgaaccccgtgagagtgcacatcgagatcggccccgacggcagagtgaccggcgaggccgacgtggagttcgccacccacgaggacgccgtggccgccatgagcaaggacaaggccaacatgcagcacagatacgtggagctgttcctgaacagcaccgccggcgccagcggcggcgcctacggcagccagatgctgggcggcatgggcctgagcaaccagagcagctacggcggccccgccagccagcagctgagcggcggctacggcggcggctacggcggccagagcagcatgagcggctacgaccaggtgctgcaggagaacagcagcgacttccagagcaacatcgcctag

SEQ ID NO: 12958 - DNA, 411 bp, Artificial Sequence; identical to SEQ ID NO: 12873
  Description of Artificial Sequence: Synthetic coding sequence

SEQ ID NO: 12959 - DNA, 462 bp, Artificial Sequence
  Description of Artificial Sequence: Synthetic coding sequence
atgaagctgaccagcgagaagctgcccaagaaccccttctacgccagcgtgagccagtacgccgccaagaaccagaagttcttccagtggaagaaggagaagaccgactacacccacgccaacctggtggacaaggccctgcagctgctgaaggagagaatcctgaagggcgacaccctggcctacttcctgagaggccagctgtacttcgaggagggctggtacgaggaggccctggagcagttcgaggagatcaaggagaaggaccaccaggccacctaccagctgggcgtgatgtactacgacggcctgggcaccaccctggacgccgagaagggcgtggactacatgaagaagatcctggacagcccctgccccaaggccagacacctgaagttcgccgccgcctacaacctgggcagagcctactacgagggcaagggcgtgaagagaagcaactag

SEQ ID NO: 12960 - DNA, 489 bp, Artificial Sequence
  Description of Artificial Sequence: Synthetic coding sequence
atggaggccctgctggagggcatccagaacagaggccacggcggcggcttcctgaccagctgcgaggccgagctgcaggagctgatgaagcagatcgacatcatggtggcccacaagaagagcgagtgggagggcagaacccacgccctggagacctgcctgaagatcagagagcaggagctgaagagcctgagaagccagctggacgtgacccacaaggaggtgggcatgctgcaccagcaggtggaggagcacgagaagatcaagcaggagatgaccatggagtacaagcaggagctgaagaagctgcacgaggagctgtgcatcctgaagagaagctacgagaagctgcagaagaagcagatgagagagttcagaggcaacaccaagaaccacagagaggacagaagcgagatcgagagactgaccgccaagatcgaggagttcagacagaagagcctggactgggagaagcagagactgatctag

SEQ ID NO: 12961 - DNA, 1530 bp, Artificial Sequence; identical to SEQ ID NO: 11778
  Description of Artificial Sequence: Synthetic coding sequence

SEQ ID NO: 12962 - DNA, 90 bp, Artificial Sequence
  Description of Artificial Sequence: Synthetic coding sequence
atgaacggcagagccgacttcagagagcccaacgccgaggtgcccagacccatcccccacatcggccccgactacatccccaccgagtag

SEQ ID NO: 12963 - DNA, 1236 bp, Artificial Sequence
  Description of Artificial Sequence: Synthetic coding sequence
atgatcgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgccctacgacagcaccagagtgcccctgggcaagagcaaggactacatcaacgccagctacatcagaatcgtgaactgcggcgaggagtacttctacatcgccacccagggccccctgctgagcaccatcgacgacttctggcagatggtgctggagaacaacagcaacgtgatcgccatgatcaccagagagatcgagggcggcatcatcaagtgctaccactactggcccatcagcctgaagaagcccctggagctgaagcacttcagagtgttcctggagaactaccagatcctgcagtacttcatcatcagaatgttccaggtggtggagaagagcaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 12964 - DNA, 300 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagctag

SEQ ID NO: 12965 - DNA, 705 bp, Artificial Sequence
  Description of Artificial Sequence: Synthetic coding sequence
atggccagcagcgccaagagcgccgagatgcccaccatcagcaagaccgtgaaccccacccccgacccccaccaggagtacctggaccccagaatcaccatcgccctgttcgagatcggcagccacagccccagcagctggggcagcctgcccttcctgaagaacagcagccaccaggtgaccgagcagcagaccgcccagaagttcaacaacctgctgaaggagatcaaggacatcctgaagaacatggccggcttcgaggagaagatcaccgaggccaaggagctgttcgaggagaccaacatcaccgaggacgtgagcgcccacaaggagaacatcagaggcctggacaagatcaacgagatgctgagcaccaacctgcccgtgagcctggcccccgagaaggaggacaacgagaagaagcaggagatgatcctggagaccaacatcaccgaggacgtgagcgcccacaaggagaacatcagaggcctggacaagatcaacgagatgctgagcaccaacctgcccgtgagcctggcccccgagaaggaggacaacgagaagaagcagcagatgatcatggagaaccagaacagcgagaacaccgcccaggtgttcgccagagacctggtgaacagactggaggagaagaaggtgctgaacgagacccagcagagccaggagaaggccaagaacagactgtag

SEQ ID NO: 12966 - DNA, 1095 bp, Artificial Sequence
  Description of Artificial Sequence: Synthetic coding sequence
atgtacttctgctggggcgccgacagcagagagctgcagagaagaagaaccgccggcagccccggcgccgagctgctgcaggccgccagcggcgagagacacagcctgctgctgctgaccaaccacagagtgctgagctgcggcgacaacagcagaggccagctgggcagaagaggcgcccagagaggcgagctgcccgagcccatccaggccctggagaccctgatcgtggacctggtgagctgcggcaaggagcacagcctggccgtgtgccacaagggcagagtgttcgcctggggcgccggcagcgagggccagctgggcatcggcgagttcaaggagatcagcttcacccccaagaagatcatgaccctgaacgacatcaagatcatccaggtgagctgcggccactaccacagcctggccctgagcaaggacagccaggtgttcagctggggcaagaacagccacggccagctgggcctgggcaaggagttccccagccaggccagcccccagagagtgagaagcctggagggcatccccctggcccaggtggccgccggcggcgcccacagcttcgccctgagcctgtgcggcaccagcttcggctggggcagcaacagcgccggccagctggccctgagcggcagaaacgtgcccgtgcagagcaacaagcccctgagcgtgggcgccctgaagaacctgggcgtggtgtacatcagctgcggcgacgcccacaccgccgtgctgacccaggacggcaaggtgttcaccttcggcgacaacagaagcggccagctgggctacagccccacccccgagaagagaggcccccagctggtggagagaatcgacggcctggtgagccagatcgactgcggcagctaccacaccctggcctacgtgcacaccaccggccaggtggtgagcttcggccacggccccagcgacaccagcaagcccacccaccccgaggccctgaccgagaacttcgacatcagctgcctgatcagcgccgaggacttcgtggacgtgcaggtgaagcacatcttcgccggcacctacgccaacttcgtgaccacccaccagtag

SEQ ID NO: 12967 - DNA, 348 bp, Artificial Sequence
  Description of Artificial Sequence: Synthetic coding sequence
atggccaagtacaacaccggcggcaaccccaccgaggacgtgagcgtgaacagcagacccttcagagtgaccggccccaacagcagcagcggcatccaggccagaaagaacctgttcaacaaccagggcaacgccagcccccccgccggccccagcaacgtgcccaagttcggcagccccaagccccccgtggccgtgaagcccagcagcgaggagaagcccgacaaggagcccaagccccccttcctgaagcccaccggcgccggccagagattcggcacccccgccagcctgaccaccagagaccccgaggccaaggtgggcttcctgaagcccgtgggcccctag

SEQ ID NO: 12968 - DNA, 486 bp, Artificial Sequence
  Description of Artificial Sequence: Synthetic coding sequence
atggccggcatcctgagactggtggtgcagtggccccccggcagactgcagaccgtgaccaagggcgtggagagcctgatctgcaccgactggatcagacacaagttcaccagaagcagaatccccgagaaggtgttccaggccagccccgaggaccacgagaagtacggcggcgacccccagaacccccacaagctgcacatcgtgaccagaatcaagagcaccagaagaagaccctactgggagaaggacatcatcaagatgctgggcctggagaaggcccacaccccccaggtgcacaagaacatccccagcgtgaacgccaagctgaaggtggtgaagcacctgatcagaatcaagcccctgaagctgccccagggcctgcccgccgaggagaacatgagcaacacctgcctgaagagcaccggcgagctggtggtgcagtggcacctgaagcccgtggagcagaaggcccacgagagctag

SEQ ID NO: 12969 - DNA, 516 bp, Artificial Sequence
  Description of Artificial Sequence: Synthetic coding sequence
atgaacggcagagccgacttcagagagcccaacgccgaggtgcccagacccatcccccacatcggccccgactacatccccaccgaggaggagagaagagtgttcgccgagtgcaacgacgagagcttctggttcagaagcgtgcccctggccgccaccagcatgctgatcacccagggcctgatcagcaagggcatcctgagcagccaccccaagtacggcagcatccccaagctgatcctggcctgcatcatgggctacttcgccggcaagctgagctacgtgaagacctgccaggagaagttcaagaagctggagaacagccccctgggcgaggccctgagaagcggccaggccagaagaagcagcccccccggccactactaccagaagagcaagtacgacagcagcgtgagcggccagagcagcttcgtgaccagccccgccgccgacaacatcgagatgctgccccactacgagcccatccccttcagcagcagcatgaacgagagctag

SEQ ID NO: 12970 - DNA, 438 bp, Artificial Sequence; identical to SEQ ID NO: 12853
  Description of Artificial Sequence: Synthetic coding sequence

SEQ ID NO: 12971 - DNA, 243 bp, Artificial Sequence
  Description of Artificial Sequence: Synthetic coding sequence
atggtgaccagcctgaacgaggacaacgagagcgtgaccgtggagtggatcgagaacggcgacaccaagggcaaggagatcgacctggagagcatcttcagcctgaaccccgacctggtgcccgacgaggagatcgagcccagccccgagaccccccccccccccgccagcagcgccaaggtgaacaagatcgtgaagaacagaagaaccgtggccagcatcaagaacgacccccccagctag

SEQ ID NO: 12972 - DNA, 123 bp, Artificial Sequence
  Description of Artificial Sequence: Synthetic coding sequence
atgaaggccatcaagaagagcctgaccgaggaggagtacctgtacctggacttcagccaccagaccgagggctgcatcttccccctgcacaccagcgtgaccctgttcctgctgagctactag

SEQ ID NO: 12973 - DNA, 192 bp, Artificial Sequence
  Description of Artificial Sequence: Synthetic coding sequence
atggaggccctgctggagggcatccagaacagaggccacggcggcggcttcctgaccagctgcgaggccgagctgcaggagctgatgaagcagatcgacatcatggtggcccacaagaagagcgagtgggagggcagaacccacgccctggagacctgcctgaagatcagagagcaggagctgaagagctag

SEQ ID NO: 12974 - DNA, 594 bp, Artificial Sequence
  Description of Artificial Sequence: Synthetic coding sequence
atgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatgaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 12975 - DNA, 2529 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtggacatcagaaccctggccgacagcgtgtgcagatacgacctgaacgacatggacgccgcctggctggagctgaccaacgaggagttcaaggagatgggcatgcccgagctggacgagtacaccatggagagagtgctggaggagttcgagcagagatgctacgacaacatgaaccacgccatcgagaccgaggagggcctgggcatcgagtacgacgaggacgtggtgtgcgacgtgtgccagagccccgacggcgaggacggcaacgagatggtgttctgcgacaagtgcaacatctgcgtgcaccaggcctgctacggcatcctgaaggtgcccgagggcagctggctgtgcagaacctgcgccctgggcgtgcagcccaagtgcctgctgtgccccaagaagggcggcgccatgaagcccaccagaagcggcaccaagtgggtgcacgtgagctgcgccctgtggatccccgaggtgagcatcggcagccccgagaagatggagcccatcaccaaggtgagccacatccccagcagcagatgggccctggtgtgcagcctgtgcaacgagaagttcggcgccagcatccagtgcagcgtgaagaactgcagaaccgccttccacgtgacctgcgccttcgacagaggcctggagatgaagaccatcctggccgagaacgacgaggtgaagttcaagagctactgccccaagcacagcagccacagaaagcccgaggagagcctgggcaagggcgccgcccaggagaacggcgcccccgagtgcagccccagaaaccccctggagcccttcgccagcctggagcagaacagagaggaggcccacagagtgagcgtgagaaagcagaagctgcagcagctggaggacgagttctacaccttcgtgaacctgctggacgtggccagagccctgagactgcccgaggaggtggtggacttcctgtaccagtactggaagctgaagagaaaggtgaacttcaacaagcccctgatcacccccaagaaggacgaggaggacaacctggccaagagagagcaggacgtgctgttcagaagactgcagctgttcacccacctgagacaggacctggagagagtgagaaacctgacctacatggtgaccagaagagagaagatcaagagaagcgtgtgcaaggtgcaggagcagatcttcaacctgtacaccaagctgctggagcaggagagagtgagcggcgtgcccagcagctgcagcagcagcagcctggagaacatgctgctgttcaacagccccagcgtgggccccgacgcccccaagatcgaggacctgaagtggcacagcgccttcttcagaaagcagatgggcaccagcctggtgcacagcctgaagaagccccacaagagagaccccctgcagaacagccccggcagcgagggcaagaccctgctgaagcagcccgacctgtgcggcagaagagagggcatggtggtgcccgagagcttcctgggcctggagaagaccttcgccgaggccagactgatcagcgcccagcagaagaacggcgtggtgatgcccgaccacggcaagagaagagacaacagattccactgcgacctgatcaagggcgacctgaaggacaagagcttcaagcagagccacaagcccctgagaagcaccgacgtgagccagagacacctggacaacaccagagccgccaccagccccggcgtgggccagagcgcccccggcaccagaaaggagatcgtgcccaagtgcaacggcagcctgatcaaggtgaactacaaccagaccgccgtgaaggtgcccaccacccccgccagccccgtgaagaactggggcggcttcagaatccccaagaagggcgagagacagcagcagggcgaggcccacgacggcgcctgccaccagcacagcgactacccctacctgggcctgggcagagtgcccgccaaggagagagccaagagcaagctgaagagcgacaacgagaacgacggctacgtgcccgacgtggagatgagcgacagcgagagcgaggccagcgagaagaagtgcatccacaccagcagcaccatcagcagaagaaccgacatcatcagaagaagcatcctggccagctag

SEQ ID NO: 12976 - DNA, 2490 bp, Artificial Sequence; identical to SEQ ID NO: 12891
  Description of Artificial Sequence: Synthetic coding sequence

SEQ ID NO: 12977 - DNA, 810 bp, Artificial Sequence
  Description of Artificial Sequence: Synthetic coding sequence
atgatcgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatgaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 12978 - DNA, 492 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagagagggcagacccagcggcgaggccttcgtggagctggagagcgaggacgaggtgaagctggccctgaagaaggacagagagaccatgggccacagatacgtggaggtgttcaagagcaacaacgtggagatggactgggtgctgaagcacaccggccccaacagccccgacaccgccaacgacggcttcgtgagactgagaggcctgcccttcggctgcagcaaggaggagatcgtgcagttcttcagcggcctggagatcgtgcccaacggcatcaccctgcccgtggacttccagggcagaagcaccggcgaggccttcgtgcagttcgccagccaggagtag

SEQ ID NO: 12979 - DNA, 759 bp, Artificial Sequence
  Description of Artificial Sequence: Synthetic coding sequence
atggccgccaccgccagagaggacggcgccagcggccaggagagaggccagagaggctgcgagcactacgacagaggctgcctgctgaaggccccctgctgcgacaagctgtacacctgcagactgtgccacgacaacaacgaggaccaccagctggacagattcaaggtgaaggaggtgcagtgcatcaactgcgagaagatccagcacgcccagcagacctgcgaggagtgcagcaccctgttcggcgagtactactgcgacatctgccacctgttcgacaaggacaagaagcagtaccactgcgagaactgcggcatctgcagaatcggccccaaggaggacttcttccactgcctgaagtgcaacctgtgcctggccatgaacctgcagggcagacacaagtgcatcgagaacgtgagcagacagaactgccccatctgcctggaggacatccacaccagcagagtggtggcccacgtgctgccctgcggccacctgctgcacagaggctacagatgccccctgtgcatgcacagcgccctggacatgaccagatactggagacagctggacgacgaggtggcccagacccccatgcccagcgagtaccagaacatgaccgtggacatcctgtgcaacgactgcaacggcagaagcaccgtgcagttccacatcctgggcatgaagtgcaagatctgcgagagctacaacaccgcccaggccggcggcagaagaatcagcctggaccagcagtag

SEQ ID NO: 12980 - DNA, 594 bp, Artificial Sequence; identical to SEQ ID NO: 12974
  Description of Artificial Sequence: Synthetic coding sequence

SEQ ID NO: 12981 - DNA, 4203 bp, Artificial Sequence
  Description of Artificial Sequence: Synthetic coding sequence
tgacccccccccccccccccccccatgtggaaccccatgatccccgccttcgacctgttccagggcaaccacggcttcgtggcccccgtggtgaccaccgccgcccactggagaagcgtgaactacaccttcccccccagcgtgatcagccacaccagccccaccaaggtgtggagaaacaaggacggcaccagcgcctaccaggtgcaggagacccccgtgagccaggtggtgagaaagaagaccagctacgtgggcctggtgctggtgctgctgagaggcctgcccggcagcggcaagagcttcctggccagaaccctgcaggaggacaaccccagcggcgtgatcctgagcaccgacgactacttctacatcaacggccagtaccagttcgacgtgaagtacctgggcgaggcccacgagtggaaccagaacagagccaaggaggccttcgagaagaagatcagccccatcatcatcgacaacaccaacctgcaggcctgggagatgaagccctacgtggccctgagccagaagcacaagtacaaggtgctgttcagagagcccgacacctggtggaagttcaagcccaaggagctggccagaagaaacatccacggcgtgagcaaggagaagatcaccagaatgctggagcactaccagagattcgtgagcgtgcccatcatcatgagcagcagcgtgcccgagaagatcgagagaatcgagctgtgcgcctacagctgcgaggacagaagcaccagccccagagacgacgaggacatcatcagcgagaaggaggagaacatcctgagcctgagcctgaagcacctggagttcaccgaggagaagaacctggacgtgaccaaggagaccatgctgcccgagaacgtggcctacctgagcaacgccgacctgaacaagagaagaaaggagatcagcgacatgaaccccagcatccagagcgccctgatcctggagaccccccacatgtacttcagcgacagcgagagcaagctgcaggccaccgacaagagcgagaacgagcagatcgagatggtggccgtgaagggctacagcaagaccgacaccgacagcagcatggagagagtgagccccagcacctgctgcagcgagaacaaccaggaggactgcgacctggccaacagcggccccctgcagaacgagaagagcagccccggcgagatcgtggaggagagagccaccgtgaccaagaaggccttcggcaagcagaagagcaagagcaccctggagaagttccccagacacgagctgagcaacttcgtgggcgactggcccgtggacaagaccatcggccagagaaccaagagaaacagaaagaccgagaagaccagcagcgtgcagagcgacaagaagtacaactacccccagagccacaagctggtgaacagcgtgagcgtgaacaccgactgcgtgcagcagagaggcagcccccacgagagcgtggaggacggcagaaagagccagtgcgacgacgccagcgagcccctgaacagctacaagtacgacgcctacaagaacatcgacaagaacagcttcaacatcatgggcgactggcccagcagcgacagcctggcccagagagagcacagaagcagaatgcccaagaccggcctgagcgagcccaacctggagatcggcaccaacgacaagatgaacgagatcagcctgagcaccgcccacgaggcctgctggggcaccagcagccagaagctgaagaccctgggcagcagcaacctgggcagcagcgagatgctgctgagcgagatgacctgcgagagccagacctgcctgagcaagaagagccacggccagcacaccagcctgcccctgaccttcaccaacagcgcccccaccgtgagcggcgtggtggagccccagaccctggccgagtgccaggagcagatgcccaagagagaccccggcaaggaggtgggcatgtgcacccagaccgagccccaggacttcgccctgctgtggaagatcgagaagaacaagatcagcatcagcgacagcatcaaggtgctgaccggcagactggacggcttcaagcccaaggtgttcaacatcaacaccaagagcgacgtgcaggaggccatcccctacagagtgatgtacgacaagagcaccttcgtggaggagagcgagctgaccagcgccgacgagagcgagaacctgaacatcctgtgcaagctgttcggcagcttcagcctggaggccctgaaggacctgtacgagagatgcaacaaggacatcatctgggccaccagcctgctgctggacagcgagaccaagctgtgcgaggacaccgagttcgagaacttccagaagagctgcgacggcagccagatcggccccttcagcctgggcctgaacctgaaggagatcatcagccagagaggcaccctggagaacagcaacagccccgtgcccgagttcagccacggcatcggcatcagcaacgccgacagccagagcacctgcgacgccgagagaggcaacagcgagcaggccgagatgagagccgtgacccccgagaaccacgagagcatgaccagcatcttccccagcgccgccgtgggcctgaagaacaacaacgacatcctgcccaacagccaggaggagctgctgtacagcagcaagcagagcttccccggcatcctgaaggccaccacccccaaggacatgagcgagaccgagaagaacctggtggtgaccgagaccggcgacaacatccacagccccagccacttcagcgacatcttcaacttcgtgagcagcaccagcaacctggagctgaacgaggagatctacttcaccgacagcctggagatcaagagaaacgagaacttccccaaggactacgtgaagttcagcgacgaggaggagttcatgaacgaggacgagaaggagatgaaggagatcctgatggccggcagcagcctgagcgccggcgtgagcggcgaggacaagaccgagatcctgaaccccacccccgccatggccaagagcctgaccatcgactgcctggagctggccctgccccccgagctggccttccagctgaacgagctgttcggccccgtgggcatcgacagcggcagcctgaccgtggaggactgcgtggtgcacatcgacctgaacctggccaaggtgatccacgagaagtggaaggagagcgtgatggagagacagagacaggaggaggtgagctgcggcaagttcatgcaggaccccagcctggtgggccacaccggcctggacaaccccgagcagaagagcagccagagaaccggcaagaagctgctgaagaccctgaccgccagcgagatgctgcccctgctggaccactggaacacccagaccaagaaggtgagcctgagagagatcatgagcgaggagatcgccctgcaggagaagcacaacctgaagagagagaccctgatgttcgagaaggactgcgccaccaagctgaaggagaagcagctgttcaagatcttccccgccatcaaccagaacttcctggtggacatcttcaaggaccacaactacagcctggagcacaccgtgcagttcctgaactgcgtgctggagggcgaccccgtgaagaccgtggtggcccaggagttcgtgcaccagaacgagaacgtgaccagccacaccggccagaagagcaaggagaagaaggacttcgagtaccccgactacgacgactacagagccgaggccttcctgcaccagcagaagagaatggagtgctacagcaaggccaaggaggcctacagaatcggcaagaagaacgtggccaccttctacgcccagcagggcaccctgcacgagcagaagatgaaggaggccaaccacctggccgccatcgagatcttcgagaaggtgaacgccagcctgctgccccagaacgtgctggacctgcacggcctgcacgtggacgaggccctggagcacctgatgagagtgctggagaagaagaccgaggagttcaagcagaacggcggcaagccctacctgagcgtgatcaccggcagaggcaaccacagccagggcggcgtggccagaatcaagcccgccgtgatcaagtacctgatcagccacagcttcagattcagcgagatcaagcccggctgcctgaaggtgatgctgaagtag

SEQ ID NO: 12982 - DNA, 237 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgcggcttcatcagcgacagaagcgtgaaggaggtggcctgcggcggcaaccacagcgtgttcctgctggaggacggcgaggtgtacacctgcggcctgaacaccaagggccagctgggccacgagagagagggcaacaagcccgagcagatctag

SEQ ID NO: 12983 - DNA, 738 bp, Artificial Sequence; identical to SEQ ID NO: 9467
  Description of Artificial Sequence: Synthetic coding sequence

SEQ ID NO: 12984 - DNA, 2112 bp, Artificial Sequence; identical to SEQ ID NO: 10172
  Description of Artificial Sequence: Synthetic coding sequence

SEQ ID NO: 12985 - DNA, 573 bp, Artificial Sequence
  Description of Artificial Sequence: Synthetic coding sequence
atggccggcaccgccagacacgacagagagatggccatccaggccaagaagaagctgaccaccgccaccgaccccatcgagagactgagactgcagtgcctggccagaggcagcgccggcatcaagggcctgggcagagtgttcagaatcatggacgacgacaacaacagaaccctggacttcaaggagttcatgaagggcctgaacgactacgccgtggtgatggagaaggaggaggtggaggagctgttcagaagattcgacaaggacggcaacggcaccatcgacttcaacgagttcctgctgaccctgagaccccccatgagcagagccagaaaggaggtgatcatgcaggccttcagaaagctggacaagaccggcgacggcgtgatcaccatcgaggacctgagagaggtgtacaacgccaagcaccaccccaagtaccagaacggcgagtggagcgaggagcaggtgttcagaaagttcctggacaacttcgacagcccctacgacaaggacggcctggtgacccccgaggagttcatgaactactacgccggcgtgagcgcctag

SEQ ID NO: 12986 - DNA, 231 bp, Artificial Sequence
  Description of Artificial Sequence: Synthetic coding sequence
atgacccccccccagcagcccccccccctgagaagcgagcccggcaccctgggcagcgccgccagcagctacagccccctgggcctgaacggcgtgcccggcagcatctgggacttcgtgagcggcagcttcagccccagccccagccccatcctgagcgccggcccccccagcagcagcagcgccagccccaacggcgccgagctggccagagtgagaagacagctgtag

SEQ ID NO: 12987 - DNA, 108 bp, Artificial Sequence
  Description of Artificial Sequence: Synthetic coding sequence
atggccaccctggtggtgaacaagctgggcgccggcgtggacagcggcagacagggcagcagaggcaccgccgtggtgaaggtgctggagtgcggcgtgtgcgagtag

SEQ ID NO: 12988 - DNA, 477 bp, Artificial Sequence
  Description of Artificial Sequence: Synthetic coding sequence
atggaggccgacatcatcaccaacctgagatgcagactgaaggaggccgaggaggagagactgaaggccgcccagtacggcctgcagctggtggagagccagaacgagctgcagaaccagctggacaagtgcagaaacgagatgatgaccatgaccgagagctacgagcaggagaagtacaccctgcagagagaggtggagctgaagagcagaatgctggagagcctgagctgcgagtgcgaggccatcaagcagcagcagaagatgcacctggagaagctggaggagcagctgagcagaagccacggccaggaggtgaacgagctgaagaccaagatcgagaagctgaaggtggagctggacgaggccagactgagcgagaagcagctgaagcaccaggtggaccaccagaaggagctgctgagctgcaagagcgaggagctgagagtgatgagcgagagagtgcaggagagctag

SEQ ID NO: 12989 - DNA, 393 bp, Artificial Sequence
  Description of Artificial Sequence: Synthetic coding sequence
atggcccagaccgacaagcccacctgcatcccccccgagctgcccaagatgctgaaggagttcgccaaggccgccatcagagcccagccccaggacctgatccagtggggcgccgactacttcgaggccctgagcagaggcgagaccccccccgtgagagagagaagcgagagagtggccctgtgcaactgggccgagctgacccccgagctgctgaagatcctgcacagccaggtggccggcagactgatcatcagagccgaggagctggcccagatgtggaaggtggtgaacctgcccaccgacctgttcaacagcgtgatgaacgtgggcagattcaccgaggagatcgagtggctgaagttcctggccctggcctgcagcgccctgtag

SEQ ID NO: 12990 - DNA, 693 bp, Artificial Sequence
  Description of Artificial Sequence: Synthetic coding sequence
atggaggccgacatcatcaccaacctgagatgcagactgaaggaggccgaggaggagagactgaaggccgcccagtacggcctgcagctggtggagagccagaacgagctgcagaaccagctggacaagtgcagaaacgagatgatgaccatgaccgagagctacgagcaggagaagtacaccctgcagagagaggtggagctgaagagcagaatgctggagagcctgagctgcgagtgcgaggccatcaagcagcagcagaagatgcacctggagaagctggaggagcagctgagcagaagccacggccaggaggtgaacgagctgaagaccaagatcgagaagctgaaggtggagctggacgaggccagactgagcgagaagcagctgaagcaccaggtggaccaccagaaggagctgctgagctgcaagagcgaggagctgagagtgatgagcgagagagtgcaggagagcatgagcagcgagatgctggccctgcagatcgagctgaccgagatggagagcatgaagaccaccctgaaggaggaggtgaacgagctgcagtacagacaggagcagctggagctgctgatcaccaacctgatgagacaggtggacagactgaaggaggagaaggaggagagagagaaggaggccgtgagctactacaacgccctggagaaggccagatag

SEQ ID NO: 12991 - DNA, 639 bp, Artificial Sequence; identical to SEQ ID NO: 9337
  Description of Artificial Sequence: Synthetic coding sequence

SEQ ID NO: 12992 - DNA, 2844 bp, Artificial Sequence
  Description of Artificial Sequence: Synthetic coding sequence
atgaacttcctgagaggcgtgatgggcggccagagcgccggcccccagcacaccgaggccgagaccgtgagaggcgccgccgaccccaaggtgaccagcagctgcggcctgaagttcagacacagcttcagactggtgaagcacatcctgtaccacgtgaccatcaacgtgtacagcgacagcgagatcatcggctacgccctggacaccctgtacaacatcatcagcaacgaggaggaggaggaggtggaggagaacagcaccagacagagcgaggacctgggcagccagttcaccgagatcttcatcaagcagcaggagaacgtgaccctgctgctgagcctgctggaggagttcgacttccacgtgagatggcccggcgtgaagctgctgaccagcctgctgaagcagctgggcccccaggtgcagcagatcatcctggtgagccccatgggcgtgagcagactgatggacctgctggccgacagcagagaggtgatcagaaacgacggcgtgctgctgctgcaggccctgaccagaagcaacggcgccatccagaagatcgtggccttcgagaacgccttcgagagactgctggacatcatcagcgaggagggcaacagcgacggcggcatcgtggtggaggactgcctgatcctgctgcagaacctgctgaagaacaacaacagcaaccagaacttcttcaaggagggcagctacatccagagaatgaagccctggttcgaggtgggcgacgagaacagcggctggagcgcccagaaggtgaccaacctgcacctgatgctgcagctggtgagagtgctggtgagccccaccaacccccccggcgccaccagcagctgccagaaggccatgttccagtgcggcctgctgcagcagctgtgcaccatcctgatggccaccggcgtgcccgccgacatcctgaccgagaccatcaacaccgtgagcgaggtgatcagaggctgccaggtgaaccaggactacttcgccagcgtgaacgcccccagcaacccccccagacccgccatcgtggtgctgctgatgagcatggtgaacgagagacagcccttcgtgctgagatgcgccgtgctgtactgcttccagtgcttcctgtacaagaaccagaagggccagggcgagatcgtgagcaccctgctgcccagcaccatcgacgccaccggcaacagcgtgagcgccggccagctgctgtgcggcggcctgttcagcaccgacagcctgagcaactggtgcgccgccgtggccctggcccacgccctgcaggagaacgccacccagaaggagcagctgctgagagtgcagctggccaccagcatcggcaacccccccgtgagcctgctgcagcagtgcaccaacatcctgagccagggcagcaagatccagaccagagtgggcctgctgatgctgctgtgcacctggctgagcaactgccccatcgccgtgacccacttcctgcacaacagcgccaacgtgcccttcctgaccggccagatcgccgagaacctgggcgaggaggagcagctggtgcagggcctgtgcgccctgctgctgggcatcagcatctacttcaacgacaacagcctggagagctacatgaaggagaagctgaagcagctgatcgagaagagaatcggcaaggagaacttcatcgagaagctgggcttcatcagcaagcacgagctgtacagcagagccagccagaagccccagcccaacttccccagccccgagtacatgatcttcgaccacgagttcaccaagctggtgaaggagctggagggcgtgatcaccaaggccatctacaagagcagcgaggaggacaagaaggaggaggaggtgaagaagaccctggagcagcacgacaacatcgtgacccactacaagaacatgatcagagagcaggacctgcagctggaggagctgagacagcaggtgagcaccctgaagtgccagaacgagcagctgcagaccgccgtgacccagcaggtgagccagatccagcagcacaaggaccagtacaacctgctgaagatccagctgggcaaggacaaccagcaccagggcagctacagcgagggcgcccagatgaacggcatccagcccgaggagatcggcagactgagagaggagatcgaggagctgaagagaaaccaggagctgctgcagagccagctgaccgagaaggacagcatgatcgagaacatgaagagcagccagaccagcggcaccaacgagcagagcagcgccatcgtgagcgccagagacagcgagcaggtggccgagctgaagcaggagctggccaccctgaagagccagctgaacagccagagcgtggagatcaccaagctgcagaccgagaagcaggagctgctgcagaagaccgaggccttcgccaagagcgtggaggtgcagggcgagaccgagaccatcatcgccaccaagaccaccgacgtggagggcagactgagcgccctgctgcaggagaccaaggagctgaagaacgagatcaaggccctgagcgaggagagaaccgccatcaaggagcagctggacagcagcaacagcaccatcgccatcctgcagaccgagaaggacaagctggagctggagatcaccgacagcaagaaggagcaggacgacctgctggtgctgctggccgaccaggaccagaagatcctgagcctgaagaacaagctgaaggacctgggccaccccgtggaggaggaggacgagctggagagcggcgaccaggaggacgaggacgacgagagcgaggaccccggcaaggacctggaccacatctag

SEQ ID NO: 12993 - DNA, 1095 bp, Artificial Sequence; identical to SEQ ID NO: 12864
  Description of Artificial Sequence: Synthetic coding sequence

SEQ ID NO: 12994 - DNA, 1236 bp, Artificial Sequence; identical to SEQ ID NO: 12963
  Description of Artificial Sequence: Synthetic coding sequence

SEQ ID NO: 12995 - DNA, 810 bp, Artificial Sequence; identical to SEQ ID NO: 12977
  Description of Artificial Sequence: Synthetic coding sequence

SEQ ID NO: 12996 - DNA, 360 bp, Artificial Sequence
  Description of Artificial Sequence: Synthetic coding sequence
atggccagccagctgcaggtgttcagcccccccagcgtgagcagcagcgccttctgcagcgccaagaagctgaagatcgagcccagcggctgggacgtgagcggccagagcagcaacgacaagtactacacccacagcaagaccctgcccgccacccagggccaggccaacagcagccaccaggtggccaacttcaacatccccgcctacgaccagggcctgctgctgcccgcccccgccgtggagcacatcgtggtgaccgccgccgacagcagcggcagcgccgccaccagcaccttccagagcagccagaccctgacccacagaagcaacgtgagcctgctggagccctaccagtag

SEQ ID NO: 12997 - DNA, 339 bp, Artificial Sequence; identical to SEQ ID NO: 12889
  Description of Artificial Sequence: Synthetic coding sequence

SEQ ID NO: 12998 - DNA, 54 bp, Artificial Sequence
  Description of Artificial Sequence: Synthetic coding sequence
atgaagagaggcagactgcccagcagcagcgaggacagcgacgacaacggctag

SEQ ID NO: 12999 - DNA, 810 bp, Artificial Sequence; identical to SEQ ID NO: 9299
  Description of Artificial Sequence: Synthetic coding sequence

SEQ ID NO: 13000 - DNA, 339 bp, Artificial Sequence
  Description of Artificial Sequence: Synthetic coding sequence
atgaacggcagagccgacttcagagagcccaacgccgaggtgcccagacccatcccccacatcggccccgactacatccccaccgaggaggagagaagagtgttcgccgagtgcaacgacgagagcttctggttcagaagcgtgcccctggccgccaccagcatgctgatcacccagggcctgatcagcaagggcatcctgagcagccaccccaagtacggcagcatccccaagctgatcctggcctgcatcatgggctacttcgccggcaagctgagctacgtgaagacctgccaggagaagttcaagaagctggagaacagccccctgggcgagtag

SEQ ID NO: 13001 - DNA, 687 bp, Artificial Sequence
  Description of Artificial Sequence: Synthetic coding sequence
atggaggagcagccccagatgcaggacgccgacgagcccgccgacagcggcggcgagggcagagccggcggccccccccaggtggccggcgcccaggccgcctgcagcgaggacagaatgaccctgctgctgagactgagagcccagaccaagcagcagctgctggagtacaagagcatggtggacgccagcgaggagaagacccccgagcagatcatgcaggagaagcagatcgaggccaagatcgaggacctggagaacgagatcgaggaggtgaaggtggccttcgagatcaagaagctggccctggacagcgtgctgatggacaacatgaagcacctgctggagctgaacaagctgatcatgaagagccagcaggagagctgggacctggaggagaagctgctggacatcagaaagaagagactgcagctgaagcaggccagcgagagcaagctgctggagatccagaccgagaagaacaagcagaagatcgacctggacagcatggagaacagcgagagaatcaagatcatcagacagaacctgcagatggagatcaagatcaccaccgtgatccagcacgtgttccagaacctgatcctgggcagcaaggtgaactgggccgaggaccccgccctgaaggagatcgtgctgcagctggagaagaacgtggacatgatgtag

SEQ ID NO: 13002 - DNA, 2352 bp, Artificial Sequence; identical to SEQ ID NO: 10346
  Description of Artificial Sequence: Synthetic coding sequence

SEQ ID NO: 13003 - DNA, 393 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagagagggcagacccagcggcgaggccttcgtggagctggagagcgaggacgaggtgaagctggccctgaagaaggacagagagaccatgggccacagatacgtggaggtgttcaagagcaacaacgtggagatggactgggtgctgaagcacaccggccccaacagccccgacaccgccaacgacggcttcgtgagactgagaggcctgcccttcggctgcagcaaggaggagatcgtgcagttctag

SEQ ID NO: 13004 - DNA, 267 bp, Artificial Sequence
  Description of Artificial Sequence: Synthetic coding sequence
atggaggccgacatcatcaccaacctgagatgcagactgaaggaggccgaggaggagagactgaaggccgcccagtacggcctgcagctggtggagagccagaacgagctgcagaaccagctggacaagtgcagaaacgagatgatgaccatgaccgagagctacgagcaggagaagtacaccctgcagagagaggtggagctgaagagcagaatgctggagagcctgagctgcgagtgcgaggccatcaagcagcagcagaagtag

SEQ ID NO: 13005 - DNA, 1902 bp, Artificial Sequence; identical to SEQ ID NO: 10526
  Description of Artificial Sequence: Synthetic coding sequence

SEQ ID NO: 13006 - DNA, 597 bp, Artificial Sequence
  Description of Artificial Sequence: Synthetic coding sequence
atggccaccggcgacctgaagagaagcctgagaaacctggagcaggtgctgagactgctgaactaccccgaggaggtggactgcgtgggcctgatcaagggcgaccccgccgccagcctgcccatcatcagctacagcttcaccagctacagcccctacgtgaccgagctgatcatggagagcaacgtggagctgatcgccaagaacgacctgagattcatcgacgccgtgtacaagctgctgagagaccagttcaactacaagcccatcctgaccaagaagcagttcatccagtgcggcttcgccgagtggaagatccagatcgtgtgcgacatcctgaactgcgtgatgaagaagcacaaggagctgagcagcctgcagaagatccccagccagcagagaaagaagatcagcagcggcaagagcgagccccccctgggcaacgagaagatcagcgccgaggccgtgggcgtggacatcagcggcagattcatgaccagcggcaagaagaaggccgtggtgatcagacacctgtacaacgaggacaacgtggacatcagcgaggacaccctgagccccatcaccgacgtgaactag

SEQ ID NO: 13007 - DNA, 336 bp, Artificial Sequence
  Description of Artificial Sequence: Synthetic coding sequence
atggtgatggagaagcccagccccctgctggtgggcagagagttcgtgagacagtactacaccctgctgaacaaggcccccgagtacctgcacagattctacggcagaaacagcagctacgtgcacggcggcgtggacgccagcggcaagccccaggaggccgtgtacggccagaacgacatccaccacaaggtgctgagcctgaacttcagcgagtgccacaccaagatcagacacgtggacgcccacgccaccctgagcgacggcgtggtggtgcaggtgatgggcctgctgagcaacagcggccagcccgagagaaagttcatgcagacctag

SEQ ID NO: 13008 - DNA, 681 bp, Artificial Sequence; identical to SEQ ID NO: 10935
  Description of Artificial Sequence: Synthetic coding sequence

SEQ ID NO: 13009 - DNA, 1872 bp, Artificial Sequence
  Description of Artificial Sequence: Synthetic coding sequence
atgagcgacgaggtgttcagcaccaccctggcctacaccaagagccccaaggtgaccaagagaaccaccttccaggacgagctgatcagagccatcaccgccagaagcgccagacagagaagcagcgagtacagcgacgacttcgacagcgacgagatcgtgagcctgggcgacttcagcgacaccagcgccgacgagaacagcgtgaacaagaagatgaacgacttccacatcagcgacgacgaggagaagaaccccagcaagctgctgttcctgaagaccaacaagagcaacggcaacatcaccaaggacgagcccgtgtgcgccatcaagaacgaggaggagatggcccccgacggctgcgaggacatcgtggtgaagagcttcagcgagagccagaacaaggacgaggagttcgagaaggacaagatcaagatgaagcccaagcccagaatcctgagcatcaagagcaccagcagcgccgagaacaacagcctggacaccgacgaccacttcaagcccagccccagacccagaagcatgctgaagaagaagagccacatggaggagaaggacggcctggaggacaaggagaccgccctgagcgaggagctggagctgcacagcgcccccagcagcctgcccacccccaacggcatccagctggaggccgagaagaaggccttcagcgagaacctggaccccgaggacagctgcctgaccagcctggccagcagcagcctgaagcagatcctgggcgacagcttcagccccggcagcgagggcaacgccagcggcaaggccgaccacgtgaccaccgccgtggagaagagcaaggagagccaggtgaccgccgacgacctggaggaggagaaggccaaggccgagctgatcatggacgacgacagaaccgtggaccccctgctgagcaagagccagagcatcctgatcagcaccagcgccaccgccagcagcaagaagaccatcgaggacagaaacatcaagaacaagaagagcaccaacaacagagccagcagcgccagcgccagactgatgaccagcgagttcctgaagaagagcagcagcaagagaagaacccccagcaccaccaccagcagccactacctgggcaccctgaaggtgctggaccagaagcccagccagaagcagagcatcgagcccgacagagccgacaacatcagagccgccgtgtaccaggagtggctggagaagaagaacgtgtacctgcacgagatgcacagaatcaagagaatcgagagcgagaacctgagaatccagaacgagcagaagaaggccgccaagagagaggaggccctggccagcttcgaggcctggaaggccatgaaggagaaggaggccaagaagatcgccgccaagaagagactggaggagaagaacaagaagaagaccgaggaggagaacgccgccagaaagggcgaggccctgcaggccttcgagaagtggaaggagaagaagatggagtacctgaaggagaagaacagaaaggagagagagtacgagagagccaagaagcagaaggaggaggagaccgtggccgagaagaagaaggacaacctgaccgccgtggagaagtggaacgagaagaaggaggccttcttcaagcagaaggagaaggagaagatcaacgagaagagaaaggaggagctgaagagagccgagaagaaggacaaggacaagcaggccatcaacgagtacgagaagtggctggagaacaaggagaagcaggagagaatcgagagaaagcagaagaagagacacagcttcctggagagcgaggccctgcccccctggagcccccccagcagaaccgtgttcgccaaggtgttctag

SEQ ID NO: 13010 - DNA, 255 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagagagggcagacccagcggcgaggccttcgtggagctggagagcgaggacgaggtgaagctggccctgaagaaggacagagagaccatgggccacagatacgtggagtag

SEQ ID NO: 13011 - DNA, 993 bp, Artificial Sequence
  Description of Artificial Sequence: Synthetic coding sequence
atggaccagggcgacacccccaccctggaggaggacctgaagaagctgcagctgagcgagttcttcgacatcttcgagaaggagaaggtggacaaggaggccctggccctgtgcaccgacagagacctgcaggagatcggcatccccctgggccccagaaagaagatcctgaactacttcagcaccagaaagaacagcatgggcatcaagagacccgccccccagcccgccagcggcgccaacatccccaaggagagcgagttctgcagcagcagcaacaccagaaacggcgactacctggacgtgggcatcggccaggtgagcgtgaagtaccccagactgatctacaagcccgagatcttcttcgccttcggcagccccatcggcatgttcctgaccgtgagaggcctgaagagaatcgaccccaactacagattccccacctgcaagggcttcttcaacatctaccaccccttcgaccccgtggcctacagaatcgagcccatggtggtgcccggcgtggagttcgagcccatgctgatcccccaccacaagggcagaaagagaatgcacctggagctgagagagggcctgaccagaatgagcatggacctgaagaacaacctgctgggcagcctgagaatggcctggaagagcttcaccagagccccctaccccgccctgcaggccagcgagacccccgaggagaccgaggccgagcccgagagcaccagcgagaagcccagcgacgtgaacaccgaggagaccagcgtggccgtgaaggaggaggtgctgcccatcaacgtgggcatgctgaacggcggccagagaatcgactacgtgctgcaggagaagcccatcgagagcttcaacgagtacctgttcgccctgcagagccacctgtgctactgggagagcgaggacaccgtgctgctggtgctgaaggagatctaccagacccagggcatcttcctggaccagcccctgcagtag

SEQ ID NO: 13012 - DNA, 1383 bp, Artificial Sequence; identical to SEQ ID NO: 10506
  Description of Artificial Sequence: Synthetic coding sequence

SEQ ID NO: 13013 - DNA, 1068 bp, Artificial Sequence
  Description of Artificial Sequence: Synthetic coding sequence
atgaccggcagcgccgccgacacccacagatgcccccaccccaagggcgccaagggcaccagaagcagaagcagccacgccagacccgtgagcctggccaccagcggcggcagcgaggaggaggacaaggacggcggcgtgctgttccacgtgaacaagagcggcttccccatcgacagccacacctgggagagaatgtggatgcacgtggccaaggtgcaccccaagggcggcgagatggtgggcgccatcagaaacgccgccttcctggccaagcccagcatcccccaggtgcccaactacagactgagcatgaccatccccgactggctgcaggccatccagaactacatgaagaccctgcagtacaaccacaccggcacccagttcttcgagatcagaaagatgagacccctgagcggcctgatggagaccgccaaggagatgaccagagagagcctgcccatcaagtgcctggaggccgtgatcctgggcatctacctgaccaacggccagcccagcatcgagagattccccatcagcttcaagacctacttcagcggcaactacttccaccacgtggtgctgggcatctactgcaacggcagatacggcagcctgggcatgagcagaagagccgagctgatggacaagcccctgaccttcagaaccctgagcgacctgatcttcgacttcgaggacagctacaagaagtacctgcacaccgtgaagaaggtgaagatcggcctgtacgtgccccacgagccccacagcttccagcccatcgagtggaagcagctggtgctgaacgtgagcaagatgctgagagccgacatcagaaaggagctggagaagtacgccagagacatgagaatgaagatcctgaagcccgccagcgcccacagccccacccaggtgagaagcagaggcaagagcctgagccccagaagaagacaggccagcccccccagaagactgggcagaagagagaagagccccgccctgcccgagaagaaggtggccgacctgagcaccctgaacgaggtgggctaccagatcagaatctag

SEQ ID NO: 13014 - DNA, 384 bp, Artificial Sequence
  Description of Artificial Sequence: Synthetic coding sequence
atggccagcaaccacaagagcagcgccgccagacccgtgagcagaggcggcgtgggcctgaccggcagaccccccagcggcatcagacccctgagcggcaacatcagagtggccaccgccatgccccccggcaccgccagacccggcagcagaggctgccccatcggcaccggcggcgtgctgagcagccagatcaaggtggcccacagacccgtgacccagcagggcctgaccggcatgaagaccggcaccaagggcccccagagacagatcctggacaagagctactacctgggcctgctgagaagcaagatcagcgagctgaccaccgaggtgaacaagctgcagaagggcatcgagatgtacaaccaggagaacagctag

SEQ ID NO: 13015 - DNA, 510 bp, Artificial Sequence
  Description of Artificial Sequence: Synthetic coding sequence
atgcacaagctgcagagcggcatcggcagactgatcctgaaggaggagatgaaggccagaagcagcagctacgccgacccctggaccccccccagaagcagcaccagcagcagagaggccctgcacaccgccggctacgagatgagcctgaacggcagccccagaagccactacctggccgacagcgaccccctgatcagcaagagcgccagcctgcccgcctacagaagaaacggcctgcacagaacccccagcgccgacctgttccactacgacagcatgaacgccgtgaactggggcatgagagagtacaagatctacccctacgagctgctgctggtgaccaccagaggcagaaacagactgcccaaggacgtggacagaaccagactggagagacacctgagccaggaggagttctaccaggtgttcggcatgaccatcagcgagttcgacagactggccctgtggaagagaaacgagctgaagaagcaggccagactgttctag

SEQ ID NO: 13016 - DNA, 144 bp, Artificial Sequence
  Description of Artificial Sequence: Synthetic coding sequence
atggccagcgtgctgagcagaagactgggcaagagaagcctgctgggcgccagagtgctgggccccagcgccagcgagggccccagcgccgccccccccagcgagcccctgctggagggcgccgccccccagcccttcacctag

SEQ ID NO: 13017 - DNA, 558 bp, Artificial Sequence
  Description of Artificial Sequence: Synthetic coding sequence
atggacgacagcatcaacaacagattcagctacgtgacccacgaggacatctgcaactgcttcaacggcgacaccctgctggccatccaggcccccagcggcacccagctggaggtgcccatccccgagatgggccagaacggccagaagaagtaccagatcaacctgaagagccacagcggccccatccacgtgctgctgatcaacaaggagagcagcagcagcaagcccgtggtgttccccgtgcccccccccgacgacctgacccagcccagcagccagagcctgacccccgtgaccccccagaagagcagcatggccacccagaacctgcccgagcagcacgtgagcgagagaagccaggccctgcagcagaccagcgccaccgacatcagcagcgccggcagcatcagcggcgacatcatcgacgagctgatgagcagcgacgtgttccccctgctgagactgagccccacccccgccgacgactacaacttcaacctggacgacaacgagggcgtgtgcgacctgttcgacgtgcagatcctgaactactag

SEQ ID NO: 13018 - DNA, 492 bp, Artificial Sequence; identical to SEQ ID NO: 10357
  Description of Artificial Sequence: Synthetic coding sequence

SEQ ID NO: 13019 - DNA, 915 bp, Artificial Sequence
  Description of Artificial Sequence: Synthetic coding sequence
atgagcaagagaagaagactgaagcagggcgagcccatcatgaccggcaagacccagaccagcaacgtgaccaacaagaacgaccccaagagcatcaacagcagagtgttcatcggcaacctgaacaccgccatcgtgaagaaggtggacatcgaggccatcttcagcaagtacggcaagatcgtgggctgcagcgtgcacaagggctacgccttcgtgcagtacatgagcgagagacacgccagagccgccgtggccggcgagaacgccagagtgatcgccggccagcccctggacatcaacatggccggcgagcccaagccctacagacccaagcccggcaacaagagacccctgagcgccctgtacagactggagagcaaggagcccttcctgagcgtgggcggctacgtgttcgactacgactactacagagacgacttctacaacagactgttcgactaccacggcagagtgccccccccccccagagccgtgatccccctgaagagacccagagtggccgtgaccaccaccagaagaggcaagggcgtgttcagcatgaagggcggcagcagaagcaccgccagcggcagcaccggcagcaagctgaagagcgacgagctgcagaccatcaagaaggagctgacccagatcaagaccaagatcgacagcctgctgggcagactggagaagatcgagaagcagcagaaggccgaggccgaggcccagaagaagcagctggaggagagcctggtgctgatccaggaggagtgcgtgagcgagatcgccgaccacagcaccgaggagcccgccgagggcggccccgacgccgacggcgaggagatgaccgacggcatcgaggaggacttcgacgaggacggcggccacgagctgttcctgcagatcaagtag

SEQ ID NO: 13020 - DNA, 405 bp, Artificial Sequence
  Description of Artificial Sequence: Synthetic coding sequence
atgcccagcgccgaggccaagctgaagaagaacagatgcgccaactgcttcgactgccccggctgcatgcacaccctgagcaccagagccaccagcatcagcacccagctgcccgacgaccccgccaagaccaccatgaagaaggcctactacctggcctgcggcttctgcagatggaccagcagagacgtgggcatggccgacaagagcgtggccagcggcggctggcaggagcccgagaacccccacacccagagaatgaacaagctgatcgagtactaccagcagctggcccagaaggagaaggtggagagagacagaaagaagctggccagaagaagaaactacatgcccctggccttcagcgacaagtacggcctgggcaccagactgcagagaccctag

SEQ ID NO: 13021 - DNA, 1230 bp, Artificial Sequence
  Description of Artificial Sequence: Synthetic coding sequence
atgtggagagtgatcgagcccccctgccccggcgcccccagcaccgagaacggcaagagcgtgcactggaagctgggcgccgacaaggaggtgtgggtgtgggtgatgggcgagcaccacctggacaagccctacgacgtgctgtgcaacgagatcatcgccgagagagccagactgaaggccgagcaggaggccgaggagcccagaaagacccacagcgaggagttcaccaacagcctgaagaccaagagccagtaccacgacctgcaggcccccgacaaccagcagaccaaggacatctggaagaaggtggccgagaaggaggagctggagcagggcagcagacccgcccccaccctggaggaggagaagatcagaagcctgagcagcagcagcagaaacatccagcagatgctggccgacagcatcaacagaatgaaggcctacgccttccaccagaagaaggagagcatgaagaagaagcaggacgaggagatcaaccagatcgaggaggagagaaccaagcagatctgcaagagctggaaggaggacagcgagtggcaggccagcctgagaaagagcaaggccgccgacgagaagagaagaagcctggccaagcaggccagagaggactacaagagactgagcctgggcgcccagaagggcagaggcggcgagagactgcagagccccctgagagtgccccagaagcccgagagaccccccctgccccccaagccccagttcctgaacagcggcgcctacccccagaagcccctgagaaaccagggcgtggtgagaaccctgagcagcagcgcccaggaggacatcatcagatggttcaaggaggagcagctgcccctgagagccggctaccagaagaccagcgacaccatcgccccctggttccacggcatcctgaccctgaagaaggccaacgagctgctgctgagcaccggcatgcccggcagcttcctgatcagagtgagcgagagaatcaagggctacgccctgagctacctgagcgaggacggctgcaagcacttcctgatcgacgccagcgccgacgcctacagcttcctgggcgtggaccagctgcagcacgccaccctggccgacctggtggagtaccacaaggaggagcccatcaccagcctgggcaaggagctgctgctgtacccctgcggccagcaggaccagctgcccgactacctggagctgttcgagtag

SEQ ID NO: 13022 - DNA, 390 bp, Artificial Sequence
  Description of Artificial Sequence: Synthetic coding sequence
atgagcgacaagagcgacctgaaggccgagctggagagaaagaagcagagactggcccagatcagagaggagaagaagagaaaggaggaggagagaaagaagaaggaggccgacatgcagcagaagaaggagcccgtgcaggacgacagcgacctggacagaaagagaagagagaccgaggccctgctgcagagcatcggcatcagccccgagccccccctggtgcccacccccatgagccccagcagcaagagcgtgagcacccccagcgaggccggcagccaggacagcggcgacctgggccccctgaccagaaccctgcagtgggacaccgaccccagcgtgctgcagctgcagagcgacagcgagctgggctacatgagcgcctag

SEQ ID NO: 13023 - DNA, 780 bp, Artificial Sequence
  Description of Artificial Sequence: Synthetic coding sequence
atggtgggcagagagaaggagctgagcatccacttcgtgcccggcagctgcagactggtggaggaggaggtgaacatccccaacagaagagtgctggtgaccggcgccaccggcctgctgggcagagccgtgcacaaggagttccagcagaacaactggcacgccgtgggctgcggcttcagaagagccagacccaagttcgagcaggtgaacctgctggacagcaacgccgtgcaccacatcatccacgacttccagccccacgtgatcgtgcactgcgccgccgagagaagacccgacgtggtggagaaccagcccgacgccgccagccagctgaacgtggacgccagcggcaacctggccaaggaggccgccgccgtgggcgccttcctgatctacatcagcagcgactacgtgttcgacggcaccaaccccccctacagagaggaggacatccccgcccccctgaacctgtacggcaagaccaagctggacggcgagaaggccgtgctggagaacaacctgggcgccgccgtgctgagaatccccatcctgtacggcgaggtggagaagctggaggagagcgccgtgaccgtgatgttcgacaaggtgcagttcagcaacaagagcgccaacatggaccactggcagcagagattccccacccacgtgaaggacgtggccaccgtgtgcagacagctggccgagaagagaatgctggtgagaagaatccccgagagctgcctgagcgagggccccctgtgcctgttccacgcctag

SEQ ID NO: 13024 - DNA, 549 bp, Artificial Sequence
  Description of Artificial Sequence: Synthetic coding sequence
agctacgacagcaccttcagctacgtgacccacgaggacatctgcaactgcttcaacggcgacaccctgctggccatccaggcccccagcggcacccagctggaggtgcccatccccgagatgggccagaacggccagaagaagtaccagatcaacctgaagagccacagcggccccatccacgtgctgctgatcaacaaggagagcagcagcagcaagcccgtggtgttccccgtgcccccccccgacgacctgacccagcccagcagccagagcctgacccccgtgaccccccagaagagcagcatggccacccagaacctgcccgagcagcacgtgagcgagagaagccaggccctgcagcagaccagcgccaccgacatcagcagcgccggcagcatcagcggcgacatcatcgacgagctgatgagcagcgacgtgttccccctgctgagactgagccccacccccgccgacgactacaacttcaacctggacgacaacgagggcgtgtgcgacctgttcgacgtgcagatcctgaactactag

SEQ ID NO: 13025 - DNA, 162 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccagtag

SEQ ID NO: 13026 - DNA, 3018 bp, Artificial Sequence
  Description of Artificial Sequence: Synthetic coding sequence
atggccggcgccctgagaagaggcagagccctgggcagcagacccagcggccccaccgtgagcagcagaagaagcccccagtgccccgtggcccaggagggcctgggcgccagaagcagacccagagtggcccccagaagcctggccagatgcggccccagcagcagactgatgggctggaagcccagcgaggccagaggccagagccagagcttccaggccagcggcctgcagcccagaagcctgaaggccgccagaagagccaccggcagacccgacagaagcagagccgccagacccaccatggaccccagcgcccacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagttcatcggccagaccggcaccgtgcacagaatcaccgacagaggcgacgtgagagtgcagttcaaccacgagaccagatggaccttccaccccggcgccctgaccaagcaccacagcttctgggtgggcgacgtggtgagagtgatcggcgacctggacaccgtgaagagactgcaggccggccacggcgagtggaccgacgacatggcccccgccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 13027 - DNA, 294 bp, Artificial Sequence
  Description of Artificial Sequence: Synthetic coding sequence
atggccagcagcgccgagctggacttcaacctgcaggccctgctggagcagctgagccaggacgagctgagcaagttcaagagcctgatcagaaccatcagcctgggcaaggagctgcagaccgtgccccagaccgaggtggacaaggccaacggcaagcagctggtggagatcttcaccagccacagctgcagctactgggccggcatggccgccatccaggtgttcgagaagatgaaccagacccacctgagcggcagagccgacgagcactgcgtgatgccccccccctag

SEQ ID NO: 13028 - DNA, 693 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaaggacatcagcatccagctgagcagcgcccagagcagatgcaccctgctggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagatcaagcacctggaggagaagctgaaggaggaggagcaccagagaaagctgttccaggacaaggccagcgagctgcagaccggcctggagatcagcaagatcatctag

SEQ ID NO: 13029 - DNA, 624 bp, Artificial Sequence
  Description of Artificial Sequence: Synthetic coding sequence
atggacagaggcgagcagggcctgctgagaaccgaccccgtgcccgaggagggcgaggacgtggccgccaccatcagcgccaccgagaccctgagcgaggaggagcaggaggagctgagaagagagctggccaaggtggaggaggagatccagaccctgagccaggtgctggccgccaaggagaagcacctggccgagatcaagagaaagctgggcatcaacagcctgcaggagctgaagcagaacatcgccaagggctggcaggacgtgaccgccaccagcgcctacaagaagaccagcgagaccctgagccaggccggccagaaggccagcgccgccttcagcagcgtgggcagcgtgatcaccaagaagctggaggacgtgaagctgcaggccttcagccacagcttcagcatcagaagcatccagcacagcatcagcatgcccgccatgagaaacagccccaccttcaagagcttcgaggagaaggtggagaacctgaagagcaaggtgggcggcaccaagcccgccggcggcgacttcggcgaggtgctgaacagcgccgccaacgccagcgccaccaccaccgagcccctgcccgagaagacccaggagagcctgtag

SEQ ID NO: 13030 - DNA, 387 bp, Artificial Sequence
  Description of Artificial Sequence: Synthetic coding sequence
atgaagttcaaccccttcgtgaccagcgacagaagcaagaacagaaagagacacttcaacgcccccagccacgtgagaagaaagatcatgagcagccccctgagcaaggagctgagacagaagtacaacgtgagaagcatgcccatcagaaaggacgacgaggtgcaggtggtgagaggccactacaagggccagcagatcggcaaggtggtgcaggtgtacagaaagaagtacgtgatctacatcgagagagtgcagagagagaaggccaacggcaccaccgtgcacgtgggcatccaccccagcaaggtggtgatcaccagactgaagctggacaaggacagaaagaagatcctggagagaaaggccaagagcagacaggtgtag

SEQ ID NO: 13031 - DNA, 126 bp, Artificial Sequence
  Description of Artificial Sequence: Synthetic coding sequence
  Description of Combined DNA/RNA Molecule: Synthetic coding sequence
ggcctgaccaagcagctgctggacgacaccatcggcatccaccccacctgcggcgaggtgttcaccaccctggagatcaccaagagcagcggcctggacatcacccagaagggctgcugaggctag

SEQ ID NO: 13032 - DNA, 1365 bp, Artificial Sequence; identical to SEQ ID NO: 9494
  Description of Artificial Sequence: Synthetic coding sequence

SEQ ID NO: 13033 - DNA, 438 bp, Artificial Sequence; identical to SEQ ID NO: 9483
  Description of Artificial Sequence: Synthetic coding sequence

SEQ ID NO: 13034 - DNA, 621 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaaggacatcagcatccagctgagcagcgcccagagcagatgcaccctgctggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagatcaagcacctggaggagaagctgaaggaggagtag

SEQ ID NO: 13035 - DNA, 1050 bp, Artificial Sequence; identical to SEQ ID NO: 9332
  Description of Artificial Sequence: Synthetic coding sequence

SEQ ID NO: 13036 - DNA, 429 bp, Artificial Sequence
  Description of Artificial Sequence: Synthetic coding sequence
atgcccagcatcaagctgcagagcagcgacggcgagatcttcgaggtggacgtggagatcgccaagcagagcgtgaccatcaagaccatgctggaggacctgggcatggacgacgagggcgacgacgaccccgtgcccctgcccaacgtgaacgccgccatcctgaagaaggtgatccagtggtgcacccaccacaaggacgacccccccccccccgaggacgacgagaacaaggagaagagaaccgacgacatccccgtgtgggaccaggagttcctgaaggtggaccagggcaccctgttcgagctgatcctggccgccaactacctggacatcaagggcctgctggacgtgacctgcaagaccgtggccaacatgatcaagggcaagacccccgaggagatcagaaagaccttcaacatcaagtag

SEQ ID NO: 13037 - DNA, 375 bp, Artificial Sequence
  Description of Artificial Sequence: Synthetic coding sequence
atgagcgccaccgtggtggacgccgtgaacgccgcccccctgagcggcagcaaggagatgagcctggaggagcccaagaagatgaccagagaggactggagaaagaagaaggagctggaggagcagagaaagctgggcaacgcccccgccgaggtggacgaggagggcaaggacatcaacccccacatcccccagtacatcagcagcgtgccctggtacatcgaccccagcaagagacccaccctgaagcaccagagaccccagcccgagaagcagaagcagttcagcagcagcggcgagtggtacaagagaggcgtgaaggagaacagcatcatcaccaagtacagaaagggcgcctgcgagaactgcggctag

SEQ ID NO: 13038 - DNA, 750 bp, Artificial Sequence; identical to SEQ ID NO: 9881
  Description of Artificial Sequence: Synthetic coding sequence

SEQ ID NO: 13039 - DNA, 120 bp, Artificial Sequence
  Description of Artificial Sequence: Synthetic coding sequence
atgaagttcaaccccttcgtgaccagcgacagaagcaagaacagaaagagacacttcaacgcccccagccacgtgagaagaaagatcatgagcagccccctgagcaaggagctgagatag

SEQ ID NO: 13040 - DNA, 1401 bp, Artificial Sequence; identical to SEQ ID NO: 9331
  Description of Artificial Sequence: Synthetic coding sequence

SEQ ID NO: 13041 - DNA, 528 bp, Artificial Sequence
  Description of Artificial Sequence: Synthetic coding sequence
atggccagcaaccacaagagcagcgccgccagacccgtgagcagaggcggcgtgggcctgaccggcagaccccccagcggcatcagacccctgagcggcaacatcagagtggccaccgccatgccccccggcaccgccagacccggcagcagaggctgccccatcggcaccggcggcgtgctgagcagccagatcaaggtggcccacagacccgtgacccagcagggcctgaccggcatgaagaccggcaccaagggcccccagagacagatcctggacaagagctactacctgggcctgctgagaagcaagatcagcgagctgaccaccgaggtgaacaagctgcagaagggcatcgagatgtacaaccaggagaacagcgtgtacctgagctacgagaagagagccgagaccctggccgtggagatcaaggagctgcagggccagctggccgactacaacatgctggtggacaagctgaacaccaacaccgagatggaggaggtgatgaacgactacaacatgtag

SEQ ID NO: 13042 - DNA, 438 bp, Artificial Sequence; identical to SEQ ID NO: 9483
  Description of Artificial Sequence: Synthetic coding sequence

SEQ ID NO: 13043 - DNA, 2136 bp, Artificial Sequence; identical to SEQ ID NO: 11492
  Description of Artificial Sequence: Synthetic coding sequence

SEQ ID NO: 13044 - DNA, 471 bp, Artificial Sequence
  Description of Artificial Sequence: Synthetic coding sequence
atggccagcgtgctgagcagaagactgggcaagagaagcctgctgggcgccagagtgctgggccccagcgccagcgagggccccagcgccgccccccccagcgagcccctgctggagggcgccgccccccagcccttcaccaccagcgacgacaccccctgccaggagcagcccaaggaggtgctgaaggcccccagcaccagcggcctgcagcaggtggccttccagcccggccagaaggtgtacgtgtggtacggcggccaggagtgcaccggcctggtggagcagcacagctggatggagggccaggtgaccgtgtggctgctggagcagaagctgcaggtgtgctgcagagtggaggaggtgtggctggccgagctgcagggcccctgcccccaggccccccccctggagcccggcgcccaggccctggcctacagacccgtgagcagaaacatcgacgtgccctag

SEQ ID NO: 13045 - DNA, 309 bp, Artificial Sequence
  Description of Artificial Sequence: Synthetic coding sequence
atgcccagcatcaagctgcagagcagcgacggcgagatcttcgaggtggacgtggagatcgccaagcagagcgtgaccatcaagaccatgctggaggacctgggcatggacgacgagggcgacgacgaccccgtgcccctgcccaacgtgaacgccgccatcctgaagaaggtgatccagtggtgcacccaccacaaggacgacccccccccccccgaggacgacgagaacaaggagaagagaaccgacgacatccccgtgtgggaccaggagttcctgaaggtggaccagggcaccctgttcgagtag

SEQ ID NO: 13046 - DNA, 465 bp, Artificial Sequence
  Description of Artificial Sequence: Synthetic coding sequence
atggccgacgacctggacttcgagaccggcgacgccggcgccagcgccaccttccccatgcagtgcagcgccctgagaaagaacggcttcgtggtgctgaagggctggccctgcaagatcgtggagatgagcgccagcaagaccggcaagcacggccacgccaaggtgcacctggtgggcatcgacatcttcaccggcaagaagtacgaggacatctgccccagcacccacaacatggacgtgcccaacatcaagagaaacgacttccagctgatcggcatccaggacggctacctgagcctgctgcaggacagcggcgaggtgcccgaggacctgagactgcccgagggcgacctgggcaaggagatcgagcagaagtacgactgcggcgaggagatcctgatcaccgtgctgagcgccatgaccgaggaggccgccgtggccatcaaggccatggccaagtag

SEQ ID NO: 13047 - DNA, 306 bp, Artificial Sequence
  Description of Artificial Sequence: Synthetic coding sequence
atgagcgccaccgtggtggacgccgtgaacgccgcccccctgagcggcagcaaggagatgagcctggaggagcccaagaagatgaccagagaggactggagaaagaagaaggagctggaggagcagagaaagctgggcaacgcccccgccgaggtggacgaggagggcaaggacatcaacccccacatcccccagtacatcagcagcgtgccctggtacatcgaccccagcaagagacccaccctgaagcaccagagaccccagcccgagaagcagaagcagttcagcagcagcggcgagtggtag

SEQ ID NO: 13048 - DNA, 3201 bp, Artificial Sequence
  Description of Artificial Sequence: Synthetic coding sequence
atggccggcgccctgagaagaggcagagccctgggcagcagacccagcggccccaccgtgagcagcagaagaagcccccagtgccccgtggcccaggagggcctgggcgccagaagcagacccagagtggcccccagaagcctggccagatgcggccccagcagcagactgatgggctggaagcccagcgaggccagaggccagagccagagcttccaggccagcggcctgcagcccagaagcctgaaggccgccagaagagccaccggcagacccgacagaagcagagccgccagacccaccatggaccccagcgcccacagaagcagagccgccccccccaacatggaccccgacccccaggccggcgtgcaggtgggcatgagagtggtgagaggcgtggactggaagtggggccagcaggacggcggcgagggcggcgtgggcaccgtggtggagctgggcagacacggcagccccagcacccccgacagaaccgtggtggtgcagtgggaccagggcaccagaaccaactacagagccggctaccagggcgcccacgacctgctgctgtacgacaacgcccagatcggcgtgagacaccccaacatcatctgcgactgctgcaagaagcacggcctgagaggcatgagatggaagtgcagagtgtgcctggactacgacctgtgcacccagtgctacatgcacaacaagcacgagctggcccacgccttcgacagatacgagaccgcccacagcagacccgtgaccctgagccccagacagggcctgcccagaatccccctgagaggcatcttccagggcgccaaggtggtgagaggccccgactgggagtggggcagccaggacggcggcgagggcaagcccggcagagtggtggacatcagaggctgggacgtggagaccggcagaagcgtggccagcgtgacctgggccgacggcaccaccaacgtgtacagagtgggccacaagggcaaggtggacctgaagtgcgtgggcgaggccgccggcggcttctactacaaggaccacctgcccagactgggcaagcccgccgagctgcagagaagagtgagcgccgacagccagcccttccagcacggcgacaaggtgaagtgcctgctggacaccgacgtgctgagagagatgcaggagggccacggcggctggaaccccagaatggccgagaccggcaccgtgcacagaatcaccgacagaggcgacgtgagagtgcagttcaaccacgagaccagatggaccttccaccccggcgccctgaccaagcaccacagcttctgggtgggcgacgtggtgagagtgatcggcgacctggacaccgtgaagagactgcaggccggccacggcgagtggaccgacgacatggcccccgccctgggcagagtgggcaaggtggtgaaggtgttcggcgacggcaacctgagagtggccgtggccggccagagatggaccttcagccccagctgcctggtggcctacagacccgaggaggacgccaacctggacgtggccgagagagccagagagaacaagagcagcctgagcgtggccctggacaagctgagagcccagaagagcgaccccgagcaccccggcagactggtggtggaggtggccctgggcaacgccgccagagccctggacctgctgagaagaagacccgagcaggtggacaccaagaaccagggcagaaccgccctgcaggtggccgcctacctgggccaggtggagctgatcagactgctgctgcaggccagagccggcgtggacctgcccgacgacgagggcaacaccgccctgcactacgccgccctgggcaaccagcccgaggccaccagagtgctgctgagcgccggctgcagagccgacgccatcaacagcacccagagcaccgccctgcacgtggccgtgcagagaggcttcctggaggtggtgagagccctgtgcgagagaggctgcgacgtgaacctgcccgacgcccacagcgacacccccctgcacagcgccatcagcgccggcaccggcgccagcggcatcgtggaggtgctgaccgaggtgcccaacatcgacgtgaccgccaccaacagccagggcttcaccctgctgcaccacgccagcctgaagggccacgccctggccgtgagaaagatcctggccagagccagacagctggtggacgccaagaaggaggacggcttcaccgccctgcacctggccgccctgaacaaccacagagaggtggcccagatcctgatcagagagggcagatgcgacgtgaacgtgagaaacagaaagctgcagagccccctgcacctggccgtgcagcaggcccacgtgggcctggtgcccctgctggtggacgccggctgcagcgtgaacgccgaggacgaggagggcgacaccgccctgcacgtggccctgcagagacaccagctgctgcccctggtggccgacggcgccggcggcgaccccggccccctgcagctgctgagcagactgcaggccagcggcctgcccggcagcgccgagctgaccgtgggcgccgccgtggcctgcttcctggccctggagggcgccgacgtgagctacaccaaccacagaggcagaagccccctggacctggccgccgagggcagagtgctgaaggccctgcagggctgcgcccagagattcagagagagacaggccggcggcggcgccgcccccggccccagacagaccctgggcacccccaacaccgtgaccaacctgcacgtgggcgccgcccccggccccgaggccgccgagtgcctggtgtgcagcgagctggccctgctggtgctgttcagcccctgccagcacagaaccgtgtgcgaggagtgcgccagaagaatgaagaagtgcatcagatgccaggtggtggtgagcaagaagctgagacccgacggcagcgaggtggccagcgccgcccccgcccccggcccccccagacagctggtggaggagctgcagagcagatacagacagatggaggagagaatcacctgccccatctgcatcgacagccacatcagactggtgttccagtgcggccacggcgcctgcgccccctgcggcagcgccctgagcgcctgccccatctgcagacagcccatcagagacagaatccagatcttcgtgtag

SEQ ID NO: 13049 - DNA, 348 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagagattcttcagcgactgcaagatccagaacggcgcccagggcatcagattcatctacaccagagagggcagacccagcggcgaggccttcgtggagctggagagcgaggacgaggtgaagctggccctgaagaaggacagagagaccatgggccacagatacgtggaggtgttcaagagcaacaacgtggagatggactgggtgctgaagcacaccggccccaacagccccgacaccgccaacgacggcttcgtgagactgtag

SEQ ID NO: 13050 - DNA, 375 bp, Artificial Sequence
  Description of Artificial Sequence: Synthetic coding sequence
atggccagcgtgctgagcagaagactgggcaagagaagcctgctgggcgccagagtgctgggccccagcgccagcgagggccccagcgccgccccccccagcgagcccctgctggagggcgccgccccccagcccttcaccaccagcgacgacaccccctgccaggagcagcccaaggaggtgctgaaggcccccagcaccagcggcctgcagcaggtggccttccagcccggccagaaggtgtacgtgtggtacggcggccaggagtgcaccggcctggtggagcagcacagctggatggagggccaggtgaccgtgtggctgctggagcagaagctgcaggtgtgctgcagagtggaggaggtgtggctgtag

SEQ ID NO: 13051 - DNA, 438 bp, Artificial Sequence; identical to SEQ ID NO: 9483
  Description of Artificial Sequence: Synthetic coding sequence

SEQ ID NO: 13052 - DNA, 339 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagtag

SEQ ID NO: 13053 - DNA, 345 bp, Artificial Sequence
  Description of Artificial Sequence: Synthetic coding sequence
atgcccagcgccgaggccaagctgaagaagaacagatgcgccaactgcttcgactgccccggctgcatgcacaccctgagcaccagagccaccagcatcagcacccagctgcccgacgaccccgccaagaccaccatgaagaaggcctactacctggcctgcggcttctgcagatggaccagcagagacgtgggcatggccgacaagagcgtggccagcggcggctggcaggagcccgagaacccccacacccagagaatgaacaagctgatcgagtactaccagcagctggcccagaaggagaaggtggagagagacagaaagaagctggccagaagaagatag

SEQ ID NO: 13054 - DNA, 648 bp, Artificial Sequence
  Description of Artificial Sequence: Synthetic coding sequence
atgcccggcgaggccaccgagaccgtgcccgccaccgagcaggagctgccccagagccaggccgagaccggcagcggcaccgccagcgacagcggcgagagcgtgcccggcatcgaggagcaggacagcacccagaccaccacccagaaggcctggctggtggccgccgccgagatcgacgaggagcccgtgggcaaggccaagcagagcagaagcgagaagagagccagaaaggccatgagcaagctgggcctgctgcaggtgaccggcgtgaccagagtgaccatctggaagagcaagaacatcctgttcgtgatcaccaagctggacgtgtacaagagccccgccagcgacgcctacatcgtgttcggcgaggccaagatccaggacctgagccagcaggcccagctggccgccgccgagaagttcagagtgcagggcgaggccgtgggcaacatccaggagaacacccagacccccaccgtgcaggaggagagcgaggaggaggaggtggacgagaccggcgtggaggtgaaggacgtgaagctggtgatgagccaggccaacgtgagcagagccaaggccgtgagagccctgaagaacaacagcaacgacatcgtgaacgccatcatggagctgaccgtgtag

SEQ ID NO: 13055 - DNA, 432 bp, Artificial Sequence
  Description of Artificial Sequence: Synthetic coding sequence
atgagcgccaccgtggtggacgccgtgaacgccgcccccctgagcggcagcaaggagatgagcctggaggagcccaagaagatgaccagagaggactggagaaagaagaaggagctggaggagcagagaaagctgggcaacgcccccgccgaggtggacgaggagggcaaggacatcaacccccacatcccccagtacatcagcagcgtgccctggtacatcgaccccagcaagagacccaccctgaagcaccagagaccccagcccgagaagcagaagcagttcagcagcagcggcgagtggtacaagagaggcgtgaaggagaacagcatcatcaccaagtacagaaagggcgcctgcgagaactgcggcgccatgacccacaagaagaaggactgcttcgagagacccagaagagtgggcgccaagtag

SEQ ID NO: 13056 - DNA, 567 bp, Artificial Sequence
  Description of Artificial Sequence: Synthetic coding sequence
atggccagcgtgctgagcagaagactgggcaagagaagcctgctgggcgccagagtgctgggccccagcgccagcgagggccccagcgccgccccccccagcgagcccctgctggagggcgccgccccccagcccttcaccaccagcgacgacaccccctgccaggagcagcccaaggaggtgctgaaggcccccagcaccagcggcctgcagcaggtggccttccagcccggccagaaggtgtacgtgtggtacggcggccaggagtgcaccggcctggtggagcagcacagctggatggagggccaggtgaccgtgtggctgctggagcagaagctgcaggtgtgctgcagagtggaggaggtgtggctggccgagctgcagggcccctgcccccaggccccccccctggagcccggcgcccaggccctggcctacagacccgtgagcagaaacatcgacgtgcccaagagaaagagcgacgccgtggagatggacgagatgatggccgccatggtgctgaccagcctgagctgcagccccgtggtgcagagcccccccggctag

SEQ ID NO: 13057 - DNA, 87 bp, Artificial Sequence
  Description of Artificial Sequence: Synthetic coding sequence
atgatgctgggcaccgagggcggcgagggcttcgtggtgaaggtgagaggcctgccctggagctgcagcgccgacgaggtgcagtag

SEQ ID NO: 13058 - DNA, 87 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaactag

SEQ ID NO: 13059 - DNA, 1074 bp, Artificial Sequence; identical to SEQ ID NO: 10529
  Description of Artificial Sequence: Synthetic coding sequence

SEQ ID NO: 13060 - DNA, 483 bp, Artificial Sequence
  Description of Artificial Sequence: Synthetic coding sequence
atgcccagcatcaagctgcagagcagcgacggcgagatcttcgaggtggacgtggagatcgccaagcagagcgtgaccatcaagaccatgctggaggacctgggcatggacgacgagggcgacgacgaccccgtgcccctgcccaacgtgaacgccgccatcctgaagaaggtgatccagtggtgcacccaccacaaggacgacccccccccccccgaggacgacgagaacaaggagaagagaaccgacgacatccccgtgtgggaccaggagttcctgaaggtggaccagggcaccctgttcgagctgatcctggccgccaactacctggacatcaagggcctgctggacgtgacctgcaagaccgtggccaacatgatcaagggcaagacccccgaggagatcagaaagaccttcaacatcaagaacgacttcaccgaggaggaggaggcccaggtgggcagcacccagttctgcctgtag

SEQ ID NO: 13061 - DNA, 342 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaagtag

SEQ ID NO: 13062 - DNA, 309 bp, Artificial Sequence
  Description of Artificial Sequence: Synthetic coding sequence
atggccagcgtgctgagcagaagactgggcaagagaagcctgctgggcgccagagtgctgggccccagcgccagcgagggccccagcgccgccccccccagcgagcccctgctggagggcgccgccccccagcccttcaccaccagcgacgacaccccctgccaggagcagcccaaggaggtgctgaaggcccccagcaccagcggcctgcagcaggtggccttccagcccggccagaaggtgtacgtgtggtacggcggccaggagtgcaccggcctggtggagcagcacagctggatggagggctag

SEQ ID NO: 13063 - DNA, 492 bp, Artificial Sequence; identical to SEQ ID NO: 10357
  Description of Artificial Sequence: Synthetic coding sequence

SEQ ID NO: 13064 - DNA, 441 bp, Artificial Sequence
  Description of Artificial Sequence: Synthetic coding sequence
atgtgccccggcaactggctgtgggccagcatgaccttcatggccagattcagcagaagcagcagcagaagccccgtgagaaccagaggcaccctggaggagatgcccaccgtgcagcaccccttcctgaacgtgttcgagctggagagactgctgtacaccggcaagaccgcctgcaaccacgccgacgaggtgtggcccggcctgtacctgggcgaccaggacatggccaacaacagaagagagctgagaagactgggcatcacccacgtgctgaacgccagccacagcagatggagaggcacccccgaggcctacgagggcctgggcatcagatacctgggcgtggaggcccacgacagccccgccttcgacatgagcatccacttccagaccgccgccgacttcatccacagagccctgagccagcccggcggctag

SEQ ID NO: 13065 - DNA, 1542 bp, Artificial Sequence; identical to SEQ ID NO: 10287
  Description of Artificial Sequence: Synthetic coding sequence

SEQ ID NO: 13066 - DNA, 438 bp, Artificial Sequence
  Description of Artificial Sequence: Synthetic coding sequence
atggccgtgagcaccggcgtgaaggtgcccagaaacttcagactgctggaggagctggaggagggccagaagggcgtgggcgacggcaccgtgagctggggcctggaggacgacgaggacatgaccctgaccagatggaccggcatgatcatcggcccccccagaaccaactacgagaacagaatctacagcctgaaggtggagtgcggccccaagtaccccgaggccccccccagcgtgagattcgtgaccaagatcaacatgaacggcatcaacaacagcagcggcatggtggacgccagaagcatccccgtgctggccaagtggcagaacagctacagcatcaaggtggtgctgcaggagctgagaagactgatgatgagcaaggagaacatgaagctgccccagccccccgagggccagacctacaacaactag

SEQ ID NO: 13067 - DNA, 1542 bp, Artificial Sequence; identical to SEQ ID NO: 10287
  Description of Artificial Sequence: Synthetic coding sequence

SEQ ID NO: 13068 - DNA, 57 bp, Artificial Sequence
  Description of Artificial Sequence: Synthetic coding sequence
atgcccagcatcaagctgcagagcagcgacggcgagatcttcgaggtggacgtgtag

SEQ ID NO: 13069 - DNA, 1935 bp, Artificial Sequence
  Description of Artificial Sequence: Synthetic coding sequence
  Description of Combined DNA/RNA Molecule: Synthetic coding sequence
gtggccagcgagggcagcgtgagaagacccagcggccccgtgcccgccccccagccccccgccttcagattcgtgagcagacccggcagagccagaagcgagagcgagaccctggagagaagccccccccagagccccggccccggcaaggccggcgacgcccccaacagaagaagcggccacgtgagaggcgccagagtgctgagcccccccggcagaagagccagactgagcagccccggccccagcagaagcagcgaggccagagaggagctgagaagacacctggtgggcctgatcgagagaagcagagtggtgatcttcagcaagagctactgcccccacagcaccagagtgaaggagctgttcagcagcctgggcgtggagtgcaacgtgctggagctggaccaggtggacgacggcgccagagtgcaggaggtgctgagcgagatcaccaaccagaagaccgtgcccaacatcttcgtgaacaaggtgcacgtgggcggctgcgaccagaccttccaggcctaccagagcggcctgctgcagaagctgctgcaggaggacctggcctacgactacgacctgatcatcatcggcggcggcagcggcggcctgagctgcgccaaggaggccgccatcctgggcaagaaggtgatggtgctggacttcgtggtgcccagcccccagggcaccagctggggcctgggcggcacctgcgtgaacgtgggctgcatccccaagaagctgatgcaccaggccgccctgctgggccaggccctgtgcgacagcagaaagttcggctgggagtacaaccagcaggtgagacacaactgggagaccatgaccaaggccatccagaaccacatcagcagcctgaactggggctacagactgagcctgagagagaaggccgtggcctacgtgaacagctacggcgagttcgtggagcaccacaagatcaaggccaccaacaagaagggccaggagacctactacaccgccgcccagttcgtgatcgccaccggcgagagacccagatacctgggcatccagggcgacaaggagtactgcatcaccagcgacgacctgttcagcctgccctactgccccggcaagaccctggtggtgggcgccagctacgtggccctggagtgcgccggcttcctggccggcttcggcctggacgtgaccgtgatggtgagaagcatcctgctgagaggcttcgaccaggagatggccgagaaggtgggcagctacatggagcagcacggcgtgaagttcctgagaaagttcatccccgtgatggtgcagcagctggagaagggcagccccggcaagctgaaggtgctggccaagagcaccgagggcaccgagaccatcgagggcgtgtacaacaccgtgctgctggccatcggcagagacagctgcaccagaaagatcggcctggagaagatcggcgtgaagatcaacgagaagagcggcaagatccccgtgaacgacgtggagcagaccaacgtgccctacgtgtacgccgtgggcgacatcctggaggacaagcccgagctgacccccgtggccatccagagcggcaagctgctggcccagagactgttcggcgccagcctggagaagatctaccacaccctgttctggcccctggagtggaccgtggccggcagagagaacaacacctgctacgccaagatcatctgcaacaagttcgaccacgacagagtgatcggcttccacatcctgggccccaacgccggcgaggtgacccagggcttcgccgccgccatgaagtgcggcctgaccaagcagctgctggacgacaccatcggcatccaccccacctgcggcgaggtgttcaccaccctggagatcaccaagagcagcggcctggacatcacccagaagggctgcugaggctag

SEQ ID NO: 13070 - DNA, 1338 bp, Artificial Sequence
  Description of Artificial Sequence: Synthetic coding sequence
atgaacaagggcatcagcagcatccccatcaacctgagagtgtacagcccccacgtgctgaacctgaccctgatcgacctgcccggcatcaccaaggtgcccgtgggcgaccagccccccgacatcgagtaccagatcagagagatgatcatgcagttcatcaccagagagaactgcctgatcctggccgtgacccccgccaacaccgacctggccaacagcgacgccctgaagctggccaaggaggtggacccccagggcctgagaaccatcggcgtgatcaccaagctggacctgatggacgagggcaccgacgccagagacgtgctggagaacaagctgctgcccctgagaagaggctacgtgggcgtggtgaacagaagccagaaggacatcgacggcaagaaggacatcaaggccgccatgctggccgagagaaagttcttcctgagccaccccgcctacagacacatcgccgacagaatgggcaccccccacctgcagaaggtgctgaaccagcagctgaccaaccacatcagagacaccctgcccaacttcagaaacaagctgcagggccagctgctgagcatcgagcacgaggtggaggcctacaagaacttcaagcccgaggaccccaccagaaagaccaaggccctgctgcagatggtgcagcagttcgccgtggacttcgagaagagaatcgagggcagcggcgaccaggtggacaccctggagctgagcggcggcgccaagatcaacagaatcttccacgagagattccccttcgagatcgtgaagatggagttcaacgagaaggagctgagaagagagatcagctacgccatcaagaacatccacggcatcagaaccggcctgttcacccccgacatggccttcgaggccatcgtgaagaagcagatcgtgaagctgaagggccccagcctgaagagcgtggacctggtgatccaggagctgatcaacaccgtgaagaagtgcaccaagaagctggccaacttccccagactgtgcgaggagaccgagagaatcgtggccaaccacatcagagagagagagggcaagaccaaggaccaggtgctgctgctgatcgacatccaggtgagctacatcaacaccaaccacgaggacttcatcggcttcgccaacgcccagcagagaagcagccaggtgcacaagaagaccaccgtgggcaaccaggtgatcagaaagggctggctgaccatcagcaacatcggcatcatgaagggcggcagcaagggctactggttcgtgctgaccgccgagagcctgagctggtacaaggacgacgaggagaagtag

SEQ ID NO: 13071 - DNA, 1560 bp, Artificial Sequence
  Description of Artificial Sequence: Synthetic coding sequence
atgctgcagctgatggacagcggcatcaccatctgcctgagaaacggcgccgccagcgtgttcaagaagaaggagtggagcacccagggcgaggagaacaagcaggacagcaagctgaagaagctgagcgaggacagcctgaccaagcagcccgaggaggtgttcgacgtgctggagaagctgggcgagggcagctacggcagcgtgttcaaggccatccacaaggagagcggccaggtggtggccatcaagcaggtgcccgtggagagcgacctgcaggagatcatcaaggagatcagcatcatgcagcagtgcgacagcccctacgtggtgaagtactacggcagctacttcaagaacaccgacctgtggatcgtgatggagtactgcggcgccggcagcgtgagcgacatcatcagactgagaaacaagaccctgatcgaggacgagatcgccaccatcctgaagagcaccctgaagggcctggagtacctgcacttcatgagaaagatccacagagacatcaaggccggcaacatcctgctgaacaccgagggccacgccaagctggccgacttcggcgtggccggccagctgaccgacaccatggccaagagaaacaccgtgatcggcacccccttctggatggcccccgaggtgatccaggagatcggctacaactgcgtggccgacatctggagcctgggcatcaccagcatcgagatggccgagggcaagcccccctacgccgacatccaccccatgagagccatcttcatgatccccaccaaccccccccccaccttcagaaagcccgagctgtggagcgacgacttcaccgacttcgtgaagaagtgcctggtgaagaaccccgagcagagagccaccgccacccagctgctgcagcaccccttcatcaagaacgccaagcccgtgagcatcctgagagacctgatcaccgaggccatggagatcaaggccaagagacacgaggagcagcagagagagctggaggaggaggaggagaacagcgacgaggacgagctggacagccacaccatggtgaagaccagcgtggagagcgtgggcaccatgagagccaccagcaccatgagcgagggcgcccagaccatgatcgagcacaacagcaccatgctggagagcgacctgggcaccatggtgatcaacagcgaggacgaggaggaggaggacggcaccatgaagagaaacgccaccagcccccaggtgcagagacccagcttcatggactacttcgacaagcaggacttcaagaacaagagccacgagaactgcaaccagaacatgcacgagcccttccccatgagcaagaacgtgttccccgacaactggaaggtgccccaggacggcgacttcgacttcctgaagaacctgagcctggaggagctgcagatgagactgaaggccctggaccccatgatggagagagagatcgaggagctgagacagagatacaccgccaagagacagcccatcctggacgccatggacgccaagaagagaagacagcagaacttctag

SEQ ID NO: 13072 - DNA, 1392 bp, Artificial Sequence
  Description of Artificial Sequence: Synthetic coding sequence
atgaagatcatggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaaggacatcagcatccagctgagcagcgcccagagcagatgcaccctgctggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagatcaagcacctggaggagaagctgaaggaggaggagcaccagagaaagctgttccaggacaaggccagcgagctgcagaccggcctggagatcagcaagatcatcatgagcagcgtgagcaacctgaagcacagcaaggagaagaagaagagcagcaagaagaccaagtgcatcaagagaagacccccctggcagatctgcagcaagttcggcgccctgcccttcgtggccgagaagatgagacagcacagagacccccacatcctgcagaagcccttcaacgtgaccgagaccagatgcctgcccaagcccagcagaaccaccagctggtgcaaggccatcccccccgacagcgagaagagcatcagcatctgcgacaacctgagcgagctgctgatggccatgcaggacgagctggaccagatgagcatggagcaccaggagctgctgaagcagatgaaggagaccgagagccacagcgtgtgcgacgacatcgagtgcgagctggagtgcctgctgaagaagatggagatcaagggcgagcagatcagcaagctgaagaagcaccaggacagcgtgtgcaagctgcagcagaaggtgcagaacagcaagatgagcgaggccagcggcatccagcaggaggacagctaccccaagggcagcaagaacatcaagaacagccccagaaagtgcctgaccgacaccaacctgttccagaagaacagcagcttccaccccatcagagtgcacaacctgcagatgaagctgagaagagacgacatcatgtgggagcagtag

SEQ ID NO: 13073 - DNA, 1050 bp, Artificial Sequence; identical to SEQ ID NO: 9332
  Description of Artificial Sequence: Synthetic coding sequence

SEQ ID NO: 13074 - DNA, 636 bp, Artificial Sequence; identical to SEQ ID NO: 9361
  Description of Artificial Sequence: Synthetic coding sequence

SEQ ID NO: 13075 - DNA, 438 bp, Artificial Sequence
  Description of Artificial Sequence: Synthetic coding sequence
atgatccccatctggaagcagcaggccagacccggcgacggccccgtgatctgggactaccacgtggtgctgctgcacgtgagcagcggcggccagaacttcatctacgacctggacaccgtgctgcccttcccctgcctgttcgacacctacgtggaggacgccttcaagagcgacgacgacatccacccccagttcagaagaaagttcagagtgatcagagccgacagctacctgaagaacttcgccagcgacagaagccacatgaaggacagcagcggcaactggagagagcccccccccccctacccctgcatcgagaccggcgacagcaagatgaacctgaacgacttcatcagcatggaccccaaggtgggctggggcgccgtgtacaccctgagcgagttcacccacagattcggcagcaagaactgctag

SEQ ID NO: 13076 - DNA, 258 bp, Artificial Sequence
  Description of Artificial Sequence: Synthetic coding sequence
atgagcgacaagagcgacctgaaggccgagctggagagaaagaagcagagactggcccagatcagagaggagaagaagagaaaggaggaggagagaaagaagaaggaggccgacatgcagcagaagaaggagcccgtgcaggacgacagcgacctggacagaaagagaagagagaccgaggccctgctgcagagcatcggcatcagccccgagccccccctggtgcccacccccatgagccccagcagcaagagctag

SEQ ID NO: 13077 - DNA, 588 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaaggacatcagcatccagctgagcagcgcccagagcagatgcaccctgctggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagtag

SEQ ID NO: 13078 - DNA, 1272 bp, Artificial Sequence; identical to SEQ ID NO: 10767
  Description of Artificial Sequence: Synthetic coding sequence

SEQ ID NO: 13079 - DNA, 2097 bp, Artificial Sequence
  Description of Artificial Sequence: Synthetic coding sequence
  Description of Combined DNA/RNA Molecule: Synthetic coding sequence
ggcgtgggcggcagaggcgagagactgcccagaggcttcgccagagtggtgagagtggccagcgagggcagcgtgagaagacccagcggccccgtgcccgccccccagccccccgccttcagattcgtgagcagacccggcagagccagaagcgagagcgagaccctggagagaagccccccccagagccccggccccggcaaggccggcgacgcccccaacagaagaagcggccacgtgagaggcgccagagtgctgagcccccccggcagaagagccagactgagcagccccggccccagcagaagcagcgaggccagagaggagctgagaagacacctggtgggcctgatcgagagaagcagagtggtgatcttcagcaagagctactgcccccacagcaccagagtgaaggagctgttcagcagcctgggcgtggagtgcaacgtgctggagctggaccaggtggacgacggcgccagagtgcaggaggtgctgagcgagatcaccaaccagaagaccgtgcccaacatcttcgtgaacaaggtgcacgtgggcggctgcgaccagaccttccaggcctaccagagcggcctgctgcagaagctgctgcaggaggacctggcctacgactacgacctgatcatcatcggcggcggcagcggcggcctgagctgcgccaaggaggccgccatcctgggcaagaaggtgatggtgctggacttcgtggtgcccagcccccagggcaccagctggggcctgggcggcacctgcgtgaacgtgggctgcatccccaagaagctgatgcaccaggccgccctgctgggccaggccctgtgcgacagcagaaagttcggctgggagtacaaccagcaggtgagacacaactgggagaccatgaccaaggccatccagaaccacatcagcagcctgaactggggctacagactgagcctgagagagaaggccgtggcctacgtgaacagctacggcgagttcgtggagcaccacaagatcaaggccaccaacaagaagggccaggagacctactacaccgccgcccagttcgtgatcgccaccggcgagagacccagatacctgggcatccagggcgacaaggagtactgcatcaccagcgacgacctgttcagcctgccctactgccccggcaagaccctggtggtgggcgccagctacgtggccctggagtgcgccggcttcctggccggcttcggcctggacgtgaccgtgatggtgagaagcatcctgctgagaggcttcgaccaggagatggccgagaaggtgggcagctacatggagcagcacggcgtgaagttcctgagaaagttcatccccgtgatggtgcagcagctggagaagggcagccccggcaagctgaaggtgctggccaagagcaccgagggcaccgagaccatcgagggcgtgtacaacaccgtgctgctggccatcggcagagacagctgcaccagaaagatcggcctggagaagatcggcgtgaagatcaacgagaagagcggcaagatccccgtgaacgacgtggagcagaccaacgtgccctacgtgtacgccgtgggcgacatcctggaggacaagcccgagctgacccccgtggccatccagagcggcaagctgctggcccagagactgttcggcgccagcctggagaagtgcgactacatcaacgtgcccaccaccgtgttcacccccctggagtacggctgctgcggcctgagcgaggagaaggccatcgaggtgtacaagaaggagaacctggagatctaccacaccctgttctggcccctggagtggaccgtggccggcagagagaacaacacctgctacgccaagatcatctgcaacaagttcgaccacgacagagtgatcggcttccacatcctgggccccaacgccggcgaggtgacccagggcttcgccgccgccatgaagtgcggcctgaccaagcagctgctggacgacaccatcggcatccaccccacctgcggcgaggtgttcaccaccctggagatcaccaagagcagcggcctggacatcacccagaagggctgcugaggctag

SEQ ID NO: 13080 - DNA, 609 bp, Artificial Sequence
  Description of Artificial Sequence: Synthetic coding sequence
atgaccggcagcaacagccacatcaccatcctgaccctgaaggtgctgccccacttcgagagcctgggcaagcaggagaagatccccaacaagatgagcgccttcagaaaccactgcccccacctggacagcgtgggcgagatcaccaaggaggacctgatccagaagagcctgggcacctgccaggactgcaaggtgcagggccccaacctgtgggcctgcctggagaacagatgcagctacgtgggctgcggcgagagccaggtggaccacagcaccatccacagccaggagaccaagcactacctgaccgtgaacctgaccaccctgagagtgtggtgctacgcctgcagcaaggaggtgttcctggacagaaagctgggcacccagcccagcctgccccacgtgagacagccccaccagatccaggagaacagcgtgcaggacttcaagatccccagcaacaccaccctgaagacccccctggtggccgtgttcgacgacctggacatcgaggccgacgaggaggacgagctgagagccagaggcctgaccggcctgaagaacatcggcaacacctgctacatgaacgccgccctgcaggcctag

SEQ ID NO: 13081 - DNA, 1443 bp, Artificial Sequence; identical to SEQ ID NO: 12577
  Description of Artificial Sequence: Synthetic coding sequence

SEQ ID NO: 13082 - DNA, 309 bp, Artificial Sequence; identical to SEQ ID NO: 11300
  Description of Artificial Sequence: Synthetic coding sequence

SEQ ID NO: 13083 - DNA, 318 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgcagctgagcagcaaggagaagatctggacccaggagatgctgctgcaggtgaacgaccagagcctgagactgctggactag

SEQ ID NO: 13084 - DNA, 222 bp, Artificial Sequence
  Description of Artificial Sequence: Synthetic coding sequence
atgagcgccttcagaaaccactgcccccacctggacagcgtgggcgagatcaccaaggaggacctgatccagaagagcctgggcacctgccaggactgcaaggtgcagggccccaacctgtgggcctgcctggagaacagatgcagctacgtgggctgcggcgagagccaggtggaccacagcaccatccacagccaggagaccaagcactacctgacctag

SEQ ID NO: 13085 - DNA, 276 bp, Artificial Sequence
  Description of Artificial Sequence: Synthetic coding sequence
atggccatgaccgtggtgaccaaggagaagaacaagaaggtgcccaccatcttcctgagcaagaagcccagagagaaggaggtggacagcaagagccaggtgatcgagggcatcagcagactgatctgcagcgccaagcagcagcagaccatgctgagagtgagcatcgacggcgtggagtggagcgacatcaagttcttccagctggccgcccagtggcccacccacgtgaagcacttccccgtgggcctgttcagcggcagcaaggccacctag

SEQ ID NO: 13086 - DNA, 2535 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaagagcgtgatgaagaccacctggggcgtgctggacccccccgtgggcaacaccagactgaacgtgatcagactgatcagcagcctgctgcagaccaacaccagcagcatcaacggcgacctgatggagctgaacagcatcggcgtgatcctgaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggccttcagcgactaccagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagcgaggagggcaagctgagcaccagccaggacgccgcctgcaaggacgccgaggagtgccccgagaccgccgaggccaagtgcgccgcccccagaccccccagcagcagccccgagcagagaaccggccagcccagcgcccccggcgacaccagcgtgaacggccccgtgtag

SEQ ID NO: 13087 - DNA, 2604 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaagagcgtgatgaagaccacctggggcgtgctggacccccccgtgggcaacaccagactgaacgtgatcagactgatcagcagcctgctgcagaccaacaccagcagcatcaacggcgacctgatggagctgaacagcatcggcgtgatcctgaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggtgaccacctgccacatccacagcagcagcgacgacgagatcgacttcaaggagaccggcttcagccaggacagcagcctgcagcagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagcgaggagggcaagctgagcaccagccaggacgccgcctgcaaggacgccgaggagtgccccgagaccgccgaggccaagtgcgccgcccccagaccccccagcagcagccccgagcagagaaccggccagcccagcgcccccggcgacaccagcgtgaacggccccgtgtag

SEQ ID NO: 13088 - DNA, 174 bp, Artificial Sequence
  Description of Artificial Sequence: Synthetic coding sequence
atgaccagcaagaagctggtgaacagcgtggccggctgcgccgacgacgccctggccggcctggtggcctgcaaccccaacctgcagctgctgcagggccacagagtggccctgagaagcgacctggacagcctgaagggcagagtggccctgctgagcggcggcggcagctag

SEQ ID NO: 13089 - DNA, 2709 bp, Artificial Sequence; identical to SEQ ID NO: 9700
  Description of Artificial Sequence: Synthetic coding sequence

SEQ ID NO: 13090 - DNA, 537 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttcggcagctgcctggacaccttcttcggcctgaccgccaccggcctgcacagatacatccaggaccccaacaagatccccgagaccctggacaacgacaccacccagaacctgctgaccaaggccgtggagacctgcttcgtgggccagagcttcatcttcggcgtgaccaacttcgagaaccagcccggccagggcagcgacgccagcaacttcctgcagcagtgcagcgaccacaagagaaaggccaaggccctggtggcctgccagatcgtgctgcccgaccccgccacccaggacgccaagaccaagtag

SEQ ID NO: 13091 - DNA, 441 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgcagctgcccaagcccctgagcgaggccggctag

SEQ ID NO: 13092 - DNA, 348 bp, Artificial Sequence
  Description of Artificial Sequence: Synthetic coding sequence
atggccggcagacccctgagaatcggcgaccagctggtgctggaggaggactacgacgagacctacatccccagcgagcaggagatcctggagttcgccagagagatcggcatcgaccccatcaaggagcccgagctgatgtggctggccagagagggcatcgtggcccccctgcccggcgagtggaagccctgccaggacatcaccggcgacatctactacttcaacttcgccaacggccagagcatgtgggaccacccctgcgacgagcactacagaagcctggtgatccaggagagagccaagctgagcaccagcggcgccatcaagaagaagaagaagaagtag

SEQ ID NO: 13093 - DNA, 1191 bp, Artificial Sequence
  Description of Artificial Sequence: Synthetic coding sequence
atgagaaccagctacaccgtgaccctgcccgaggacccccccgccgcccccttccccgccctggccaaggagctgagacccagaagccccctgagccccagcctgctgctgagcaccttcgtgggcctgctgctgaacaaggccaagaacagcaagagcgcccagggcctggccggcctgagaaacctgggcaacacctgcttcatgaacagcatcctgcagtgcctgagcaacaccagagagctgagagactactgcctgcagagactgtacatgagagacctgcaccacggcagcaacgcccacaccgccctggtggaggagttcgccaagctgatccagaccatctggaccagcagccccaacgacgtggtgagccccagcgagttcaagacccagatccagagatacgcccccagattcgtgggctacaaccagcaggacgcccaggagttcctgagattcctgctggacggcctgcacaacgaggtgaacagagtgaccctgagacccaagagcaaccccgagaacctggaccacctgcccgacgacgagaagggcagacagatgtggagaaagtacctggagagagaggacagcagaatcggcgacctgttcgtgggccagctgaagagcagcctgacctgcaccgactgcggctactgcagcaccgtgttcgaccccttctgggacctgagcctgcccatcgccaagagaggctaccccgaggtgaccctgatggactgcatgagactgttcaccaaggaggacgtgctggacggcgacgagaagcccacctgctgcagatgcagaggcagaaagagatgcatcaagaagttcagcatccagagattccccaagatcctggtgctgcacctgaagagattcagcgagagcagaatcagaaccagcaagctgaccaccttcgtgaacttccccctgagagacctggacctgagagagttcgccagcgagaacaccaaccacgccgtgtacaacctgtacgccgtgagcaaccacagcggcaccaccatgggcggccactacaccgcctactgcagaagccccggcaccggcgagtggcacaccttcaacgacagcagcgtgacccccatgagcagcagccaggtgagaaccagcgacgcctacctgctgttctacgagctggccagcccccccagcagaatgtag

SEQ ID NO: 13094 - DNA, 633 bp, Artificial Sequence; identical to SEQ ID NO: 10549
  Description of Artificial Sequence: Synthetic coding sequence

SEQ ID NO: 13095 - DNA, 1428 bp, Artificial Sequence
  Description of Artificial Sequence: Synthetic coding sequence
atggagctgtggcaggccgccctgagcaccctgaaccccaaccccaccgacagctgccccctgtacctgaactacgccaccgtggccgccctgccctgcagagtgagcagacacaacagccccagcgccgcccacttcatcaccagactggtgagaacctgcctgccccccggcgcccacagatgcatcgtgatggtgtgcgagcagcccgaggtgttcgccagcgcctgcgccctggccagagccttccccctgttcacccacagaagcggcgccagcagaagactggagaagaagaccgtgaccgtggagttcttcctggtgggccaggacaacggccccgtggaggtgagcaccctgcagtgcctggccaacgccaccgacggcgtgagactggccgccagaatcgtggacaccccctgcaacgagatgaacaccgacaccttcctggaggagatcaacaaggtgggcaaggagctgggcatcatccccaccatcatcagagacgaggagctgaagaccagaggcttcggcggcatctacggcgtgggcaaggccgccctgcacccccccgccctggccgtgctgagccacacccccgacggcgccacccagaccatcgcctgggtgggcaagggcatcgtgtacgacaccggcggcctgagcatcaagggcaagaccaccatgcccggcatgaagagagactgcggcggcgccgccgccgtgctgggcgccttcagagccgccatcaagcagggcttcaaggacaacctgcacgccgtgttctgcctggccgagaacagcgtgggccccaacgccaccagacccgacgacatccacctgctgtacagcggcaagaccgtggagatcaacaacaccgacgccgagggcagactggtgctggccgacggcgtgagctacgcctgcaaggacctgggcgccgacatcatcctggacatggccaccctgaccggcgcccagggcatcgccaccggcaagtaccacgccgccgtgctgaccaacagcgccgagtgggaggccgcctgcgtgaaggccggcagaaagtgcggcgacctggtgcaccccctggtgtactgccccgagctgcacttcagcgagttcaccagcgccgtggccgacatgaagaacagcgtggccgacagagacaacagccccagcagctgcgccggcctgttcatcgccagccacatcggcttcgactggcccggcgtgtgggtgcacctggacatcgccgcccccgtgcacgccggcgagagagccaccggcttcggcgtggccctgctgctggccctgttcggcagagccagcgaggaccccctgctgaacctggtgagccccctgggctgcgaggtggacgtggaggagggcgacctgggcagagacagcaagagaagaagactggtgtag

SEQ ID NO: 13096 - DNA, 537 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgcagctgcccaagcccctgagcgaggccgacgtgagagtgctggaggagcaggcccagaacctgggcctggagggcaccctggtgagcctggccagagtgccccaggccagagccgtgagagtggtgtag

SEQ ID NO: 13097 - DNA, 1893 bp, Artificial Sequence
  Description of Artificial Sequence: Synthetic coding sequence
atggagaaggtgctgggctgcgagctgctgaagggcctgaacgtgctggacctgggcctgaacatggagatcctggaggagcagatgctgcacgagatcctgtgcagagagtaccccgagctggagaccagatggcaggacctgaagatcagagccctggacacctgcaaggccgtggaggccgccgaggagagactgctgaccatgctgctgttccagaaccccaagagacagaagcccgccaagttcctgagaaacatcgtgagagcccagggcaagctgtgccagctgagagcccactgcgaggagctggagggccagaagctgcaggagatggtgctgtgggccccctacagacccgtggtgtggcacggcatggccatggtgaaggccctgagccagctgcagaacctgctgcccctgttctgcatgagccccgagaactggctggccgtgaccaagcaggccctggacagcatgaagcccagagagatcaaccacggcgaggacctggccagccacctgctgcagctgagagcccacctgaccagacagctgctgggcagcaccgtgaccgccctgggcctgacccaggtgcccctggtgggcgccctgggcgccctggccctgctgcaggccaccggcaaggccagcgagctggagagactggccctgtggcccggcctggccgccagccccagcaccgtgcacagcaagcccgtgagcgacgtggccagacccgcctggctgggccccaaggcctggcacgagtgcgagatgctggagctgctgccccccttcgtgggcctgtgcgccagcctggccggccacagcagcgcctggcaggcctacctgagcctgagcagcaccgtgctgggccccgcccccggccccggccccgagcccctgagcctgctgcagaagctgatcctgtggagagtgctgagacccgagtgcctggccggcgccctggccgacttcaccaccagcctgctgggcagacccctggacgagaacacctacgcccccaccatgcccttcaagcacagccaggccacccagcccatgctgatcctgctgcccccccccggccaccccagcgccaccctgcaccccctgaccgtgatccagaagctggccgccaagtaccagcagggccagaagcagctgcaggtgatcgccctgggcagcgaggcctgggaccccgtgagcgtggtggtgagcaccctgagccaggccatgtacgagggccactggctggtgctggacaactgccacctgatgccccactggcccaaggagctgctgcagctgctgctggagctgctgggcagagccaaggtggtggccgacctggagagcgagcagctgctggaccagcccgagagcagaaacgtgagcaccgtgcacagagacttcagactgtggctgatcgtgcccgccgagagcagcgccagcctgcccgccgtgctgacccagcacagcatgcccgtgttctggaaccagagcctggagctgggccacgtgctgatcgacagcgtggagctggcccagcaggtgctgtacatgcagccccccacccaggccctgcccctgctgctgctgcacggcctgctgctgcacagacagctgtacggcaccagactgcaggcccacagaggcagatggagccaggtgaccctgacccaggtgctgcagacccaggaccagctgtgggccagcctgagcaaccccagagccgccatgcaggagctggccggcgagaccctgcccctgcccctgggcgtgatcagcccccaggagagcctggaggagggcggcggcggcatccagttcaccgccctggtgctggccgtggtggagaccgagggcaccggcaccgagagactgtag

SEQ ID NO: 13098 - DNA, 1488 bp, Artificial Sequence
  Description of Artificial Sequence: Synthetic coding sequence
atggagctgcacggcggcaacagaggcggctaccagcccaaggccctggagcagagcggctgctggctgtggcaggccgccctgagcaccctgaaccccaaccccaccgacagctgccccctgtacctgaactacgccaccgtggccgccctgccctgcagagtgagcagacacaacagccccagcgccgcccacttcatcaccagactggtgagaacctgcctgccccccggcgcccacagatgcatcgtgatggtgtgcgagcagcccgaggtgttcgccagcgcctgcgccctggccagagccttccccctgttcacccacagaagcggcgccagcagaagactggagaagaagaccgtgaccgtggagttcttcctggtgggccaggacaacggccccgtggaggtgagcaccctgcagtgcctggccaacgccaccgacggcgtgagactggccgccagaatcgtggacaccccctgcaacgagatgaacaccgacaccttcctggaggagatcaacaaggtgggcaaggagctgggcatcatccccaccatcatcagagacgaggagctgaagaccagaggcttcggcggcatctacggcgtgggcaaggccgccctgcacccccccgccctggccgtgctgagccacacccccgacggcgccacccagaccatcgcctgggtgggcaagggcatcgtgtacgacaccggcggcctgagcatcaagggcaagaccaccatgcccggcatgaagagagactgcggcggcgccgccgccgtgctgggcgccttcagagccgccatcaagcagggcttcaaggacaacctgcacgccgtgttctgcctggccgagaacagcgtgggccccaacgccaccagacccgacgacatccacctgctgtacagcggcaagaccgtggagatcaacaacaccgacgccgagggcagactggtgctggccgacggcgtgagctacgcctgcaaggacctgggcgccgacatcatcctggacatggccaccctgaccggcgcccagggcatcgccaccggcaagtaccacgccgccgtgctgaccaacagcgccgagtgggaggccgcctgcgtgaaggccggcagaaagtgcggcgacctggtgcaccccctggtgtactgccccgagctgcacttcagcgagttcaccagcgccgtggccgacatgaagaacagcgtggccgacagagacaacagccccagcagctgcgccggcctgttcatcgccagccacatcggcttcgactggcccggcgtgtgggtgcacctggacatcgccgcccccgtgcacgccggcgagagagccaccggcttcggcgtggccctgctgctggccctgttcggcagagccagcgaggaccccctgctgaacctggtgagccccctgggctgcgaggtggacgtggaggagggcgacctgggcagagacagcaagagaagaagactggtgtag

SEQ ID NO: 13099 - DNA, 618 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccctag

SEQ ID NO: 13100 - DNA, 117 bp, Artificial Sequence
  Description of Artificial Sequence: Synthetic coding sequence
atggccgccttcaagctggacttcctgcccgagatgatggtggaccactgcagcctgaacagcagccccgtgagcaagaagatgaacggcaccctggaccaccccgaccagccctag

SEQ ID NO: 13101 - DNA, 1554 bp, Artificial Sequence; identical to SEQ ID NO: 9849
  Description of Artificial Sequence: Synthetic coding sequence

SEQ ID NO: 13102 - DNA, 768 bp, Artificial Sequence
  Description of Artificial Sequence: Synthetic coding sequence
atggagagaagcggccagagagtgaccacctgggactgcgaccagggcaagcacagcgacagcgcccagaagaacgagagagagagcatcagacagaagctggccctgggcagcttcttcgacgacggccccggcatctacaccagctgcagcaagagcggcaagcccagcctgagcagcagactgcagagcggcatgaacctgcagatctgcttcgtgaacgacagcggcagcgacaaggacagcgacgccgacgacagcaagaccgagaccagcctggacacccccctgagccccatgagcaagcagagcagcagctacagcgacagagacaccaccgaggaggagagcgagagcctggacgacatggacttcctgaccagacagaagaagctgcaggccgaggccaagatggccctggccatggccaagcccatggccaagatgcaggtggaggtggagaagcagaacagaaagaagagccccgtggccgacctgctgccccacatgccccacatcagcgagtgcctgatgaagagaagcctgaagcccaccgacctgagagacatgaccatcggccagctgcaggtgatcgtgaacgacctgcacagccagatcgagagcctgaacgaggagctggtgcagctgctgctgatcagagacgagctgcacaccgagcaggacgccatgctggtggacatcgaggacctgaccagacacgccgagagccagcagaagcacatggccgagaagatgcccgccaagtag

SEQ ID NO: 13103 - DNA, 78 bp, Artificial Sequence
  Description of Artificial Sequence: Synthetic coding sequence
atgagccagagcggcgccgtgagctgctgccccggcgccaccaacggcagcctgggcagaagcgacggcgtggcctag

SEQ ID NO: 13104 - DNA, 360 bp, Artificial Sequence
  Description of Artificial Sequence: Synthetic coding sequence
atggtgctggagggcaaccccgaggtgggcagccccagaaccagcgacctgcagcacagaggcaacaagggcagctgcgtgctgagcagccccggcgaggacgcccagcccggcgaggagcccatcaagtacggcgagctgatcgtgctgggctgctgcgaggagggcggcgaggagaccgaggcccagagaggcgaggtgaccggccccagagcccacagctgctacaacggctgcctggccagcggcgacaagggcagaagaagaagcagactggccctgagcagaagaagccacgccaacggcgtgaagcccgacgtgatgcaccacatcagcacccccctggtgagcaaggcctag

SEQ ID NO: 13105 - DNA, 348 bp, Artificial Sequence; identical to SEQ ID NO: 13092
  Description of Artificial Sequence: Synthetic coding sequence

SEQ ID NO: 13106 - DNA, 471 bp, Artificial Sequence
  Description of Artificial Sequence: Synthetic coding sequence
atgagcagcgtgcagagccagcaggagcagctgagccagagcgaccccagccccagccccaacagctgcagcagcttcgagctgatcgacatggacgccggcagcctgtacgagcccgtgagcccccactggttctactgcaagatcatcgacagcaaggagacctggatccccttcaacagcgaggacagccagcagctggaggaggcctacagcagcggcaagggctgcaacggcagagtggtgcccaccgacggcggcagatacgacgtgcacctgggcgagagaatgagatacgccgtgtactgggacgagctggccagcgaggtgagaagatgcacctggttctacaagggcgacaaggacaacaagtacgtgccctacagcgagagcttcagccaggtgctggaggagacctacatgctggccgtgaccctggacgagtggaagaagaagctggagagcccctag

SEQ ID NO: 13107 - DNA, 14262 bp, Artificial Sequence; identical to SEQ ID NO: 9351
  Description of Artificial Sequence: Synthetic coding sequence

SEQ ID NO: 13108 - DNA, 390 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagcccctag

SEQ ID NO: 13109 - DNA, 867 bp, Artificial Sequence
  Description of Artificial Sequence: Synthetic coding sequence
atggagagagagcccagcgccagcgaggccgcccccgccgccgccgccctgttcgcctggggcgccaacagctacggccagctgggcctgggccacaaggaggacgtgctgctgccccagcagctgaacgacttctgcaagcccagaagcgtgagaagaatcaccggcggcggcggccacagcgccgtggtgaccgacggcggcgacctgttcgtgtgcggcctgaacaaggacggccagctgggcctgggccacaccgaggacatcccctacttcaccccctgcaagagcctgttcggctgccccatccagcaggtggcctgcggctgggacttcaccatcatgctgaccgagaacggccaggtgctgagctgcggcagcaacagcttcggccagctgggcgtgccccacggccccagaagatgcgtggtgccccaggccatcgagctgcacaaggagaaggtggtgtgcatcgccgccggcctgagacacgccgtggccgccaccgccagcggcatcgtgttccagtggggcaccggcctggccagctgcggcagaagactgtgccccggccagaccctgcccctgttcttcaccgccaaggagcccagcagagtgaccggcctggagaacagcaaggccatgtgcgtgctggccggcagcgaccacagcgccagcctgaccgacgccggcgaggtgtacgtgtggggcagcaacaagcacggccagctggccaacgaggccgccttcctgcccgtgccccagaagatcgaggcccactgcttccagaacgagaaggtgaccgccatctggagcggctggacccacctggtggcccagaccggcctgctgtggctgagagcctag

SEQ ID NO: 13110 - DNA, 372 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttcggcagctgcctggacaccttcttcggcctgaccgccaccggcctgcacagatacatccaggaccccaacaagatccccgagaccctggacaacgacaccacccagaacctgctgaccaaggccgtggagacctgcttcgtgggctag

SEQ ID NO: 13111 - DNA, 324 bp, Artificial Sequence
  Description of Artificial Sequence: Synthetic coding sequence
atgctgagactgtaccccggccccatggtgaccgaggccgagggcaagggcggccccgagatggccagcctgagcagcagcgtggtgcccgtgagcttcatcagcaccctgagagagagcgtgctggaccccggcgtgggcggcgagggcgccagcgacaagcagagaagcaagctgagcctgagccacagcatgatccccgccgccaagatccacaccgagctgtgcctgcccgccttcttcagccccgccggcacccagagaagattccagcagccccagcaccacctgaccctgagcatcatccacaccgccgccagatag

SEQ ID NO: 13112 - DNA, 1653 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccccccatcatgggcatcatcatcgaccacttcgtggacagaccctaccccagcagcagccccatgcacccctgcaactacagaaccgccggcgaggacaccggcgtgatctaccccagcgtggaggacagccaggaggtgtgcaccaccagcttcagcaccagcccccccagccagtgcgtgttcaccgtgaccaaggcccacttccagacccccacccccgtggtgaccgacaccctgagagtgcccatggccggcctggccttcagccaccagctgagcagcagcagactgagctaccagcccgccgccctgggcgtgggcagcgccgacctggcctaccccgtggtgttcgccgccggcctgaacgccacccacccccaccagctgatggtgcccggcaaggagggcggcgtgcccctggcccccaaccagcccgtgcacggcacccaggccgaccaggagagactggccacctgcacccccagcgacagaacccactgcgccgccacccccagcagcagcgaggacaccgagaccgtgagcaacagcagcgagggcagagccagcccccacgacgtgctggagaccatcttcgtgagaaaggtgggcgccttcgtgaacaagcccatcaaccaggtgaccctgaccagcctggacatccccttcgccatgttcgcccccaagaacctggagctggaggacaccgaccccatggtgaacccccccgacagccccgagaccgagagccccctgcagggcagcctgcacagcgacggcagcagcggcggcagcagcggcaacacccacgacgacttcgtgatgatcgacttcaagcccgccttcagcaaggacgacatcctgcccatggacctgggcaccttctacagagagttccagaaccccccccagctgagcagcctgagcatcgacatcggcgcccagagcatggccgaggacctggacagcctgcccgagaagctggccgtgcacgagaagaacgtgagagagttcgacgccttcgtggagaccctgcagtag

SEQ ID NO: 13113 - DNA, 4104 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgagcagaggcgtggcctacagcacccacagaaccaacgcccccggcaaggacttccagggcatcagcgccgccttcagcaccgagaacggcttccacagcgtgggccacgagctggccgacaaccacatcaccagcagagactgcaacggccacctgctgaactgctacggcagaaacgagagcatcgccagcaccccccccggcgaggacagaaagagccccagagtgctgatcaagaccctgggcaagctggacggctgcctgagagtggagttccacaacggcggcaaccccagcaaggtgcccgccgaggactgcagcgagcccgtgcagctgctgagatacagccccaccctggccagcgagaccagccccgtgcccgaggccagaagaggcagcagcgccgacagcctgcccagccacagacccagccccaccgacagcagactgagaagcagcaagggcagcagcctgagcagcgagagcagctggtacgacagcccctggggcaacgccggcgagctgagcgaggccgagggcagcttcctggcccccggcatgcccgaccccagcctgcacgccagcttcccccccggcgacgccaagaagcccttcaaccagagcagcagcctgagcagcctgagagagctgtacaaggacgccaacctgggcagcctgagccccagcggcatcagactgagcgacgagtacatgggcacccacgccagcctgagcaacagagtgagcttcgccagcgacatcgacgtgcccagcagagtggcccacggcgaccccatccagtacagcagcttcaccctgccctgcagaaagcccaaggccttcgtggaggacaccgccaagaaggacagcctgaaggccagaatgagaagaatcagcgactggaccggcagcctgagcagaaagaagagaaagctgcaggagcccagaagcaaggagggcagcgactacttcgacagcagaagcgacggcctgaacaccgacgtgcagggcagcagccaggccagcgccttcctgtggagcggcggcagcacccagatcctgagccagagaagcgagagcacccacgccatcggcagcgaccccctgagacagaacatctacgagaacttcatgagagagctggagatgagcagaaccaacaccgagaacatcgagaccagcaccgagaccgccgagagcagcagcgagagcctgagcagcctggagcagctggacctgctgttcgagaaggagcagggcgtggtgagaaaggccggctggctgttcttcaagcccctggtgaccgtgcagaaggagagaaagctggagctggtggccagaagaaagtggaagcagtactgggtgaccctgaagggctgcaccctgctgttctacgagacctacggcaagaacagcatggaccagagcagcgcccccagatgcgccctgttcgccgaggacagcatcgtgcagagcgtgcccgagcaccccaagaaggagaacgtgttctgcctgagcaacagcttcggcgacgtgtacctgttccaggccaccagccagaccgacctggagaactgggtgaccgccgtgcacagcgcctgcgccagcctgttcgccaagaagcacggcaaggaggacaccctgagactgctgaagaaccagaccaagaacctgctgcagaagatcgacatggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgctag

SEQ ID NO: 13114 - DNA, 45 bp, Artificial Sequence
  Description of Artificial Sequence: Synthetic coding sequence
atgaacggcaccctggaccaccccgaccagcccgacctggactag

SEQ ID NO: 13115 - DNA, 519 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgcagctgcccaagcccctgagcgaggccgacgtgagagtgctggaggagcaggcccagaacctgggcctggagggcaccctggtgagcctggccagagtgccccaggcctag

SEQ ID NO: 13116 - DNA, 27 bp, Artificial Sequence
  Description of Artificial Sequence: Synthetic coding sequence
atgttctggaagttcgacctgcactag

SEQ ID NO: 13117 - DNA, 411 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgtag

SEQ ID NO: 13118 - DNA, 5844 bp, Artificial Sequence
  Description of Artificial Sequence: Synthetic coding sequence
ggcagacccatcgaccccagagagggccccggcagaccccccctggacggcagagaccacttcggcagaccccccgtggacatcagagagaacctggtgagacccggcatcgaccacctgggcagaagagaccacttcggcttcaaccccgagaagccctggggccacagaggcgacttcgacgagagagagcacagagtgctgcccgtgtacggcggccccaagggcctgcacgaggagagaggcagattcagaagcggcaactacagattcgaccccagaagcggcccctggaacagaggcttcggccaggaggtgcacagagacttcgacgacagaagaagaccctgggagagacagagagacagagacgacagagacttcgacttctgcagagagatgaacggcaacagactgggcagagacagaatccagaacacctgggtgccccccccccacgccagagtgttcgactacttcgagggcgccaccagccagagaaagggcgacaacgtgccccaggtgaacggcgagaacaccgagagacacgcccagcccccccccatccccgtgcagaacgaccccgagctgtacgagaagctgaccagcagcaacgagatcaacaaggagaagagcgacaccgtggccgacatcgagagcgagcccgtggtggagagcaccgagaccgagggcacccccctgaccagcctgaccgccgagaccagaagacaggtgaagatgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgagcagaggcgtggcctacagcacccacagaaccaacgcccccggcaaggacttccagggcatcagcgccgccttcagcaccgagaacggcttccacagcgtgggccacgagctggccgacaaccacatcaccagcagagactgcaacggccacctgctgaactgctacggcagaaacgagagcatcgccagcaccccccccggcgaggacagaaagagccccagagtgctgatcaagaccctgggcaagctggacggctgcctgagagtggagttccacaacggcggcaaccccagcaaggtgcccgccgaggactgcagcgagcccgtgcagctgctgagatacagccccaccctggccagcgagaccagccccgtgcccgaggccagaagaggcagcagcgccgacagcctgcccagccacagacccagccccaccgacagcagactgagaagcagcaagggcagcagcctgagcagcgagagcagctggtacgacagcccctggggcaacgccggcgagctgagcgaggccgagggcagcttcctggcccccggcatgcccgaccccagcctgcacgccagcttcccccccggcgacgccaagaagcccttcaaccagagcagcagcctgagcagcctgagagagctgtacaaggacgccaacctgggcagcctgagccccagcggcatcagactgagcgacgagtacatgggcacccacgccagcctgagcaacagagtgagcttcgccagcgacatcgacgtgcccagcagagtggcccacggcgaccccatccagtacagcagcttcaccctgccctgcagaaagcccaaggccttcgtggaggacaccgccaagaaggacagcctgaaggccagaatgagaagaatcagcgactggaccggcagcctgagcagaaagaagagaaagctgcaggagcccagaagcaaggagggcagcgactacttcgacagcagaagcgacggcctgaacaccgacgtgcagggcagcagccaggccagcgccttcctgtggagcggcggcagcacccagatcctgagccagagaagcgagagcacccacgccatcggcagcgaccccctgagacagaacatctacgagaacttcatgagagagctggagatgagcagaaccaacaccgagaacatcgagaccagcaccgagaccgccgagagcagcagcgagagcctgagcagcctggagcagctggacctgctgttcgagaaggagcagggcgtggtgagaaaggccggctggctgttcttcaagcccctggtgaccgtgcagaaggagagaaagctggagctggtggccagaagaaagtggaagcagtactgggtgaccctgaagggctgcaccctgctgttctacgagacctacggcaagaacagcatggaccagagcagcgcccccagatgcgccctgttcgccgaggacagcatcgtgcagagcgtgcccgagcaccccaagaaggagaacgtgttctgcctgagcaacagcttcggcgacgtgtacctgttccaggccaccagccagaccgacctggagaactgggtgaccgccgtgcacagcgcctgcgccagcctgttcgccaagaagcacggcaaggaggacaccctgagactgctgaagaaccagaccaagaacctgctgcagaagatcgacatggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 13119 - DNA, 294 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaaggacgccaagaccaccaacggccacggcggcgaggccgccgagggcaagagcctgggcagcgccctgaagcccggcgagggcagaagcgccctgttcgccggcaacgagtggagaagacccatcatccagttcgtggagagcggcgacgacaagaacagcaactacttcagcatggactag

SEQ ID NO: 13120 - DNA, 117 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaagtag

SEQ ID NO: 13121 - DNA, 1455 bp, Artificial Sequence
  Description of Artificial Sequence: Synthetic coding sequence
atggccatcggcaagagactggccaccctgcccaccaaggagcagaagacccagagactgatcagcgagctgagcctgctgaaccacaagctgcccgccagagtgtggctgcccaccgccggcttcgaccaccacgtggtgagagtgccccacacccaggccgtggtgctgaacagcaaggacaaggccccctacctgatctacgtggaggtgctggagtgcgagaacttcgacaccaccagcgtgcccgccagaatccccgagaacagaatcagaagcaccagaagcgtggagaacctgcccgagtgcggcatcacccacgagcagagagccggcagcttcagcaccgtgcccaactacgacaacgacgacgaggcctggagcgtggacgacatcggcgagctgcaggtggagctgcccgaggtgcacaccaacagctgcgacaacatcagccagttcagcgtggacagcatcaccagccaggagagcaaggagcccgtgttcatcgccgccggcgacatcagaagaagactgagcgagcagctggcccacacccccaccgccttcaagagagaccccgaggaccccagcgccgtggccctgaaggagccctggcaggagaaggtgagaagaatcagagagggcagcccctacggccacctgcccaactggagactgctgagcgtgatcgtgaagtgcggcgacgacctgagacaggagctgctggccttccaggtgctgaagcagctgcagagcatctgggagcaggagagagtgcccctgtggatcaagccctacaagatcctggtgatcagcgccgacagcggcatgatcgagcccgtggtgaacgccgtgagcatccaccaggtgaagaagcagagccagctgagcctgctggactacttcctgcaggagcacggcagctacaccaccgaggccttcctgagcgcccagagaaacttcgtgcagagctgcgccggctactgcctggtgtgctacctgctgcaggtgaaggacagacacaacggcaacatcctgctggacgccgagggccacatcatccacatcgacttcggcttcatcctgagcagcagccccagaaacctgggcttcgagaccagcgccttcaagctgaccaccgagttcgtggacgtgatgggcggcctggacggcgacatgttcaactactacaagatgctgatgctgcagggcctgatcgccgccagaaagcacatggacaaggtggtgcagatcgtggagatcatgcagcagggcagccagctgccctgcttccacggcagcagcaccatcagaaacctgaaggagagattccacatgagcatgaccgaggagcagctgcagctgctggtggagcagatggtggacggcagcatgagaagcatcaccaccaagctgtacgacggcttccagtacctgaccaacggcatcatgtag

SEQ ID NO: 13122 - DNA, 228 bp, Artificial Sequence
  Description of Artificial Sequence: Synthetic coding sequence
atggccatccccatcaccgtgctggactgcgacctgctgctgtacggcagaggccacagaaccctggacagattcaagctggacgacgtgaccgacgagtacctgatgagcatgtacggcttccccagacagttcatctactacctggtggagctgctgggcgccaacctgagcagacccacccagagaagcagagccatcagccccgagacccaggtgctggcctag

SEQ ID NO: 13123 - DNA, 2754 bp, Artificial Sequence
  Description of Artificial Sequence: Synthetic coding sequence
atggacggcgccgccggccccggcgacggccccgccagagaggccctgcagagcctgagccagagactgagagtgcaggagcaggagatggagctggtgaaggccgccctggccgaggccctgagactgctgagactgcaggtgccccccagcagcctgcagggcagcggcacccccgccccccccggcgacagcctggccgccccccccggcctgccccccacctgcacccccagcctggtgagcagaggcacccagaccgagaccgaggtggagctgaagagcagccccggcccccccggcctgagcaacggcccccccgccccccagggcgccagcgaggagcccagcggcacccagagcgagggcggcggcagcagcagcagcggcgccggcagccccggcccccccggcatcctgagacccctgcagcccccccagagagccgacacccccagaagaaacagcagcagcagcagcagccccagcgagagacccagacagaagctgagcagaaaggccatcagcagcgccaacctgctggtgagaagcggcagcaccgagagcagaggcggcaaggaccccctgagcagccccggcggccccggcagcagaagaagcaactacaacctggagggcatcagcgtgaagatgttcctgagaggcagacccatcaccatgtacatccccagcggcatcagaagcctggaggagctgcccagcggccccccccccgagaccctgagcctggactgggtgtacggctacagaggcagagacagcagaagcaacctgttcgtgctgagaagcggcgaggtggtgtacttcatcgcctgcgtggtggtgctgtacagacccggcggcggccccggcggccccggcggcggcggccagagacactacagaggccacaccgactgcgtgagatgcctggccgtgcaccccgacggcgtgagagtggccagcggccagaccgccggcgtggacaaggacggcaagcccctgcagcccgtggtgcacatctgggacagcgagaccctgctgaagctgcaggagatcggcctgggcgccttcgagagaggcgtgggcgccctggccttcagcgccgccgaccagggcgccttcctgtgcgtggtggacgacagcaacgagcacatgctgagcgtgtgggactgcagcagaggcatgaagctggccgagatcaagagcaccaacgacagcgtgctggccgtgggcttcaaccccagagacagcagctgcatcgtgaccagcggcaagagccacgtgcacttctggaactggagcggcggcgtgggcgtgcccggcaacggcaccctgaccagaaagcagggcgtgttcggcaagtacaagaagcccaagttcatcccctgcttcgtgttcctgcccgacggcgacatcctgaccggcgacagcgagggcaacatcctgacctggggcagaagccccagcgacagcaagacccccggcagaggcggcgccaaggagacctacggcatcgtggcccaggcccacgcccacgagggcagcatcttcgccctgtgcctgagaagagacggcaccgtgctgagcggcggcggcagagacagaagactggtgcagtggggccccggcctggtggccctgcaggaggccgagatccccgagcacttcggcgccgtgagagccatcgccgagggcctgggcagcgagctgctggtgggcaccaccaagaacgccctgctgagaggcgacctggcccagggcttcagccccgtgatccagggccacaccgacgagctgtggggcctgtgcacccaccccagccagaacagattcctgacctgcggccacgacagacagctgtgcctgtgggacggcgagagccacgccctggcctggagcatcgacctgaaggagaccggcctgtgcgccgacttccaccccagcggcgccgtggtggccgtgggcctgaacaccggcagatggctggtgctggacaccgagaccagagagatcgtgagcgacgtgatcgacggcaacgagcagctgagcgtggtgagatacagccccgacggcctgtacctggccatcggcagccacgacaacgtgatctacatctacagcgtgagcagcgacggcgccaagagcagcagattcggcagatgcatgggccacagcagcttcatcacccacctggactggagcaaggacggcaacttcatcatgagcaacagcggcgactacgagatcctgtactgggacgtggccggcggctgcaagcagctgaagaacagatacgagagcagagacagagagtgggccacctacacctgcgtgctgggcttccacgtgtacgtgcccgtgagaagctgccagggcgccgagccccacgtgagaggccccagacagcccagagaccagagacccatccacgccagaagactggcccccagactggccggcagacagggcagacagcacctgcccgtggccagcgccggcagatggggcagaggcgccggcgccagacacgccctgagcaaccccctgcccgtgcccagactgctgcccagaagactgatcgccgcctggagagacagactggccagaagaagaggccccgcccccccctgccccagcctggcccagagccccaccaccagaggcagactgttccccggcctgaccagcagacacagcagaagcagaatcttcctggagggcgccaacggcgcccccgcccacaccgtgtag

SEQ ID NO: 13124 - DNA, 321 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagtag

SEQ ID NO: 13125 - DNA, 228 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatactag

SEQ ID NO: 13126 - DNA, 1275 bp, Artificial Sequence; identical to SEQ ID NO: 11943
  Description of Artificial Sequence: Synthetic coding sequence

SEQ ID NO: 13127 - DNA, 288 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaaggacgccaagaccaccaacggccacggcggcgaggccgccgagggcaagagcctgggcagcgccctgaagcccggcgagggcagaagcgccctgttcgccggcaacgagtggagaagacccatcatccagttcgtggagagcggcgacgacaagaacagcaactacttcagctag

SEQ ID NO: 13128 - DNA, 3144 bp, Artificial Sequence
  Description of Artificial Sequence: Synthetic coding sequence
atggcccccagactgcagctggagaaggccgcctggagatgggccgagaccgtgagacccgaggaggtgagccaggagcacatcgagaccgcctacagaatctggctggagccctgcatcagaggcgtgtgcagaagaaactgcaagggcaaccccaactgcctggtgggcatcggcgagcacatctggctgggcgagatcgacgagaacagcttccacaacatcgacgaccccaactgcgagagaagaaagaagaacagcttcgtgggcctgaccaacctgggcgccacctgctacgtgaacaccttcctgcaggtgtggttcctgaacctggagctgagacaggccctgtacctgtgccccagcacctgcagcgactacatgctgggcgacggcatccaggaggagaaggactacgagccccagaccatctgcgagcacctgcagtacctgttcgccctgctgcagaacagcaacagaagatacatcgaccccagcggcttcgtgaaggccctgggcctggacaccggccagcagcaggacgcccaggagttcagcaagctgttcatgagcctgctggaggacaccctgagcaagcagaagaaccccgacgtgagaaacatcgtgcagcagcagttctgcggcgagtacgcctacgtgaccgtgtgcaaccagtgcggcagagagagcaagctgctgagcaagttctacgagctggagctgaacatccagggccacaagcagctgaccgactgcatcagcgagttcctgaaggaggagaagctggagggcgacaacagatacttctgcgagaactgccagagcaagcagaacgccaccagaaagatcagactgctgagcctgccctgcaccctgaacctgcagctgatgagattcgtgttcgacagacagaccggccacaagaagaagctgaacacctacatcggcttcagcgagatcctggacatggagccctacgtggagcacaagggcggcagctacgtgtacgagctgagcgccgtgctgatccacagaggcgtgagcgcctacagcggccactacatcgcccacgtgaaggacccccagagcggcgagtggtacaagttcaacgacgaggacatcgagaagatggagggcaagaagctgcagctgggcatcgaggaggacctggagcccagcaagagccagaccagaaagcccaagtgcggcaagggcacccactgcagcagaaacgcctacatgctggtgtacagactgcagacccaggagaagcccaacaccaccgtgcaggtgcccgccttcctgcaggagctggtggacagagacaacagcaagttcgaggagtggtgcatcgagatggccgagatgagaaagcagagcgtggacaagggcaaggccaagcacgaggaggtgaaggagctgtaccagagactgcccgccggcgccgagccctacgagttcgtgagcctggagtggctgcagaagtggctggacgagagcacccccaccaagcccatcgacaaccacgcctgcctgtgcagccacgacaagctgcaccccgacaagatcagcatcatgaagagaatcagcgagtacgccgccgacatcttctacagcagatacggcggcggccccagactgaccgtgaaggccctgtgcaaggagtgcgtggtggagagatgcagaatcctgagactgaagaaccagctgaacgaggactacaagaccgtgaacaacctgctgaaggccgccgtgaagggcagcgacggcttctgggtgggcaagagcagcctgagaagctggagacagctggccctggagcagctggacgagcaggacggcgacgccgagcagagcaacggcaagatgaacggcagcaccctgaacaaggacgagagcaaggaggagagaaaggaggaggaggagctgaacttcaacgaggacatcctgtgcccccacgccgtgttcttcttcagcaagtacatcttcctgaacagcggcgagctgtgcatcagcgagaacgagagaagactggtgagcaaggaggcctggagcaagctgcagcagtacttccccaaggcccccgagttccccagctacaaggagtgctgcagccagtgcaagatcctggagagagagggcgaggagaacgaggccctgcacaagatgatcgccaacgagcagaagaccagcctgcccaacctgttccaggacaagaacagaccctgcctgagcaactggcccgaggacaccgacgtgctgtacatcgtgagccagttcttcgtggaggagtggagaaagttcgtgagaaagcccaccagatgcagccccgtgagcagcgtgggcaacagcgccctgctgtgcccccacggcggcctgatgttcaccttcgccagcatgaccaaggaggacagcaagctgatcgccctgatctggcccagcgagtggcagatgatccagaagctgttcgtggtggaccacgtgatcaagatcaccagaatcgaggtgggcgacgtgaaccccagcgagacccagtacatcagcgagcccaagctgtgccccgagtgcagagagggcctgctgtgccagcagcagagagacctgagagagtacacccaggccaccatctacgtgcacaaggtggtggacaacaagaaggtgatgaaggacagcgcccccgagctgaacgtgagcagcagcgagaccgaggaggacaaggaggaggccaagcccgacggcgagaaggaccccgacttcaaccagagcaacggcggcaccaagagacagaagatcagccaccagaactacatcgcctaccagaagcaggtgatcagaagaagcatgagacacagaaaggtgagaggcgagaaggccctgctggtgagcgccaaccagaccctgaaggagctgaagatccagatcatgcacgccttcagcgtggcccccttcgaccagaacctgagcatcgacggcaagatcctgagcgacgactgcgccaccctgggcaccctgggcgtgatccccgagagcgtgatcctgctgaaggccgacgagcccatcgccgactacgccgccatggacgacgtgatgcaggtgtgcatgcccgaggagggcttcaagggcaccggcctgctgggccactag

SEQ ID NO: 13129 - DNA, 1443 bp, Artificial Sequence; identical to SEQ ID NO: 12577
  Description of Artificial Sequence: Synthetic coding sequence

SEQ ID NO: 13130 - DNA, 2376 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggccttcagcgactaccagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagcgaggagggcaagctgagcaccagccaggacgccgcctgcaaggacgccgaggagtgccccgagaccgccgaggccaagtgcgccgcccccagaccccccagcagcagccccgagcagagcggcgtggagatccccgccctgcccggccagtggagccagcagtag

SEQ ID NO: 13131 - DNA, 1500 bp, Artificial Sequence
  Description of Artificial Sequence: Synthetic coding sequence
atgttcggcgacgccagcaccagcctggtggtgcccgagaaggtgaagacccccatgaagagcagcaagaccgacctgcagggcagcgccagccccagcaaggtggagggcgtgcacacccccagacagaagagaagcacccccctgaaggagagacagctgagcaagcccctgagcgagagaaccaacagcagcgacagcgagagaagccccgacctgggccacagcacccagatccccagaaaggtggtgtacgaccagctgaaccagatcctggtgagcgacgccgccctgcccgagaacgtgatcctggtgaacaccaccgactggcagggccagtacgtggccgagctgctgcaggaccagagaaagcccgtggtgtgcacctgcagcaccgtggaggtgcaggccgtgctgagcgccctgctgaccagaatccagagatactgcaactgcaacagcagcatgcccagacccgtgaaggtggccgccgtgggcggccagagctacctgagcagcatcctgagattcttcgtgaagagcctggccaacaagaccagcgactggctgggctacatgagattcctgatcatccccctgggcagccaccccgtggccaagtacctgggcagcgtggacagcaagtacagcagcagcttcctggacagcggctggagagacctgttcagcagaagcgagccccccgtgagcgagcagctggacgtggccggcagagtgatgcagtacgtgaacggcgccgccaccacccaccagctgcccgtggccgaggccatgctgacctgcagacacaagttccccgacgaggacagctaccagaagttcatccccttcatcggcgtggtgaaggtgggcctggtggaggacagccccagcaccgccggcgacggcgacgacagccccgtggtgagcctgaccgtgcccagcaccagcccccccagcagcagcggcctgagcagagacgccaccgccaccccccccagcagccccagcatgagcagcgccctggccatcgtgggcagccccaacagcccctacggcgacgtgatcggcctgcaggtggactactggctgggccaccccggcgagagaagaagagagggcgacaagagagacgccagcagcaagaacaccctgaagagcgtgttcagaagcgtgcaggtgagcagactgccccacagcggcgaggcccagctgagcggcaccatggccatgaccgtggtgaccaaggagaagaacaagaaggtgcccaccatcttcctgagcaagaagcccagagagaaggaggtggacagcaagagccaggtgatcgagggcatcagcagactgatctgcagcgccaagcagcagcagaccatgctgagagtgagcatcgacggcgtggagtggagcgacatcaagttcttccagctggccgcccagtggcccacccacgtgaagcacttccccgtgggcctgttcagcggcagcaaggccacctag

SEQ ID NO: 13132 - DNA, 435 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgcagctgcccaagcccctgagcgagtag

SEQ ID NO: 13133 - DNA, 513 bp, Artificial Sequence; identical to SEQ ID NO: 9958
  Description of Artificial Sequence: Synthetic coding sequence

SEQ ID NO: 13134 - DNA, 270 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgcctag

SEQ ID NO: 13135 - DNA, 1206 bp, Artificial Sequence
  Description of Artificial Sequence: Synthetic coding sequence
atgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccccccatcatgggcatcatcatcgaccacttcgtggacagaccctaccccagcagcagccccatgcacccctgcaactacagaaccgccggcgaggacaccggcgtgatctaccccagcgtggaggacagccaggaggtgtgcaccaccagcttcagcaccagcccccccagccagctgatggtgcccggcaaggagggcggcgtgcccctggcccccaaccagcccgtgcacggcacccaggccgaccaggagagactggccacctgcacccccagcgacagaacccactgcgccgccacccccagcagcagcgaggacaccgagaccgtgagcaacagcagcgagggcagagccagcccccacgacgtgctggagaccatcttcgtgagaaaggtgggcgccttcgtgaacaagcccatcaaccaggtgaccctgaccagcctggacatccccttcgccatgttcgcccccaagaacctggagctggaggacaccgaccccatggtgaacccccccgacagccccgagaccgagagccccctgcagggcagcctgcacagcgacggcagcagcggcggcagcagcggcaacacccacgacgacttcgtgatgatcgacttcaagcccgccttcagcaaggacgacatcctgcccatggacctgggcaccttctacagagagttccagaaccccccccagctgagcagcctgagcatcgacatcggcgcccagagcatggccgaggacctggacagcctgcccgagaagctggccgtgcacgagaagaacgtgagagagttcgacgccttcgtggagaccctgcagtag

SEQ ID NO: 13136 - DNA, 2148 bp, Artificial Sequence; identical to SEQ ID NO: 9921
  Description of Artificial Sequence: Synthetic coding sequence

SEQ ID NO: 13137 - DNA, 336 bp, Artificial Sequence
  Description of Artificial Sequence: Synthetic coding sequence
atgaccggcagcaacagccacatcaccatcctgaccctgaaggtgctgccccacttcgagagcctgggcaagcaggagaagatccccaacaagatgagcgccttcagaaaccactgcccccacctggacagcgtgggcgagatcaccaaggaggacctgatccagaagagcctgggcacctgccaggactgcaaggtgcagggccccaacctgtgggcctgcctggagaacagatgcagctacgtgggctgcggcgagagccaggtggaccacagcaccatccacagccaggagaccaagcactacctgaccgtgaacctgaccaccctgagatag

SEQ ID NO: 13138 - DNA, 228 bp, Artificial Sequence
  Description of Artificial Sequence: Synthetic coding sequence
atggccggccaggaggaccccgtgcagagagagatccaccaggactgggccaacagagagtacatcgagatcatcaccagcagcatcaagaagatcgccgacttcctgaacagcttcgacatgagctgcagaagcagactggccaccctgaacgagaagctgaccgccctggagagaagaatcgagtacatcgaggccagagtgaccaagggcgagaccctgacctag

SEQ ID NO: 13139 - DNA, 348 bp, Artificial Sequence; identical to SEQ ID NO: 9946
  Description of Artificial Sequence: Synthetic coding sequence

SEQ ID NO: 13140 - DNA, 1077 bp, Artificial Sequence; identical to SEQ ID NO: 11551
  Description of Artificial Sequence: Synthetic coding sequence

SEQ ID NO: 13141 - DNA, 4047 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcaccacccagggcttccccgtgagaaacgtgagacccgtgcagaacgccatgaaccaggtgggcatcgtgctgaacgtgcagcagggccagaccgtgagacccatcaccctggtgcccgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 13142 - DNA, 561 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgtag

SEQ ID NO: 13143 - DNA, 288 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgcagctgagcagcaaggagaagatctggacccaggagatgctgctgcagtag

SEQ ID NO: 13144 - DNA, 1740 bp, Artificial Sequence
  Description of Artificial Sequence: Synthetic coding sequence
atggacgacagcaagcaggagagcaccaccagcaaggaggaggagaccaacatcatcagcagcatcgtgcccagcacccaggacatctaccagagacagaacagcagcgacgtgcacaagagcctgctgcccgccgtggacgagaccacctgcggccacacccacttccagcagatgatcgacaagtacatcaacgaggccaacctgatccccgagaagaccgacctgcaggagctggagcacatcttccccaacctgcaccaccagctgttcaagcccctggagccccaccccgacttcgacctgagcagcagcagcagcggcatcagccccgacaacagagacttctaccagagaagcgacagcagcagcgagagccactgcgccaccggcctgagcaagagcaccgtgtacttcaccgccctgagaagaaccagcatgcacagcagcctgaacaccagccccaaccagcagcccgacaccaacctggcccacgtgggcgcccacagcttcgccaccgagaacatcatcggcggcagcgagcagtgcttcgagcagctgcagcccgagtacagcagccaggaggagagccagcacgccgacctgcccagcatcttcagcatcgaggccagagacagcagccagggcatgaagaaccagaactaccccagcgaggagcacaccgagatcctgcagaacaagaagaagatcgtgcacttccagctgagcatcggcaacctgagcagcgtgtacagcagcagcgacgaggccaacgtgttcgaccagctgaacgtgcagcacagcaccccctgcggcagcaacagcagcgagtgcagcaccaagcaccagctggagagcagaaaggagagcatgggcttcgaggagctgagcaagagaggcgtggtgaccatgctgcagagccagggcctgatcgaggacaacaagaacgagacctgcagagtgctggacatcaacccccaggtggaggagaccgacagcagactgtgcgtgagaaccgtggagatgggcaccagcatccaggccccctacagcctgaccacccagaacgagaagtacttcgagaacagcgccgagaccgacatccccaagatcaccaagaagctgagccagctgggcgagagcgagctgttcgccagcagcggcagcttcagcctgcagagcagcatccccgtgtgggagaccgagaccggccacggcatcatggaggagcccgagctgaccctgatcagcaccaccgacaccagcatcgccgagatggacttcgccaacctgaccctggaggagaagagcgagaacgaggccaagtgcttcttccaggtgagcgagttcctgcccctggtgagcgccaccgaggccagcgactaccccgccgtgagcgagctgagcatcgagaagcccagaaccgccagcaccgccgagacccccagaagactgacccccgtgcccggcagcctgcaggaggccttcatcaagagaaagaagagcttcatggagagaagccaccagagacagaaggagatcagaaacaagatccacgtgagcgagaacagccagatcaagaccgtgaaggagaagcccagcatcagcagcagcgtgagcagactgaagggcgtgaacaaggtgagagccagcttccccgaggacagaaagaccacccaggccctgagacaccagagaggcctgagactgtacaaccagctggccgaggtgaagcagtag

SEQ ID NO: 13145 - DNA, 435 bp, Artificial Sequence; identical to SEQ ID NO: 13132
  Description of Artificial Sequence: Synthetic coding sequence

SEQ ID NO: 13146 - DNA, 246 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagatag

SEQ ID NO: 13147 - DNA, 1539 bp, Artificial Sequence
  Description of Artificial Sequence: Synthetic coding sequence
atggccgccttcaagctggacttcctgcccgagatgatggtggaccactgcagcctgaacagcagccccgtgagcaagaagatgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgcacaacatgaaggtgctgcccggcatgcaccaccccatccagatgaagcccgccgacagcgagaagaacaacgtggaggacagaaagctgttcatcggcatgatcagcaagaagtgcaccgagaacgacatcagagtgatgttcagcagcttcggccagatcgaggagtgcagaatcctgagaggccccgacggcctgagcagaggctgcgccttcgtgaccttcaccaccagagccatggcccagaccgccatcaaggccatgcaccaggcccagaccatggagggctgcagcagccccatggtggtgaagttcgccgacacccagaaggacaaggagcagaagagaatggcccagcagctgcagcagcagatgcagcagatcagcgccgccagcgtgtggggcaacctggccggcctgaacaccctgggcccccagtacctggccctgtacctgcagctgctgcagcagaccgccagcagcggcaacctgaacaccctgagcagcctgcaccccatgggcggcctgaacgccatgcagctgcagaacctggccgccctggccgccgccgccagcgccgcccagaacacccccagcggcaccaacgccctgaccaccagcagcagccccctgagcgtgctgaccagcagcggcagcagccccagcagcagcagcagcaacagcgtgaaccccatcgccagcctgggcgccctgcagaccctggccggcgccaccgccggcctgaacgtgggcagcctggccggcatggccgccctgaacggcggcctgggcagcagcggcctgagcaacggcaccggcagcaccatggaggccctgacccaggcctacagcggcatccagcagtacgccgccgccgccctgcccaccctgtacaaccagaacctgctgacccagcagagcatcggcgccgccggcagccagaaggagggccccgagggcgccaacctgttcatctaccacctgccccaggagttcggcgaccaggacctgctgcagatgttcatgcccttcggcaacgtggtgagcgccaaggtgttcatcgacaagcagaccaacctgagcaagtgcttcggcttcgtgagctacgacaaccccgtgagcgcccaggccgccatccagagcatgaacggcttccagatcggcatgaagagactgaaggtgcagctgaagagaagcaagaacgacagcaagccctactag

SEQ ID NO: 13148 - DNA, 1131 bp, Artificial Sequence
  Description of Artificial Sequence: Synthetic coding sequence
atgaaggacgtgcccggcttcctgcagcagagccagaacagcggccccggccagcccgccgtgtggcacagactggaggagctgtacaccaagaagctgtggcaccagctgaccctgcaggtgctggacttcgtgcaggacccctgcttcgcccagggcgacggcctgatcaagctgtacgagaacttcatcagcgagttcgagcacagagtgaaccccctgagcctggtggagatcatcctgcacgtggtgagacagatgaccgaccccaacgtggccctgaccttcctggagaagaccagagagaaggtgaagagcagcgacgaggccgtgatcctgtgcaagaccgccatcggcgccctgaagctgaacatcggcgacctgcaggtgaccaaggagaccatcgaggacgtggaggagatgctgaacaacctgcccggcgtgaccagcgtgcacagcagattctacgacctgagcagcaagtactaccagaccatcggcaaccacgccagctactacaaggacgccctgagattcctgggctgcgtggacatcaaggacctgcccgtgagcgagcagcaggagagagccttcaccctgggcctggccggcctgctgggcgagggcgtgttcaacttcggcgagctgctgatgcaccccgtgctggagagcctgagaaacaccgacagacagtggctgatcgacaccctgtacgccttcaacagcggcaacgtggagagattccagaccctgaagaccgcctggggccagcagcccgacctggccgccaacgaggcccagctgctgagaaagatccagctgctgtgcctgatggagatgaccttcaccagacccgccaaccacagacagctgaccttcgaggagatcgccaagagcgccaagatcaccgtgaacgaggtggagctgctggtgatgaaggccctgagcgtgggcctggtgaagggcagcatcgacgaggtggacaagagagtgcacatgacctgggtgcagcccagagtgctggacctgcagcagatcaagggcatgaaggacagactggagttctggtgcaccgacgtgaagagcatggagatgctggtggagcaccaggcccacgacatcctgacctag

SEQ ID NO: 13149 - DNA, 489 bp, Artificial Sequence
  Description of Artificial Sequence: Synthetic coding sequence
atgaccagcaagaagctggtgaacagcgtggccggctgcgccgacgacgccctggccggcctggtggcctgcaaccccaacctgcagctgctgcagggccacagagtggccctgagaagcgacctggacagcctgaagggcagagtggccctgctgagcggcggcggcagcggccacgagcccgcccacgccggcttcatcggcaagggcatgctgaccggcgtgatcgccggcgccgtgttcaccagccccgccgtgggcagcatcctggccgccatcagagccgtggcccaggccggcaccgtgggcaccctgctgatcgtgaagaactacaccggcgacagactgaacttcggcctggccagagagcaggccagagccgagggcatccccgtggagatggtggtgatcggcgacgacagcgccttcaccgtgctgaagaaggccggcagaagaggcctgtgcggcaccgtgctgatccacaagtag

SEQ ID NO: 13150 - DNA, 7854 bp, Artificial Sequence
  Description of Artificial Sequence: Synthetic coding sequence
atgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggtgcccagagtgcccacccacaccctggccatggtggtgcccccccaggagcccgacagaaccagccaggagaacagccccgccctgctgggcgtgcagaagggcaccagcaagcagaagagcagcagcctgcaggtggccgaccaggacctgctgcccagcttccacccctaccagcccctggagtgcatcgtggaggagaccgagggcaagctgaacgagctgggccagagaatcagcgccatcgagaaggcccagctgaagagcctggagctgatccagggcgagcccctgaacaaggacaagatcgaggagctgaagaagaacagagaggagcaggtgcagaagaagaagaagatcctgaaggagctgcagaaggtggagagacagctgcagatgaagacccagcagcagttcaccaaggagtacctggagaccaagggccagaaggacaccgtgagcctgcaccagcagtgcagccacagaggcgtgttccccgagggcgagggcgacggcagcctgcccgaggaccacttcagcgagctgccccaggtggacaccatcctgttcaaggacaacgacgtggacgacgagcagcagagcccccccagcgccgagcagatcgacttcgtgcccgtgcagcccctgagcagcccccagtgcaacttcagcagcgacctgggcagcaacggcaccaacagcctggagctgcagaaggtgagcggcaaccagcagatcgtgggccagccccagatcgccatcaccggccacgaccagggcctgctggtgcaggagcccgacggcctgatggtggccacccccgcccagaccctgaccgacaccctggacgacctgatcgccgccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagagagaagagaaaggagaagagaaagaagaagaaggaggagcagaagagaaagcaggaggaggacgaggagaacaagcccaaggagaacagcgagctgcccgaggacgaggacgaggaggagaacgacgaggacgtggagcaggaggtgcccatcgagccccccagcgccaccaccaccaccaccatcggcatcagcgccaccagcgccaccttcaccaacgtgttcggcaagaagagagccaacgtggtgaccacccccagcaccaacagaaagaacaagaagaacaagaccaaggagaccccccccaccgcccacctgatcctgcccgagcagcacatgagcctggcccagcagaaggccgacaagaacaagatcaacggcgagcccagaggcggcggcgccggcggcaacagcgacagcgacaacctggacagcaccgactgcaacagcgagagcagcagcggcggcaagagccaggagctgaacttcgtgatggacgtgaacagcagcaagtaccccagcctgctgctgcacagccaggaggagaagaccagcaccgccaccagcaagacccagaccagactggagggcgaggtgacccccaacagcctgagcaccagctacaagaccgtgagcctgcccctgagcagccccaacatcaagctgaacctgaccagccccaagagaggccagaagagagaggagggctggaaggaggtggtgagaagaagcaagaagctgagcgtgcccgccagcgtggtgagcagaatcatgggcagaggcggctgcaacatcaccgccatccaggacgtgaccggcgcccacatcgacgtggacaagcagaaggacaagaacggcgagagaatgatcaccatcagaggcggcaccgagagcaccagatacgccgtgcagctgatcaacgccctgatccaggaccccgccaaggagctggaggacctgatccccaagaaccacatcagaacccccgccagcaccaagagcatccacgccaacttcagcagcggcgtgggcaccaccgccgccagcagcaagaacgccttccccctgggcgcccccaccctggtgaccagccaggccaccaccctgagcaccttccagcccgccaacaagctgaacaagaacgtgcccaccaacgtgagaagcagcttccccgtgagcctgcccctggcctacccccacccccacttcgccctgctggccgcccagaccatgcagcagatcagacaccccagactgcccatggcccagttcggcggcaccttcagccccagccccaacacctggggccccttccccgtgagacccgtgaaccccggcaacaccaacagcagccccaagcacaacaacaccagcagactgcccaaccagaacggcaccgtgctgcccagcgagagcgccggcctggccaccgccagctgccccatcaccgtgagcagcgtggtggccgccagccagcagctgtgcgtgaccaacaccagaacccccagcagcgtgagaaagcagctgttcgcctgcgtgcccaagaccagcccccccgccaccgtgatcagcagcgtgaccagcacctgcagcagcctgcccagcgtgagcagcgcccccatcaccagcggccaggcccccaccaccttcctgcccgccagcaccagccaggcccagctgagcagccagaagatggagagcttcagcgccgtgccccccaccaaggagaaggtgagcacccaggaccagcccatggccaacctgtgcacccccagcagcaccgccaacagctgcagcagcagcgccagcaacacccccggcgcccccgagacccaccccagcagcagccccacccccaccagcagcaacacccaggaggaggcccagcccagcagcgtgagcgacctgagccccatgagcatgcccttcgccagcaacagcgagcccgcccccctgaccctgaccagccccagaatggtggccgccgacaaccaggacaccagcaacctgccccagctggccgtgcccgcccccagagtgagccacagaatgcagcccagaggcagcttctacagcatggtgcccaacgccaccatccaccaggacccccagagcatcttcgtgaccaaccccgtgaccctgacccccccccagggcccccccgccgccgtgcagctgagcagcgccgtgaacatcatgaacggcagccagatgcacatcaaccccgccaacaagagcctgccccccaccttcggccccgccaccctgttcaaccacttcagcagcctgttcgacagcagccaggtgcccgccaaccagggctggggcgacggccccctgagcagcagagtggccaccgacgccagcttcaccgtgcagagcgccttcctgggcaacagcgtgctgggccacctggagaacatgcaccccgacaacagcaaggcccccggcttcagaccccccagccagagagtgagcaccagccccgtgggcctgcccagcatcgaccccagcggcagcagccccagcagcagcagcgcccccctggccagcttcagcggcatccccggcaccagagtgttcctgcagggccccgcccccgtgggcacccccagcttcaacagacagcacttcagcccccacccctggaccagcgccagcaacagcagcaccagcgccccccccaccctgggccagcccaagggcgtgagcgccagccaggacagaaagatccccccccccatcggcaccgagagactggccagaatcagacagggcggcagcgtggcccaggcccccgccggcaccagcttcgtggcccccgtgggccacagcggcatctggagcttcggcgtgaacgccgtgagcgagggcctgagcggctggagccagagcgtgatgggcaaccaccccatgcaccagcagctgagcgaccccagcaccttcagccagcaccagcccatggagagagacgacagcggcatggtggcccccagcaacatcttccaccagcccatggccagcggcttcgtggacttcagcaagggcctgcccatcagcatgtacggcggcaccatcatccccagccacccccagctggccgacgtgcccggcggccccctgttcaacggcctgcacaaccccgaccccgcctggaaccccatgatcaaggtgatccagaacagcaccgagtgcaccgacgcccagcaggccagcctgctgcccagcgtgcccgccctgaagggcgagatccccagcccccagctgaccagacccaagaagagaatcggcagacccatggtggccagccccaaccagagacaccaggaccacctgagacccaaggtgcccgccggcgtgcaggagctgacccactgccccgacacccccctgctgccccccagcgacagcagaggccacaacagcagcaacagccccagcctgcaggccggcggcgccgagggcgccggcgacagaggcagagacaccagatag

SEQ ID NO: 13151 - DNA, 753 bp, Artificial Sequence
  Description of Artificial Sequence: Synthetic coding sequence
atgggcgacatccccgccgtgggcctgagcagctggaaggccagccccggcaaggtgaccgaggccgtgaaggaggccatcgacgccggctacagacacttcgactgcgcctacttctaccacaacgagagagaggtgggcgccggcatcagatgcaagatcaaggagggcgccgtgagaagagaggacctgttcatcgccaccaagctgtggtgcacctgccacaagaagagcctggtggagaccgcctgcagaaagagcctgaaggccctgaagctgaactacctggacctgtacctgatccactggcccatgggcttcaagcccccccaccccgagtggatcatgagctgcagcgagctgagcttctgcctgagccaccccagagtgcaggacctgcccctggacgagagcaacatggtgatccccagcgacaccgacttcctggacacctgggaggccatggaggacctggtgatcaccggcctggtgaagaacatcggcgtgagcaacttcaaccacgagcagctggagagactgctgaacaagcccggcctgagattcaagcccctgaccaaccagatcctgatcagattccagatccagagaaacgtgatcgtgatccccggcagcatcacccccagccacatcaaggagaacatccaggtgttcgacttcgagctgacccagcacgacatggacaacatcctgagcctgaacagaaacctgagactggccatgttccccatgtag

SEQ ID NO: 13152 - DNA, 525 bp, Artificial Sequence
  Description of Artificial Sequence: Synthetic coding sequence
atgctgaccgagaacggccaggtgctgagctgcggcagcaacagcttcggccagctgggcgtgccccacggccccagaagatgcgtggtgccccaggccatcgagctgcacaaggagaaggtggtgtgcatcgccgccggcctgagacacgccgtggccgccaccgccagcggcatcgtgttccagtggggcaccggcctggccagctgcggcagaagactgtgccccggccagaccctgcccctgttcttcaccgccaaggagcccagcagagtgaccggcctggagaacagcaaggccatgtgcgtgctggccggcagcgaccacagcgccagcctgaccgacgccggcgaggtgtacgtgtggggcagcaacaagcacggccagctggccaacgaggccgccttcctgcccgtgccccagaagatcgaggcccactgcttccagaacgagaaggtgaccgccatctggagcggctggacccacctggtggcccagaccggcctgctgtggctgagagcctag

SEQ ID NO: 13153 - DNA, 228 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttctag

SEQ ID NO: 13154 - DNA, 252 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgcctag

SEQ ID NO: 13155 - DNA, 528 bp, Artificial Sequence
  Description of Artificial Sequence: Synthetic coding sequence
atgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagctacagcatcagacacagcatcagcatgcccgccatgagaaacagccccaccttcaagagcttcgaggagagagtggagaccaccgtgaccagcctgaagaccaaggtgggcggcaccaaccccaacggcggcagcttcgaggaggtgctgagcagcaccgcccacgccagcgcccagagcctggccggcggcagcagaagaaccaaggaggaggagctgcagtgctag

SEQ ID NO: 13156 - DNA, 231 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttcggctag

SEQ ID NO: 13157 - DNA, 456 bp, Artificial Sequence
  Description of Artificial Sequence: Synthetic coding sequence
atgagcatccccttcagcaacacccactacagaatcccccagggcttcggcaacctgctggagggcctgaccagagagatcctgagagagcagcccgacaacatccccgccttcgccgccgcctacttcgagagcctgctggagaagagagagaagaccaacttcgaccccgccgagtggggcagcaaggtggaggacagattctacaacaaccacgccttcgaggagcaggagccccccgagaagagcgaccccaagcaggaggagagccagatcagcggcaaggaggaggagaccagcgtgaccatcctggacagcagcgaggaggacaaggagaaggaggaggtggccgccgtgaagatccaggccgccttcagaggccacatcgccagagaggaggccaagaagatgaagaccaacagcctgcagaacgaggagaaggaggagaacaagtag

SEQ ID NO: 13158 - DNA, 270 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaaggacgccaagaccaccaacggccacggcggcgaggccgccgagggcaagagcctgggcagcgccctgaagcccggcgagggcagaagcgccctgttcgccggcaacgagtggagaagacccatcatccagttcgtggagagcggcgacgacaagtag

SEQ ID NO: 13159 - DNA, 1542 bp, Artificial Sequence
  Description of Artificial Sequence: Synthetic coding sequence
atggaggtgggcatcaccatccagcacgcctacgagaagcagcacccctggatcgacctgaccagcatcggcttcagctacgtgatcgacttcaacaccatgggccagatcaacagacagacccagagacagagaagagtgagaagaagactggacctgatctaccccatggtgaccggcaccctgcccaaggcccagagctggcccgtgagccccggccccgccaccagcccccccatgagcccctgcagctgcccccagtgcgtgctggtgatgagcgtgaaggccgccgtggtgaacggcagcaccggccccctgcagctgcccgtgaccagaaagaacatgcccccccccggcgtggtgaagctgccccccctgcccggcagcggcgccaagcccctggacagcaccggcaccatcagaggccccctgaagaccgcccccagccaggtgatcagaagacaggccagcagcatgcccaccggcaccaccatgggcagccccgccagcccccccggccccaacagcaagaccggcagagtggccctggccaccctgaacagaaccaacctgcagagactggccatcgcccagagcagagtgctgatcgccagcggcgtgcccaccgtgcccgtgaagaacctgaacggcagcagccccgtgaaccccgccctggccggcatcaccggcatcctgatgagcgccgccggcctgcccgtgtgcctgaccagaccccccaagctggtgctgcaccccccccccgtgagcaagagcgagatcaagagcatccccggcgtgagcaacaccagcagaaagaccaccaagaagcaggccaagaagggcaagacccccgaggaggtgctgaagaagtacctgcagaaggtgagacacccccccgacgaggactgcaccatctgcatggagagactgaccgcccccagcggctacaagggcccccagcccaccgtgaagcccgacctggtgggcaagctgagcagatgcggccacgtgtaccacatctactgcctggtggccatgtacaacaacggcaacaaggacggcagcctgcagtgccccacctgcaagaccatctacggcgtgaagaccggcacccagccccccggcaagatggagtaccacctgatcccccacagcctgcccggccaccccgactgcaagaccatcagaatcatctacagcatcccccccggcatccagggccccgagcaccccaaccccggcaagagcttcagcgccagaggcttccccagacactgctacctgcccgacagcgagaagggcagaaaggtgctgaagctgctgctggtggcctgggacagaagactgatcttcgccatcggcaccagcagcaccaccggcgagagcgacaccgtgatctggaacgaggtgcaccacaagaccgagttcggcagcaacctgaccggccacggctaccccgacgccaactacctggacaacgtgctggccgagctggccgcccagggcatcagcgaggacagcaccgcccaggagaaggactag

SEQ ID NO: 13160 - DNA, 414 bp, Artificial Sequence
  Description of Artificial Sequence: Synthetic coding sequence
atgagcagcgtgcagagccagcaggagcagctgagccagagcgaccccagccccagccccaacagctgcagcagcttcgagctgatcgacatggacgccggcagcctgtacgagcccgtgagcccccactggttctactgcaagatcatcgacagcaaggagacctggatccccttcaacagcgaggacagccagcagctggaggaggcctacagcagcggcaagggctgcaacggcagagtggtgcccaccgacggcggcagatacgacgtgcacctgggcgagagaatgagatacgccgtgtactgggacgagctggccagcgaggtgagaagatgcacctggttctacaagggcgacaaggacaacaagtacgtgccctacagcgagagcttcagccaggtgctggagtag

SEQ ID NO: 13161 - DNA, 120 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcctag

SEQ ID NO: 13162 - DNA, 2157 bp, Artificial Sequence
  Description of Artificial Sequence: Synthetic coding sequence
atgctgatgaccctggagatgaccgagctgaccgacccccaccacaccatgggcgactacaaggtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagacttccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 13163 - DNA, 2148 bp, Artificial Sequence; identical to SEQ ID NO: 9921
  Description of Artificial Sequence: Synthetic coding sequence

SEQ ID NO: 13164 - DNA, 360 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaactag

SEQ ID NO: 13165 - DNA, 420 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgtgagcgtgagccagcagcccgtgagcgcccccgtgcccatcgccgcccacgccagcgtggccggccacctgagcaccagcaccaccgtgagcagcagcggcgcccagaacagcgacagcaccaagaagaccctggtgaccctgatcgccaacaacaacgccggcaaccccctggtgcagcagggcggccagcccctgatcctgacccagaaccccgcccccggcctgggcaccatggtgacccagcccgtgctgagacccgtgcaggtgatgcagaacgccaaccacgtgacctag

SEQ ID NO: 13166 - DNA, 492 bp, Artificial Sequence
  Description of Artificial Sequence: Synthetic coding sequence
atgcacgacaagggcatcaccaccgccgccgtgtgcgtgtaccccgccagagtgtgcgacgccgtgaaggccctgaaggccgccggctgcaacatccccgtggccagcgtggccgccggcttccccgccggccagacccacctgaagaccagactggaggagatcagactggccgtggaggacggcgccaccgagatcgacgtggtgatcaacagaagcctggtgctgaccggccagtgggaggccctgtacgacgagatcagacagttcagaaaggcctgcggcgaggcccacctgaagaccatcctggccaccggcgagctgggcaccctgaccaacgtgtacaaggccagcatgatcgccatgatggccggcagcgacttcatcaagaccagcaccggcaaggagaccgtgaacgccaccttccccgtggccatcgtgatgctgagagccatcagagacttcttctggaagaccggcaacaaggtgtag

SEQ ID NO: 13167 - DNA, 456 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgtgagcgtgagccagcagcccgtgagcgcccccgtgcccatcgccgcccacgccagcgtggccggccacctgagcaccagcaccaccgtgagcagcagcggcgcccagaacagcgacagcaccaagaagaccctggtgaccctgatcgccaacaacaacgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcacctag

SEQ ID NO: 13168 - DNA, 252 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgcagctgagcagctag

SEQ ID NO: 13169 - DNA, 366 bp, Artificial Sequence
  Description of Artificial Sequence: Synthetic coding sequence
atggccggcagacccctgagaatcggcgaccagctggtgctggaggaggactacgacgagacctacatccccagcgagcaggagatcctggagttcgccagagagatcggcatcgaccccatcaaggagcccgagctgatgtggctggccagagagggcatcgtggcccccctgcccggcgagtggaagccctgccaggacatcaccggcgacatctactacttcaacttcgccaacggccagagcatgtgggaccacccctgcgacgagcactacagaagcctggtgatccaggagagagccaagctgagcaccagcggcgccatcaagaagaagaagaagaagaaggagaagaaggacaagtag

SEQ ID NO: 13170 - DNA, 2997 bp, Artificial Sequence; identical to SEQ ID NO: 12130
  Description of Artificial Sequence: Synthetic coding sequence

SEQ ID NO: 13171 - DNA, 504 bp, Artificial Sequence
  Description of Artificial Sequence: Synthetic coding sequence
atgggcaccaccgcccccggccccatccacctgctggagctgtgcgaccagaagctgatggagttcctgtgcaacatggacaacaaggacctggtgtggctggaggagatccaggaggaggccgagagaatgttcaccagagagttcagcaaggagcccgagctgatgcccaagacccccagccagaagaacagaagaaagaagagaagaatcagctacgtgcaggacgagaacagagaccccatcagaagaagactgagcagaagaaagagcagaagcagccagctgagcagcagaagactgagaagcaaggacagcgtggagaagctggccaccgtggtgggcgagaacggcagcgtgctgagaagagtgaccagagccgccgccgccgccgccgccgccaccatggccctggccgcccccagcagccccacccccgagagccccaccatgctgaccaagaagcccgaggacaaccacacccagtgccagctggtgccctag

SEQ ID NO: 13172 - DNA, 615 bp, Artificial Sequence
  Description of Artificial Sequence: Synthetic coding sequence
atggaggcccaggcccagggcctgctggagaccgagcccctgcagggcaccgacgaggacgccgtggccagcgccgacttcagcagcatgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagctacagcatcagacacagcatcagcatgcccgccatgagaaacagccccaccttcaagagcttcgaggagagagtggagaccaccgtgaccagcctgaagaccaaggtgggcggcaccaaccccaacggcggcagcttcgaggaggtgctgagcagcaccgcccacgccagcgcccagagcctggccggcggcagcagaagaaccaaggaggaggagctgcagtgctag

SEQ ID NO: 13173 - DNA, 1023 bp, Artificial Sequence
  Description of Artificial Sequence: Synthetic coding sequence
atggccgccgccagagacccccccgaggtgagcctgagagaggccacccagagaaagctgagaagattcagcgagctgagaggcaagctggtggccagaggcgagttctgggacatcgtggccatcaccgccgccgacgagaagcaggagctggcctacaaccagcagctgagcgagaagctgaagagaaaggagctgcccctgggcgtgcagtaccacgtgttcgtggaccccgccggcgccaagatcggcaacggcggcagcaccctgtgcgccctgcagtgcctggagaagctgtacggcgacaagtggaacagcttcaccatcctgctgatccacagcggcggctacagccagagactgcccaacgccagcgccctgggcaagatcttcaccgccctgcccctggacatccccgagtgcagcggcaagaccagctgcatcatccagagcatcctggacagcagatgcagcgtggcccccggcagcgtggtggagtacagcagactgggccccgacgtgagcgtgggcgagaactgcatcatcagcggcagctacatcctgaccaaggccgccctgcccgcccacagcttcgtgtgcagcctgagcctgaagatgaacagatgcctgaagtacgccaccatggccttcggcgtgcaggacaacctgaagaagagcgtgaagaccctgagcgacatcaagctgctgcagttcttcggcgtgtgcttcctgagctgcctggacgtgtggaacctgaaggtgaccgaggagctgttcagcggcaacaagacctgcctgagcctgtggaccgccagaatcttccccgtgtgcagcagcctgagcgacagcgtgatcaccagcctgaagatgctgaacgccgtgaagaacaagagcgccttcagcctgaacagctacaagctgctgagcatcgaggagatgctgatctacaaggacgtggaggacatgatcacctacagagagcagatcttcctggagatcagcctgaagagcagcctgatgtag

SEQ ID NO: 13174 - DNA, 873 bp, Artificial Sequence
  Description of Artificial Sequence: Synthetic coding sequence
atggccgagctgaccgccctggagagcctgatcgagatgggcttccccagaggcagagccgagaaggccctggccctgaccggcaaccagggcatcgaggccgccatggactggctgatggagcacgaggacgaccccgacgtggacgagcccctggagacccccctgggccacatcctgggcagagagcccaccagcagcgagcagggcggcctggagggcagcggcagcgccgccggcgagggcaagcccgccctgagcgaggaggagagacaggagcagaccaagagaatgctggagctggtggcccagaagcagagagagagagaggagagagaggagagagaggccctggagagagagagacagagaagaagacagggccaggagctgagcgccgccagacagagactgcaggaggacgagatgagaagagccgccgaggagagaagaagagagaaggccgaggagctggccgccagacagagagtgagagagaagatcgagagagacaaggccgagagagccaagaagtacggcggcagcgtgggcagccagcccccccccgtggcccccgagcccggccccgtgcccagcagccccagccaggagccccccaccaagagagagtacgaccagtgcagaatccaggtgagactgcccgacggcaccagcctgacccagaccttcagagccagagagcagctggccgccgtgagactgtacgtggagctgcacagaggcgaggagctgggcggcggccaggaccccgtgcagctgctgagcggcttccccagaagagccttcagcgaggccgacatggagagacccctgcaggagctgggcctggtgcccagcgccgtgctgatctag

SEQ ID NO: 13175 - DNA, 309 bp, Artificial Sequence; identical to SEQ ID NO: 11300
  Description of Artificial Sequence: Synthetic coding sequence

SEQ ID NO: 13176 - DNA, 279 bp, Artificial Sequence
  Description of Artificial Sequence: Synthetic coding sequence
atgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatctag

SEQ ID NO: 13177 - DNA, 3735 bp, Artificial Sequence; identical to SEQ ID NO: 10414
  Description of Artificial Sequence: Synthetic coding sequence

SEQ ID NO: 13178 - DNA, 2676 bp, Artificial Sequence
  Description of Artificial Sequence: Synthetic coding sequence
atggaccagcccgaggccccctgcagcagcaccggccccagactggccgtggccagagagctgctgctggccgccctggaggagctgagccaggagcagctgaagagattcagacacaagctgagagacgtgggccccgacggcagaagcatcccctggggcagactggagagagccgacgccgtggacctggccgagcagctggcccagttctacggccccgagcccgccctggaggtggccagaaagaccctgaagagagccgacgccagagacgtggccgcccagctgcaggagagaagactgcagagactgggcctgggcagcggcaccctgctgagcgtgagcgagtacaagaagaagtacagagagcacgtgctgcagctgcacgccagagtgaaggagagaaacgccagaagcgtgaagatcaccaagagattcaccaagctgctgatcgcccccgagagcgccgcccccgaggaggccatgggccccgccgaggagcccgagcccggcagagccagaagaagcgacacccacaccttcaacagactgttcagaagagacgaggagggcagaagacccctgaccgtggtgctgcagggccccgccggcatcggcaagaccatggccgccaagaagatcctgtacgactgggccgccggcaagctgtaccagggccaggtggacttcgccttcttcatgccctgcggcgagctgctggagagacccggcaccagaagcctggccgacctgatcctggaccagtgccccgacagaggcgcccccgtgccccagatgctggcccagccccagagactgctgttcatcctggacggcgccgacgagctgcccgccctgggcggccccgaggccgccccctgcaccgaccccttcgaggccgccagcggcgccagagtgctgggcggcctgctgagcaaggccctgctgcccaccgccctgctgctggtgaccaccagagccgccgcccccggcagactgcagggcagactgtgcagcccccagtgcgccgaggtgagaggcttcagcgacaaggacaagaagaagtacttctacaagtacttcagagacgagagaagagccgagagagcctacagattcgtgaaggagaacgagaccctgttcgccctgtgcttcgtgcccttcgtgtgctggatcgtgtgcaccgtgctgagacagcagctggagctgggcagagacctgagcagaaccagcaagaccaccaccagcgtgtacctgctgttcatcaccagcgtgctgagcagcgcccccgtggccgacggccccagactgcagggcgacctgagaaacctgtgcagactggccagagagggcgtgctgggcagaagagcccagttcgccgagaaggagctggagcagctggagctgagaggcagcaaggtgcagaccctgttcctgagcaagaaggagctgcccggcgtgctggagaccgaggtgacctaccagttcatcgaccagagcttccaggagttcctggccgccctgagctacctgctggaggacggcggcgtgcccagaaccgccgccggcggcgtgggcaccctgctgagaggcgacgcccagccccacagccacctggtgctgaccaccagattcctgttcggcctgctgagcgccgagagaatgagagacatcgagagacacttcggctgcatggtgagcgagagagtgaagcaggaggccctgagatgggtgcagggccagggccagggctgccccggcgtggcccccgaggtgaccgagggcgccaagggcctggaggacaccgaggagcccgaggaggaggaggagggcgaggagcccaactaccccctggagctgctgtactgcctgtacgagacccaggaggacgccttcgtgagacaggccctgtgcagattccccgagctggccctgcagagagtgagattctgcagaatggacgtggccgtgctgagctactgcgtgagatgctgccccgccggccaggccctgagactgatcagctgcagactggtggccgcccaggagaagaagaagaagagcctgggcaagagactgcaggccagcctgggcggcggcagcagccagggcaccaccaagcagctgcccgccagcctgctgcaccccctgttccaggccatgaccgaccccctgtgccacctgagcagcctgaccctgagccactgcaagctgcccgacgccgtgtgcagagacctgagcgaggccctgagagccgcccccgccctgaccgagctgggcctgctgcacaacagactgagcgaggccggcctgagaatgctgagcgagggcctggcctggccccagtgcagagtgcagaccgtgagagtgcagctgcccgacccccagagaggcctgcagtacctggtgggcatgctgagacagagccccgccctgaccaccctggacctgagcggctgccagctgcccgcccccatggtgacctacctgtgcgccgtgctgcagcaccagggctgcggcctgcagaccctgagcctggccagcgtggagctgagcgagcagagcctgcaggagctgcaggccgtgaagagagccaagcccgacctggtgatcacccaccccgccctggacggccacccccagccccccaaggagctgatcagcaccttctag

SEQ ID NO: 13179 - DNA, 240 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgtag

SEQ ID NO: 13180 - DNA, 543 bp, Artificial Sequence
  Description of Artificial Sequence: Synthetic coding sequence
atgggcgacaagaagagccccaccagacccaagagacagcccaagcccagcagcgacgagggctactgggactgcagcgtgtgcaccttcagaaacagcgccgaggccttcaagtgcatgatgtgcgacgtgagaaagggcaccagcaccagaaagcccagacccgtgagccagctggtggcccagcaggtgacccagcagttcgtgccccccacccagagcaagaaggagaagaaggacaaggtggagaaggagaagagcgagaaggagaccaccagcaagaagaacagccacaagaagaccagacccagactgaagaacgtggacagaagcagcgcccagcacctggaggtgaccgtgggcgacctgaccgtgatcatcaccgacttcaaggagaagaccaagagcccccccgccagcagcgccgccagcgccgaccagcacagccagagcggcagcagcagcgacaacaccgagagaggcatgagcagaagcagcagccccagaggcgaggccagcagcctgaacggcgagagccactag
